United States Patent 10,724,096 (METHODS AND COMPOSITIONS FOR INHIBITING AND TREATING NEUROLOGICAL CONDITIONS) - sequence listing, part 21

SEQ ID NO: 186 - DNA, 248408 bp, Homo sapiens
acactgatacttacattggctaatttttaattcttaattgttaatcccagtggagcaacggtccttaactcagggccccctgacagaggaattgtaaaataccacacgtttcccacaagttgcatacaatgctttatgtgcatgggtatttttctgaggagagttcctagaattttcatcaaatttcccaagaaatttatgaccccaaaagttctggaacaaaaccctgaagagccagggccatcgggcttaaccctcctctgtgctgtttccgttttctcaggtgtggcttttgaacctgccgacacagagtgaggttgacacagaccagtccagtcgacaggggagctgcagcagatagcagggggcatggggaaggggctctgcctcgcaaggtgctttgtgcacatcttcaccctgaagtcatcaccagggtccctgtgggctcctaggaccccaagtcacttcagagacctctcatggctcagcagctgcctcaggcattgacttgggctgagtctgccatcttcctgggattggggtcgtctttagccctggcaagttggaaactgaaatacactctccagacgaaggcagcagcagggagtgtggggacctgggttccagccttggccattctgctaaatacatttataaccctgcagtcatttcttttctctgggcctcagtttccctgtctgttaaatgaggtgattggactgtgttcattgttttcacactatgttacggcatatcgaagagttcaatcattcctttctttttcaaattttgtagagacagggtcatgctctgttgcccaggctgcagtgcagtggcacgatcatagcccatggcagcctcaaactcgtggactcaagtgatcctcccacctaagcctcccgagtagctggaattacagacatgggcctctatgctcagctcaaacatttctttaatggctgtttactgagcacatactatgtgtcagccactgttctaggcactggggaatacagcagtgatgaagacaaactctaatgtgggaaagaaacaatgacagagtaaactaagtcctggcgccaggactaagccagccctggggtgccgtgctcctcttcattctctctcatccctgcttgttttcctcatctgtctctctggccaactgtgctgttcccaaagccctcgactgcaattactttctcctggtttacccagcacactgtgtgggacagaaggaggacagtgacatttgctaaattaattgtaacagaaaaaagtcagctttaaaagtcataactctccacacccaccaggatggtgacaattttatattgtttgtttttgagacagagtctcactctgtcacccaggctggagtgcagtggcatgataccagctcaccacaacctccaccttccgagttcaagcaatcctcccacttcagcctcatgaacagctgagaccacaggtgtgtgccaccatgcccggctagcagtttttggattttttagtagagatgaggtttcaccacgttgcccaggctggtcttgaactcgtgggctcaagcgatctgcctgcctcagcctcccaaagtgctgggattacagatgtgagccactgttcccggccctggatggtgataattaaaaacaaaaacaaaaccagaaaataacaagtgttggtgaggatgtggggaaattgcaaccctcatggattgctggtgggaatgcaaaatggtgcagccgctgtggaagacagtctggcagttcctcaaaacgttgagcacagagttctcatgggacccagcaattccactcccaggcatctacccaagagaggcgaaagcaaactcccacaaaaaaaacatgaatgttgggccgggcgcggtggctcatgcctgtaatcctagcactttgggaggccgagatgggtggatcacgaggtcaagagattgagaccattctggctaacgcggtgaaaccccgtctctactaaaaacgcaaaaaattacctgggtgtggcggtgggcgcctctagtcgcagctactcgggcggctgaggcaggagaatggcatgaacccgggaggcggagcttgcagtgagccgagattgcatcaccgcactccaacctgggcgacagagcgagactccgtctcaaacaacaacaacaacaacaaaacatgaatgttcccactattagcagcactaatagcagtactattcacaatagcccaaaggtggaaacagcccaaatatctatcaacagatgaatggataaacaaaatgtggcatagccatacaataggatatcattcagccatgaaaaggaataaagtgctgattcatgccacaacatggttggaccttgtacacatgatgagagaagccagacacgaaaggccacgtagtatagggttccatgtacatgaaaaggccagaggggccaatctgcagagccagattttagaatgctggcggccaggggctgtgtggaggaagaattggggagtgactgttaatgggtatagggttttctgttagggtgatgaaaatgtcctggaattagataatgatgatggttacacaacatcataagtgtactagatgtcactaatgataagttttatattgtctgcatgttgctgcaataaaaacaattttaaaaacattaggctgggcgcagtggctcacacctctaatctcagcactttgggaggccgaggcaggtggattacttgaagccaggagttcaagaccagcctggccaacatggtgaaacactgtctctactaaaaacacaaaaaaattagctgggtgtggtggcaggcgcctgtagtcccagctactcaaaagactgaggcaggagaatcgcttgaaccagggaggcagaggttgcagcgagctaagattgtgccactgcactccagcctggatgacagagagagatcctgtctcaaaaactaaaacaaaaaaccctgccaaaataaaacaaacaaaagaaaacattatatctctagctgggcgtggtggctcatgcctataagctcaacactttgggaggccaaggtgggaggattgattgaggccaggggtttgagaccagcctgttcaacaaagcaaggcctgtctctacaaaaaaaaaaaaagcaaaagaaaaaattagctgggcatggcgatgtgcacctgtagccccagctactctgaaggctgaggtgggaggatcacttgagcccagaaggttgaggctacagtgagctgtgatagcacctctgcactccagtctgggcaatagagcaagaacctgtctctaaaaacaaacaaacaaacaaacaaaaacactcctatcttaaatgtaatgtgggacactggaacagaaagaggacattagtaagaaaactagtgacacacaaatacagcttgcagtttcactgatagtgacatgctatgttggtttcctaattgtgacaaatgtaccccagtactgtgggattttaagagaagagaaactgtgaggggtggggcataagggaactttctgtattgttttgtgacttttctgtaaatctaaaattatttcaaaattaaactttttttttttttgagacagtctcgctctgtcacccaggctggagtgcagtgacgtgatctcggctcactgaaacctctgcctcccggattcaagcaattctcctgcctcagcctcccgagtagctgggactacaggcgtgtgccaacacgcccggctaatttttgtatttttagtagagacagggttttaccatgttggccaggctggtcttgaactcctgacctcgtgatccacccaccttggcctcccaaagtgctgggattacaggcatgagccactgcatctggcctaaacattacttttttaaaactcctatgtacctcctaaaaagaaggtaattcggtctctggaaggttcttttgtctgcctatggcgcacttttgggtgtgggtttacaaatcaaggcactggagctaactccataggagagggagaagaatctggaattctcagcctgaaagtgcagggatgagaagagacaggcagatgggagaggagcttagactggaacggggctgggctggggccaggaagccccttgcgagggactttgcagaacaggaatgtccaacactgacgctacaaactagagatgcacaggctggagaccacctctacacatgtgcttgttggtcctcggttttgtcaaaataatttgagccaatacataaaaaacagctgatctcacatgaaaattggaatttccaacttctctggaaacatctgaagatatgctaagtctctgaaaacttaaccccctctgcttcctaaaatcaaaaaggaagtcctgaggttaacttcaaccaaggttgcaagttcccctctgtagcaggctgagtggtggcccccaaaagcttcccttgtcaaacccctgaacctgtgaagtgaccgtatttggaaaaaagggtctttgcagatgcaaaggaccgctagatgagatcagcccggattatctaggtggcctctaaatccaatgacaagtgcttttataagagaaagacaaggctggccaggcgcggtggctcacgcctataatcccagcacttagggaggccaaggtgggcaggccatctgaggttaggagtttgagaccagcctggccaacacagtgaaacccatctttactaaaaatacaaaaatgagccgggtgtggtggtgggtgcctgtagtcccagttactcaggaggctgaggcaggagaatcgcttgaactcgggaggtggaggttgtagtaagccaagattgtgccactgcactccaatctgggtgacagagcaaggctctgtctcaaaaaaaaaaaaaaaaattgaaatactactctaccagttggcacagagccctcctcctgggaccccagagttcttcacaattcagcaagtaagaataaccaccgcaggggtcttcctgtgtccgggcccaaacctccctgctgattgagctgtcctcctgggtaatatttctttactgcatggattggggtgggtgtcgggtgcctgggccccgatggaaaagaacaggtggcatttgttgggcctcagttcagctgtcccgggaagcacagaggcccctgggatttcaaggcaacgtctctatccccctgcgcaatccccgtggagacaggcagacaggaatgtctacaccagagaccctgggatgggaggagtgcagatggggctcccagacacagggggaggccctggaccacccaaagtctctctgcaactccaccagagagggctgagaggagagccgtggtctggtggaaaaacctaactgggcgatgaggcagttggcccaagtagaagtcagaggttaggggtaagaggtagtacactttattgaccgggttctctcaacatgttgcaacctctggcaaagccagatcctgggctttgccaccatcccatccaccaaagacagaagagaatgcatctcatgaacatccacgtggcctccagacagcagagcacaggggcgggtgtggggagggaggctgccagccaggggtgggtggacgaggggcgaaagcgctgggtgccgggctgggggcacccctgaggcccctccagacctggccagcccctcactcccccagttgaggtttcgtgtggttcacagtgagactggcttagattggcagcgggcgatggcagacagatgccctccacgctccctacccgccctggccagactcacagagctggcaagagggagagacggaaaatcccgttccccgtgtctccctccgggacagggaagccccttctctggaggggtaaaggggagaggcctagtctctggacatcccccaggctactaaggaagggccattcactcctggctcagaagtttctagaacatcttggtgaaagtgcccgccattactcccaattagaaaaaggtttttgaaatctaggagttgactggggtgcctcaaaccaaacagtaaaaaccctggtaagacctaggtttaaaaaggcagctctacctttgcttaggaggctagggaggtccgtgaaggcgttggctcagggcagcaggggtaaggagtgccctgggaatggggcagggaccaggggcaagatgcaggaagcggtgatccatgggacatggcaggtcgtctttcagtgctgcaggcctgggctcggagggcagctgggggcctccgtgggcacatctgccaggcaggcaccgggtcctctgccccaccgggagaagcaggggccccccatcaggccttgtgactgccgttggctacaggctcgttgtggccagctgtgaagtctgcggcgggctgaagccccagcatctgccgctgcaccagcttggcgtagaggccgccctgggccagcagctgctggtgggtgccctgctgcactacgcggcccttgtccagcaccacaatgaggtgcgcgtgctccacggtgctcagccggtgcgcgatgatgagtaccgtgtgcttctgcaggttgccatggatggcctgctggatctgcggggacagtgggggcctggcttgcatggcacggacgccccacccgcaaccgtgcttcatgccacggcctatgggctgatgcttaacctctctgaggctcagttcacaaacgatggccagcttcctgggtttttcttaaagggagacagctcagggccagacacaatgaggcacctggtgaatgggggatcagctctaccctggccctccagtcttctggtccttcccttccccctcctttttttttttttttttttttaagtcttgctgtcacccaggctggagtgcggtggtgcgatctcagctcactgcaacctctgcctcgtgggttcaatcgagtctcacgcctcagcttcccaagtagctaggggattacaggtgcccgccaccatacccagctaatttttgtatttttagtagagacagggtttcaccatgttggccagactggtctcgaacacctgactttgtgatccgcctggcctcggcctcccaaagtgctgggattacaggtgtgagccaccgcgcctggccttccttgtttcttatctgccttccccactggaatggaaacaccatggggacaagggtctttgtctagttagcccacgataaccccagaatggtgcctggtgcctggtgcctgagaagagctcagtaactctctgtgtaacaaatgaatcaatccgcgcatagactgaggttgctagccatctgcaaatacatgactgggcccacctgaccagtgagaatgcgactcagaggggaagcactagcttgaggtcacacagttataaactgtaggacggagctgctaatccaggtatccccattctgttttttgtttttgtttgtttgtttgttttttcagatggagtctcactctgttgccaaggctggagtgcagtggtgcaatctcggctcattgcaacctctgcttcccaggttcatgctattctcctgcctcagcctcccaagtagctaggattacaggcacctgccaccatacctggcggacttttgtatttttagtagagatggaatttcaccatgttggcccggctggtcttgaactcctgacctcaggtgatccacccgcctcggcctcccaaagtgctgggattataggcataaaccactgcgcccagcctttttttttttttttttgtagatggagtctcactctgtcgcccaggctagagtgcagtggcacaatctcagctcactgcaacctccatctcccgggttcaagtgagtctcctgcctcagcctcccgagtagctggggttacaggcatgcaccaccatgcccagctaatttttgtatttttagtagagacagggtttcactgtattgaccaggcttgtctcgaactccggacctcaagtgatccacctgccttggcctcccaaagtgctgggattataggcatgagccatcatactgggcctattttattttgttttgttttgtctgtttgtttgagccagatggagtctggctctgtcgcccaggctggagtgcagtggcacaatctcggctgactgcaacctccacttcccaggttcaagcaattctcctgcctcagcctcccaagtagctgggattataggcatgtgctaccacacctggctagtttttgtatttctagtagagatggggtttcaccatgttggccaggctggtctgcaactcctgacctcaggtgatccacctgcttcggcctcccaaagtgctgggattacaggtgtaagccaccactcatgacccaggtctccccattctgatgccttctcttgccccacaccatacagctctgcctggagcctggaggctgggtccagagtggctcctggctccccactctcaacaccaggaattcaccagcccaggaggctgatagtctgggagagctcctggggcccgtctcttctcagcatccatctgctgggcgatgggggctctggccacctggagccgctcctgcccccgcattgcccaccaccctgtgactcaccagatactcgctctcggcatccaaagcgctggtggcttcatccaggatgaggactggggggttccgcaccagagcccgggccatggccacccgctgcttctggccacctgacagctgggcgcccttctcccctgtctctgtatggtggaggcacagagacaatttagcaatgggtgaggccgggcagcaccggggaagagtgagaggccctgccctgcagctgtggaaagggcgggctggaacccacaacttgaaagctcatgaaatgatgttccccccacccaactcataaggggcatgcagattaagcctacatgcaaattgatagcaagttaccaattttcactcattcatttggcagaaacccaaacatctgatagcacacagtgcaggtgaggctgcagggagacaggccctcacccgtcctcctggagaaggggagttggagcgagccccatggcttgaagagctgcagcaataaccctgggtctatgagtctgtgcagtgcaaaggttgtgtgtattcaccacagatgtgtggcctgtggccccgcaagcccacctggaccaattttccccatggaccgacttcctcccatgcacaacaatatagacacaggtcacctgtgacccacagcgctgttattgcaaaaaataaaacaaatagactcaaatgtccatcaataggaaattgagtcaatcaattattattattttagagacagggtctcactctctcacccacgctagagtgcagtagtacaatcactgcttactgtagcctcaaacttctgggttcaagcaatcctccagcctcagccttctgagtaactgagactacaggtgcatgccaccacacctggctaacttaaaatatttttctgtagaggtggggtctcactacattgcccaagctgttctcaaacccctggcctcaagcgatcctcttgccttggcctccaaagtgctgggattacagacgtgagccactgcacctggccacgccaccagttctttattatttcatttttctttcattgagatgaaactgacataacataaacataaccattgtaaagtgaataatccgggctgagcacggtggctcccagcactttgggaggccaaccaaggtgggcgggtcacaaggtcaggagattgagaccatcctggctaatatggtgaaaccctgtctctactaaaaatacacaaaattagccgggtatggtggcacatgcctgtaatcccagctactcgggaggccgaggcaagagaatcacttgaacccgggaggaagaggttgccgtgagccgagatcgcgccactgcactccagcctgggcgacagagcgagactccatctcaagaaaaaaaaaaaaagtgaataatccagtggcatttagtgcattcacaatgttgcacaaccaccacctctactgaatttcaaaacactattctaaaataatatatatttattatatcaattaattactagaactacttaagttcatatcgaggtaatttttttaaaaattagtgtatttagtatattttaatttaaaaattcttttaaattgacaagtaaaaatagtttgtatttaatggtgtacaacgtgatgctctgaaatacatatacactgtggaatagctaaatcaagccagttaacatatacattatctcacatatttatcacttttttaaagagagaacacttaaaatctactctcttagctattttcaagtacacagtacactgttactaaatatagctggccagacacagtggctcacacctgaaatcccaccactttgggaagccaaggcaggcagatcacctgaggtcaggagttcaagaccagcctggccaaaatagtgaaaccccgtctctactaacaatacaaaaaaaaattagcaaggtgtggtggtgggcacttgtaatcccagctactcaggaggctgaggcaggagaatcgcttgaacctgggagacggaggttgcagtgaggcaagattactccactctactccagcctgggcgacagagtgagactgtctcaattaaaacacaaacaaacaaaaaactatagtcaacaggtctcttgaccttattcctaagggaaaatttttatcttttgatcaacatctccccaacccccctatacattgtatatatttaattattgaaaaggggctattcgtgtggttcaaaaatctaaaaatacaggctggatacaatggctcatgcctgtaatcccagcactttgggaggcaggaggattgcatgagcccaggaatttgagaccagcctgggaaacatagcaagaccccgtctctacaacaaaaataaaaagtggggtggaaggatggcttgagcccaagaggttgaggctgcagtgagccgtgatcacgccactgcactcccacctgggtgacagagcaagcccctgcctcaaaaaaaaaaaaaaaactaaaaaaactaaaaatatataaaactctaaataatgaaaagtttaagttctttcttcagttccctcctgctcccaccaaaacgtctttcattagttgcttacatgtccttgtctagtttctttatgcaaatatgaacatgttatttttatctccccagtcctttaataggaaaaaaaaaacccagctccttatgctctgcacctggctcttctcactcagcatcctatctcagtgacctttccatactgctatatggagagctgcctcctcctctgcctccacctcctcctccgcctccacctcctcccccttcttctacttcctctttttcccagcagcataatattccagtgtatgggcttctataataatttacttaataaatattttgctgagtcacagcacagtggctcatgcctgtaatcccagcactttggggattgcaggaagattgcttgagcgcaggaggttcgagtctggccagggtaacgtagcgggaccccatctctacaaaaaaaagagcaggtggcagggggcagtgcttaactcagagggttatgtccctgagggtgaccctgtgggcccaggagaggggccacccccagctccacacctgtgctgtagccgtcctggagttccatgatgaagccgtgggcattggccttctgtgcggcctccaccaccatctcgaaaggcacagtgggcaggccgtaggagatgttatccgtgatggagcgggcgaacagcacgggctcctggctcaccagggagatctggggaggagggagcatggagcatgagaggccaggaatgtgttcatccagctgtccccagcagccttgctgcctggggcctggagacaccagcagtctcaggcctgaaacctgatcagggcccagtgactgcactgagctgcctctcttcttccccaacagtgactcccgcctgtacccacaagccctcagcctcccctaatcagcaaactggggcctgctacatttgctgctctgggataagccaagttccctgacctctaagagaaagctcactggccatccctgtcctgaaaaaaagaaagagggatagaatatagaatgttgctgtgaatgagtctgctcatctcaggaagcaagaggccacagcagggctccaggtcacacagactgccctggcggtggtcccctcccttctaagagaacaatttaaaggagctatcatctctagattccagtttcaggaatctgggcctacaaaaataatagtatggccaggcctggtggctcatgcctgtaatcccagcacttagggaggcagaggcaggagaatggctttagtctaggagttcaagaccagcctgggcaacacagaaagaccccatatctacaaaatgaaaaaaatatatagtatggaagatatcattgcaacaccataagtagcaaaagttaattagttaattaattaaattaaaatggaaacaatctaggtgtccataaatggggattggttaaatagtgacagtgcatccttaaaactgaattgtaatagatacatatacacagcatgattctatttttgtttaaaaaaattataaacgtgtaccttcatatattgatatatttctataaagataggaaacacattgaaaaggatatttactaaactgttaacactggctacctccatgtggtggaattcaaaaggtaaggtggaggggaacattcatgtcttagttacaagattcattacaactatgagaatatgattagcttgtagcattttattgttttatgtttatagaaattaacattttaaatttaaaaatagaggccagccatggtggttcacacctgtaacaccaacagtttgggaggctaaggtgggaggatggcttgagcccaggagtttgagatcagcctgagcaacacagtgagaacccgtctctacaaaataattaaaaattggccaggtgtacacggtggctcatgcctgtaatcctagcactttgggaggccgaggtgggcggatcacctgaggtcaagagtttgagaccagcctgaccaacatggagaaactctgtctctactaaaaataaaaaattagctgggtgtggtggtgcatgcctgtaatcccagctactcaagaggatgaggcaggagaatcacttgacccctcgaggcggaggatgtggtgagctgagatcgtgccattgtactccagcctgggcaacaagagcaaaactccatctcaaaaaaaaaaaaaaaattgaccagatgtggtggtgtgcacctatagtccctcaggaggctgatgtgggaggattgcttgagcccaggaggtcgtggctgcagtgaaccatgatcacaccaccacattccagcctgggtgacagagtgagatcctatctcaaacaaaaagtacataaatagtccaggcgccatggctcactcccagcattttgggaggccaaggcgggtggatcacttgaggtcaggagttcgagaccagcctggccaacatggtgaaaccttgtctctactaaaactacaaaaaattagccgggtgtggtggtatgtgcctgtagtcccagctacttgggaagctgaggcaggagaatcgcttgaacccaggaggaagaagttgcagtgagccgagatcatgccacagcactctagcctgtgcgacagagcgagactccatcttaaaaaaaaaaaaagaaaagaaaaagtacataaataaataattaagagaggctattcatgaaggaaaaccaaatggccaatatatgaaaaggtgtttaatatcttcagtcatcaggaaaacacaaaagaccacaataagctaccactacattctcaccagttagcaaaaattcaggactgacaatgttaggtgtctgagaatcgaagcgtggtacctactgcaaagtgtgaacggctctgcccagggggctcttctaaaactttggtgagcagcagcctggtggcctcccacttggcaccatttcacaacaatctacctctggttacatgcacatggtgtgggcagatttcacaacccatggccctcaccaccatctcgaacttggctaggagttctggaatctctgtgccaacactcaggctttcacataatttatgttgatgatgtaaacggtgctcccttaatagtttatatttcttggacagtgcacaacctgagcaaccatccagggcatccctgctcttaggccagcacagggacaggtgttatggttcctttcctgaaaggattactaaaaactgtccagtcatgaatagcctattttgagtactggagatgacctaaatgtggaacagctgaaactctccttcactgctagtagaatgtaaattgtaaaatgtaaattggtataaccacctggggatagctgttgtgacagaaactacggcagttggggatgtacatccactatcaccaagctttctactcttaggattataccttgggagaacgtactcatgtacaacagaaaacatagacaaaattgtccacatcccacactggtatttttggtaatggtaaaacaaaacaaaacaaaacaaaactgaaaaacaggccgggggcagaggctcacacctgtcatcccagcactttgggaggctgaggcaggaggatcacttgaggccaggtgtttgagatcagcctgggcaacatggtgagaccacatttctacaaaaaaataaaattagctgggcataatggcatgtgcctgcagtcccagctacttgggaggctgaggtgggaggatgacttgagcacaggactctgaggctgcagtaagttgtgactgtgccactgcactccagcctgggcaacagagggagaccctttctcaaaaaaataaaaataggccaggtgcagtggctcatgcctgtaatcccagcactttgggaggccgaggcgggtggatcacgaggtcaggagatcgagaccatcctggctaacatggtgaaatgccgtctctactaaaaatacaaaaaattagccaggcgttgtggtgtgcacctgtagtcccagctactcaggagactgaggcaggagaatggcgtgaacccgggaggtggagcttgcaatgagccgagatcgtgccactgcactccagcctgggcgacagagcgagactctgtctccaaaaaaaaataaaaataaaaataaacaaataaataaaataaaatataaagggaaacaacccagcgaggcacggtggctcacgcctataaacccaacactttgggaggccaaggcaggctgatcacctgaggtcaagggttcgagaccagcctgggcaacacggtgaaaccctgtctgtactaaaaatacaaaaattagtcaggcatggtgacgcactcctgtaatcccagctactaggggggctgagataggagaatagcttgaacccgggaggcggaggctgcagtgagctgagatctcaccactgcactccagcttgggcaacagagcaagactcatctcaaaaaacaaaaataaagggaaacaacccaaatacccagaatgcataaataattgtgataaacatatgtatagtgggttaccacccagcaatgaaaatgaatgaactctgtccccagcctcaacctggatgactcacaatgtcgagtgggagacacaagacacaaactaatccacacaccaatcacgattctacccagatgaagttccgagcaggcagcacagagctcaggggtgcacacagagatggcagaaccaatgaaaagcaagagcatgaagactctaaaagtcaacacattacttcttggggaaagagaagggacacatggcggggggtaggaggcttctggagtgccagaatgttctatttcttttttttcatgagacagagtcttattctgttgcccaggctgcagtgcagtggcccagtctcggctcactgcaacctctacctcccgggttcaagtgattctcgtgcctcagcctcctgaggagctgagattacaggcatgtgccaccacacccggctaatttttgtatttttagtagagatggggtttcgccatgttggccatgctggtcttgaactcctgagctcaagcagtccacctgccttggcctcccaaagtgctgggattacaggtgtgggccatcacatctgccctttttttcttttttaatagagacggagtctcactatgttgtccaggctggcctcaagggatcctccagcctcagcttcccaaaatgctgggattacaggtgtgagccaccacgtctggacaagaatgttctgtttctctaggagggcattgtaattggtgataattctttgaactgtccatttatctctagtgccctcttccgcacctgttacagctcacaagaaagacggttagatgcagaaagggcggagaagtgtggcccaggcccgtgcacataccacacggtgcaagtacttgtggtcgtaggcgctgatgggcttgccgtccagcagcacccggcccccctccagggggtagaagttctccaggatgttgacacaggagctcttcccactgcccgagggccccaccagggccgtcaccttgccgggggacaggctgaaggagacattctgcaaagaacacacaggcacagtgcggggttatcggctcaggtcccaggactggatgccctgaccttggacacaggtgggtgcccttcccagcccaccccatgtgcctctccctcgcttgggcactgctggcccctaaacgttctttctaagacactaggacttggaagcaccttgagatttgctgtttcctctgtctggaatgttctctctgcagggaggcccctggtgaggtctcacctcaaatgtcacctcctccaagaaccccttcttgactgttaccaccattcccatggaccatccctaccacagcaccctgatctattttctttctagcacttattatcgggaatcattctgttaagtatctgtcttccccaactggagcccaaaactcctggagggcaatgatcttgcctgacatattcccagctgccctgccacagcctggtgtataggaggtgcaccagaaatggggtgacggaaaggctgattctggcaggcctcaagccgcgccctcacctgcaggacctgggtgtggggccgagtgcggtaggtgaaggtcacattctcaaagtccacccggccctccaggtggtcgggggccaagctgccatcgtgcaccatggtcggctgccggtcgatgaactcgaacaccttctcagcagcccccactccctgcatcaggccactgtagacggagcccacggactggggagaggagacacgcgttcctgtcccaccgatacccgactcctgggacccacccctgctactagagaggaggcaggtatagggaaagcaaggagttctggcggggagatgcaggaggccacctgaccacccactggtgcattagataacgacagtaaggggagctgaggacagcagcatcactagcactctaccggccatccagctgagtgggtgccatcatccccacaggagcagatggaagcgaaggaaccggcaggggtgtggcacagtgggaatccagccttgatctttcaattgcgatagcatagctttttttttttttttttaagatggagtctccctctgtcgcccaggctggagtgcattggtgcaatcttggctcactgcaccctccgcctcccaagtcaagtgattctcctgcctcagcctccagagtagctgggattacaggtactcgccaccacgcccagataatatttgtatttttagtagagacagggtttcaccacactggccaggctggtctcaaactcctgaccttaagtgatccgcccacctcaccctcccaaagtgctgggattacaggcatgagtcaccagacatggcttgatttcaattttcaaaatgggtcttaatgtgtactataaataaatatattctccttgggtaaaaatacatagaatatgaatgtaaatcataataacggcccattttcttaagtattctctatttattttttttgagaggagggtctcactctgttacccaggctggagtgcagtggtgtgatcttgctcactgcaacttctgcctcccgggttcaagcaattctccaacctcagactcctgagtagctgggaccacaggcatgagccactactaagcccagttaattttttgtattttcagtagaaatggggttgcaccatgttgcccaggctggtctcgaacttctgagctcaaggaatccgcctgcctcagcctcccaaagtgctgggattacaggtgtgggccactgcgtccggccaagcatgctctgtatgttaggaggtaggttctaacattatctccttttttactgatgaggaatctcaggcacagagggctcaagtaacttggcccaggtcacagagcctagaagtggcagagccaggatttgaatccaggcccatctgtctcctgagttcaggctcttaggtgctgaatgtcctcattggtgataagggggtgatatcggcatctgtgtcctgttactgtgaagacaacagcaacagccggtagtaaacacctaaaaccccagagctggccgggcacagtggctcacacctgtaatcccagcactttgggaggcggaggcaggcggatcatttgaggtcagaagttcgagatcagcctggccaacatggtgcaaccccatttctactgaaaatacaattttgtactaaattttgtactaaaagtacaaaaattagctgggcatggtggtgcatgcctgtagtcccagctactggggaggatgaggcaggagaatagcttgaacccgggaggcaggggttgcggtgagccaagattgcaccactgtactccagcctgggcgacagagcaagactccatctcaaaaaaaaaaaaaaaaaaaacctaaaaagaaaaacattagctgggtgtggtggcatgtgactgtaaccccagctactcaagtggctaaggtgggaagatcacttgagtccaggaggtcaaggctgcagtgagtcatgaaagcaccactgcaccccagcctgggtgacaatgtgagactgtctcaaatagtaatgataataaataaacaacactgcactgaacatctctggacatacatcttcgcccactgctgtgagtactcttgaagcatggattcctaggggcagatttactgctgagtcaaataatatggcaggtgtgattctccagcagatgcaatggcctgagtagcagatgctaggaacaccccaccaacatccttgagcctttgtcagcgcagcacacaaaggcccaatctcttactgcctgcgggctgcgggcttttttgtgggagcgaggcagacaagagaattaacaccctcactccaggctgaccttgagcaatggctgatggcagcttgggtgtaaacaccccagctccctggccctcagatgggatgactctggtgctggtgtcctaccctgtccgctagaaggatcccacctcagttgcccacactggtaactggctccacaactcactctgctgacttccttccttccacgtctcactttccactcccacccccgtttcctgagatcacctcccaaacaaatccgttgcacgccaattctgtctcaggatctgcttgtgcggaaaccaaaatcaagacaatctaaaacacccttgcatttccgaggcactacgctggaagtaggctgggaggaagtcaggcccggctggccctgagccccgttcccgagcaaatgtgatggacgagtcactccaccgctcaggttcagttttcttttcatcacttcaatttctcacagagctgttaagaccattttctgaaatcacctctgtccctaaagggtgttgctgtcacttgttggtagtattatcattctttctttcttttttttttgagatggagtttcgctttggttgcccaggctggagtgcagtggcgcgatcttggctcactgtaacctctgcctcccgggttcaagcgattctcctgcctcggcctcctgaggtgtgagccaccgcacctggccctttctttctttttgagacacggtctctctctgtcgtccagcctggagtgcagtggcgtgatcacggctcactgcggccttgacctcccaggctcaagcgattctctagcctcagcctcctgaggacctgggattacaggcacatgccaccatactcggcttgcctatttatttatcaagacggagtctcgctctgtcacccaggctggagtacagtggtgcgatctcagctcactgcaacctctgcctccagggttcaagcaattctcctctcaagtagctgggattacaggtacccaccaacacgcttggctaatttttgtgttttcagtagagatggggtttcaccatgttggccaggctggtctcgaactcctgacctcaagtgatccacccgcctccgcctcccaaagttctgggattataggcgtgagccaccacgccctgcctagtattatcattcttgatatgatcatgctgtctcccctacttaccttagagagaaataccacattgtcagagtccctggagccccgcccccaccctgttaagatccctcttccccaaactcctcccttctctctggatccccggacacactggcctctcacctccatacaatctcccaggacaaactcgtagatgatgaaggcgatgaggttgccgctggtcatctggcctgagatgacaaggtggcccccgtagtagaggatgctgacctggaccaccagcagtgtgagctggggcagagggagaggggatgtgggtcgaggggaccttagatcccccaccatccccattccctgacccatcccaggctgcagggggaggtgagggcagacccagccacaaactgaaatgccggccgttggcaggggtgtcttccaaggcttgtcactcatgccttcccctgccccgagcatttccctacagaggcctccagctggagcaggctgtgggcttggccacagaacaaggctttctttgtgaggtcctggcacacacatgccacccccaggctcctcagcttggccacctgggaactattcgtcctcctcatggggaagagcatgactcagagagggcaagtgccctggctaaggtcacacagtgagctctctgtctcctcccccagtggggttccgtgaagaaggggctgtgatgggagcgcccatgccttcctcctgtgcctggggggcatctgggaagggagtggagtctgagtacccatggcagcccacaccctagtcagggactccatctgtcctcctcatgcccagccagaactaggctgctgtctggaccaccgtgccttggtggaagctgcaaaggcaccccctgccagcagacggattgctaagaggctcagctagctgagctggaccttagcccctcctctcctccttggctgatacttttgggaggtggcagcaccaggaagtcccagatatcctctttcccctggctcccctgtagaccaccagctccctcctccctctcactccaaaccctcctcattcctccgcagctatgccctgacctgcccacctcccatgtgtgtccagtgtagcagtgacatgatccaagtgctccccatcctccaaggagaggctgtgacgcactcccgggagtgtgccagacactgtcgggagtgtgtgtggctgtgacatgagacctgcccgaaagtggcctagggacctgctgactccccacctcagcaaggatgtttccccagctgggaaaagaaagctcccaccctgccaccccacgtcaggtgactgggagaggggcagccttgcttctgggaaagattctcagcagggcgcggtggctcacgcctgtaatcccagcactttgggaggctgatgcgggtggatcacctgagctcaggagttcgagaccagcctggccaagatagtgaaaccccgtctctaccaaaaatacaaaaattagccaggcatggtggcgggcgcctgtggtcccagctatgcaggaggctgaggcaggagaatcgcttgaacccaggaggcggaggttgcagtgagctgagatggtgccactgcactccagcctgggtgacagagtgaggctctgtctcaaaaaaaaaaaaaaaaaaaaagaaagacagacagattctccaccagcttgacaccaacatgcaggactgatgtcctagatcgagggcttcccccatctttgcatcccatccctccacagccagagctgcctggccaggggcacgtaccccgctgccccagacgtagtacatgtaggcagctgcctccttcctgttcagcttgtacacctgctgcagcttccgcaggtacacctctgcctcctcctcctcattggcgaagctccggacagtcttcatggcactgatggtctcctccgccgtgttgctcgctctggccagggcattctggacctctttggagagcctctatggacaggagggggacaagaaggagaagaccccaaaacagcctcactatgtactggagcccccaggcctctctgggtttttccacccttcgctggcaccagctatatgcaagaggttcctaggacaaaaagacaagatctagccctttctcccccatccccttctggctcaatttgacacactcaggtagtcaactccagagaggctcttggggcaatggtttcagctcctgaaggatagggcacggtgctgatcgttaagtcatccccagtattcaaaagaggctattcatgactggacagtttttggtaatcctttcagaaaaggggcctcaacacctgaccctgtgctggaagagcaggggatgccttggacggttgttcaggttgtacactatttaagaaacaccaactattaaaggggcaccatttacatcatcaacataaattatgttagagcctgagggttgataaagagattccagaactcccagccaagttctacatggtggcaggggccatgggttgtgaaatctgcccacaccatgtgcatgtcaccacaggcagagctgaaaagtggtcccaagtgtgcggccatcaggctgctgttcaccagagtcctggaagaggcccctgggtggagctgttcacactttgcaggagtcactatgctgattctcaagccagccaggaaggctgcctgagagtccaggacaggagcatgcactggcatgtcccatgaccatgtgtcacgccccagccgcaggaagcatgcagggtgcctgagtcatgtttggccatgggcggtgtgtgtggtttgtggagatgactcgctggctacacacaacacattcaggcatggggtggaaaacccaaacagagccttcctgaggcctcccttagctgaactaaaaggcagggcctgcagtgcacacagaggtgggggctgagggggagctccagggtttcttgctccatcccaggggctggtgggaaggccggaagcaaggggtggggagcagcgtgccagaaatggctcagactctaaagaatagatttactttctcatctcagtgaggacggtggggaggctcgtgaccaggaacttcgggaagaggtcctacctgtgtggctggagaagactgtggggagtggcctcaccgggggctgggtgggagatggcttcctttgctaccctggtctcaggtcaccaacaccaaaggctccaatggagctgcgacaatgacttacccggcaccacctggaggccgtcatgcatccaagcccctgctctagaagtaccccacgtgggcctgggtgactgtgagggggttgcctgtacctgtcacagggtcacagccctgcctgtctgaacccagcctgtctgtcccttagggctcgggggcacccgcccattcaggaagcaggaggagggtgaggtcaaacctggctcacggccctagctcggaagcagaagcagtgccgtggggtggccagaggggacagcagcctgcccatgatggcatcacagcgggcccgcgatggcatcacagcgggcccgcaccacccccacatacacaccaggcacgttccaacccagggccttttcactggctgtgccctctgctcagcacatacctcccaagatgcccgcctccttcagacccttattcagatgtccccttctcagcaagacctatttaacttgtatttattcattcattttagagacagggtcttgctgtgtcacccaggctagagtatagtggcacgatcattgctcactacagcctcgacctcctgggctcaggcgatcctccacctcagcatcccaggtagctgggaccacaggcatgcgccaccaagcccagctaactaaaaaaaatttttttttgtagagatggggtcttgctatattgtccaatcttgtctcgaactcctaggctcaagtggtcctcctgcctgtgcctcccaaagttctgggattacaggcatgagccaccgggcccagccagtaaatccaatttaaaattgcagctacacccaatgctcccaatccctctgctcacttcatgtttctccttagcactgaccatcttttactgtattgtggattctcattctttatgctgttggtacctagtatctgtctctgacactagatacaagttccaggaaggcaggggccttgtctttttcactgatgtatcccagtgcctgggacatagcaggtggtcaataattatttattgaatgagcgaagaaatgaatgaatgaatgcaaacacagcctcaagacctgtccttcactagcccttagtggccccctgagcccctcctaaggggatgtttgggggctgccagggtgcacagtccccagcagagacagggcaggcctaccttgtagtacttgccgtagatgttggacaccatcatgatgatggggaagcccatgaaggtgaccaaggagagctgccatgagaggctgaacatgaagaccaccacgcccgtgaccttgactgtgttccgcaggaagacattgatgttctgggagaccaggtcgctgaccatggtggtgtccgaggtcaggcgggagatgaggtcccctggaacacacgcggctcagctctcaccacagcaacccgggccttgggggtggcggtgggggatgctaaggggcctctgagacagacactgggaagccgggcctccctacctgtgggcggggttggggggtgggggagaagagcagatacccctcgagggctactctgagccaatcccagtcatcagcatcttgcttaagcttcatgacatcccgctgtacagcggaggaggctggggctcagaacaggaaggcccccgtagagtcacacagcctgtccgtgactgagccagacttcaaacccatgtctcctccctgtcactggcagagggggtaactcctcttcccttctagggaaataacaacctggctggtggcgggcaggaaagcgcagacacttcttacctaagttggacattgtgctaagagctgtgtaaggaccccatggggtggctactatccgtgttcccattttacagacaagaaaacagaggatcagagaggtgaagttcgtgagtggaggaaccagggcttcgacccaggccggtgtctctcagagcttggatcttggtggatattctatcgtcttccccgttgtggcccctggccctcacctgctgacccccatgggagcagggtctctgtcggccacaggcgtgggtagtcctggacctggtggtttccatggggcaatggaaagcaaggccttggctcctgcagggacctcgggtggcctggcctgggccccacagaggccgcagcccacaccaaaacctcagtgagcaagccagctcccaggacacaggccaagcccagggtgttcccagcctgaactaacagcaggaggagaagacagagggctgagaccacccacacgcccatttcattcctcagtgccaggcaagcccacaggggtggggcccagcccccaggacacctagggcactggaaggaccaacctgtgcggttctcatcaaagaagcttgtctcctgggacaccagtgagcggaagagacagtttcgaaggcgaatgttcagtctggcaaatatgagggtaaaaatgccgccccgaatacctgcggcaaatgagctaattgcagataagagatattatagcacgatgtccttccagaccagtgaccacacccggctgccccctcccgctgccggcaggcctgggagccccaccgcagccccactccagggctggcatccctgcggggtccccctcattcccagtgggagcccccctcaaggtgagggcaaaggggacagttgtgggacaagagacccaaatgtgccagccagaccctcttccttccagaacagctcagacaaagccggttctgtttgggaccagattcctacttggaaaacagccagggagggtgagcagggaaccctgaggactgaagcccttttcagggaccagagggtgtggttctagggtgctctaagacagtgtggaagccggttcccagggtgaccagctgagggacaggcccaccaggggcatttccagggcctccctggcccctgtcttccttaggaacaggccctcccttccctccctggtgcaggtcggggtgtgcggggcagggcgtgggggttgagccagctacctgccaatggccagcaggcacacgatgacgacagccgtgctgaactgatccatgcttttctggatgacgatgccatcaatggcgcggcccgtgtagtagggcaggaaggtctctcctgggggaggcagggcagcctcagggacgtctgcagccaggggaacccgcacccttcctcctgaggctccagaagtccacacaccaacccctctgcccactccaccggtgggctttcctccctcggcaaactcttgctgcccatcgtggggccccagggtgcttaatgcccccctcctcagagaacaggggagcactgggccttgcatccacacagcctgctggttcttctttatttatagtggctaccaggcatcgagccagggctcctgcaggatgcttcattctcttgttttttgagacagggtctcgctgtgtcccccgggctggagtgcagtggtgtaatcatagctcactgcagcatcaaactcctgggctcaggtgatcctcctgtctcagcctcctgagtagggaatacaggcatgtgccaccatgccaggctaatttttttttttttttttttgtagagacaggggtctcactatgtggcccaagctggtctcaacctcctgggttgaagcaatcctcctaccttggcctcccaaagtactgggattataggtatgagccaccgctcctgaactttgtttcattccctttggagcaggccctggaatcacccccattttacaaatgagaaaaattaatttgtttttctttttctaaaatattttcctttttttttttttttttaactttttgagacagggtttcactcctgtcgcccaggctggagtgcagcctcaacctcctgggctcagtggatcttcccacctcagactcctgagtagccgggactacaggcacacgccaccaggcctagctaattttttgtatttttttgtagagacgaggtttcgctaggttgcccaggctggtctctaactcctgggctcaagcgatccacccacctcagcttcccaaagtgctggggttacaggcctgagtcacagcgtccggctgaaagtgaagttgaatgagatgactcgtccaggccacatggcaatcagtggctgattgacgccaaagttgatttcattcttctcaatgggttcagagtccaaattctggaacctcagaagacgttgctattctggttccaagcaatgctggaaattgccaccccacccctcctggtggggcacttgacaccttgctgggtgctttcttacccgcttgccttactgtgttttcacaacaatcctggggtggaatgggagactcacagaggctgaggaatttactccaggtcacacagcaaggggaaaggctgggactcaaacctaaactggctttcaacctgggggctctttcttttcccttcctcctgtggtctgaatgcatctcccaaaatttacatattgaaacataatcgccaatgtgatagggcagagctctccaggatgggatgagggcccttttcaaagggcttgtaagcctggtttgccatctctcgcccttccaccttctgcagcgtgaggacacagcagtcttcccctccagaggacacagcaaggagggaccatcttggaagcagagagtggccctcacgacaccaaacctgctggcaccttgatctgggacttcccagcctctagaacagtacgaaatcagtttctatggtttctaaatgacccagtctgtggtattttgttacagcagcagaaatgagactcccccgacaataatccggaatgtccactctcctcttaaggaaatagtggcatcaccaggccaggccaggcccttgttcatcccaggacctgtttccactgaagttctttccatgagcagagccaggtttggggctgggcatacagtaggtgctcaataaaggtcagtgaatgaaccccgggcaggtctggctagcacagtctggcctggctcagacacttgggtagtgagactttctgtgcagttctggtgccctctgctgggaccatgaggtggcagcctagagggcctgtgtccccacagtccttggccagacgaggtctccagctgaggctgcagagttccacccagcctgagtttctgcctcagtttacccacagaaaagaagagggcaacgatgagctgtgacagaatattctggaatatctgattccagcaagcaccaatgctaataatcgccttactgggtaccaggggctgtgcaaagcatgccggcaaactctcttgctgaatctgcacaagaattacgtgaaactctccaatgcaccagcaaatactcagaccatttccagaacctgaccactttcactgcctctactgccccaaccctggtccaagtcattaacctcactgggactatctcagtagcctgctctcaactttgctcacatcagcctgtccacacagtagaaggcaggatcctgttggaactaacttcagatcttgttgctccttggctcaaaacagtccaaatcccccttctcatccagtgagatggtaaaagccaaagtctttacaatagcccacaaggacctgcatgattgagccgctagcagagacctttgtcttctccccgccccatctcactccctctgctccagctaactggtgtctgctcttgaacaactgggcaccttcctgcctcaggacctttgcatgggctagtccttctgcctggagtgctcttaccacatacatttttttttttttttgagatggagtctcagtctgttacccaggctggagtgcagtggcatgatctcagctcactgcaacctccacttcctgggttcaagtgattctcatgcctcagcctcccaagtagctgagattacaggtgaccgccatcacacccggctaaattttatatatgtatatatatattttgagatggagtcgcactccgtcgcccaggctggagtgtattggcacgatttcagctcgctgtaacctctgccacctgggttcaagtgattgtcctgcctcagcctcccgagtagctgggattacagacacctgccattgcacctggctaatttttgtatttttagtagagatggggtttcaccatgttggcctggctgatcttgaactcctgacctcgtgatccacctgccttggcctcccaaagtgctgggattacaggcatgagccatcgcacctggcctaaattttatatttttattagagacagggtttcaccatgttgcccaggctggtcttgaactcttgacctcaagtgatctgcccgcctcggccttccaaaatgctgggattacaggtgtgagccaccacacccagccacttaccccagatatctgctcccctaccttcttaagtctcaaaggccacccagtaatcctataggtttggtacaattattccttccatttgtggaaatgtattctttacacaaaagaggaaactgaggctcagagagattaagtcacttgcccaagtttatacatttggtttgccatgaaatccatattaaagaatcttaggctacagaaggtagctcacacctgcaatcccagcactttgggaggccgaggtgggaggatcacttgagctggagaggtcaaggctgaagtcgctgtgatcactccactgtactccatccagcctgggtgacagagggaggccctgcctcaaaaaaaaaaaaaaggactccatttgttttttatgtattttttttattttttttgagacggagtttcactcttgttgcccaggctgcgatgcaatggtgcgatctccactcacagcaacctctgcctcctgggttcaagcgattctcctgcctcagcctcccgagtagctgggattacaggcatgcgccaccacacctagctaattttgtatttttagtagagacggggtttctccatgttggtcaggctggtctcgaactcctgacctcaggtgatctgcccccccttgctgagattacaggtgtgagccaccgtgcccggcctattttttattttttgagacagagtctcattccgtcacccaggctggagtgcagtggcacgatatcagctcactgcaacctccacctcccaggttcaagcaattctcctgcctcagccttctgagcagctgggattacaggcgtgtgccaccacgcccggctgatttttgtatttttagtagagacggagtttcaccatgttggccaagctagtcttgaactcctgacctcaagtgatctgcccacctcagccttccaaagtgctgggattataggtgtgagctgctgcacttggcctctaaagaaccttaatttaataagagatactcaaccctaaaactaacatttcccaatgggtggttttttgttttttgtttttgtttgtttgttttaagattctgagggtacagaaaagctgggcactgctgaatgcttgttgattgaaaaataattattaataatcacagtacctaattgtcttttttgagatggggtctcgctatgttgcccaggttggtctcaaactcctaagccaaagcaaccctccctccttggccacccaagtagctgcggtcacaggtacatggcattgcacctggccctaacactgattaagtatttacttgtgctaggcaccaagcttcctctcacttctttctcacagtaccccaagaaagccctcacttcagaatggtcaagtgagcgttggccaggttaataacttgcctaaagttatcagtgaagtcgggagcctgagcctcgagtctgcgccctgactcttgatgcaatcctgcaagccgggaaaatctgctcagcagtatttaaggatgtctgcattccccgaccacacagcagctgacggcagggccccagcaggtcgggtaaacaaggtcatggcatggggcaccatctgtctgcacaggcatgacagtcattcatacttttgttcatttattcattcagtgagcccatctctgtgccagctactgggatccagggtgagtcagacctggcccctgcccctgaggggctcaggacctgggaggggaggcaggagggtgaatgcatacataacagggtcttgctatgttggccagactggtcttgaactcctggcctcaagtgatcctcctgcctcagactcccaaagtactggcattgtaggcatgagccactgtgcccagcataaatgcatagttttttgggtttttgtttttttgttttttttttttttgagacggagtctcactttgttgcctaggctggagtgctgtggcacaatcccagctaactgcagcctccacctcctgggttcaagatatcctcctgcatcagccttctgagtagctgggattacaggcggctgccaccatgcccagctaatttttgtagttttagtagagacggggttttgccatattgtccaggctagtctcgaactcctaacctcaggtgatctgcaggcctcagctccccagagttctgggattataggtgtgagccaccgtacccagcctgaacatatgatttttatgtcataaaagctataactgaggtgcagacaaagttaccacagttggcagaatctaaggtggcttcctaaggaggggacttttgggccgcccagcatgagccaggagaaactgcctggtttaatgggaaggggtcatcccagtcctcacacctgctagtattactgggaggtgtctatgtgccaggagctgtccaaggtgtctcacccatgtggattcactgacctttccaaccccattggaggggtactactatgcccatgtcacagaagaggaggctaagacttagaggggttaaataacttgcctaacctcacacagatgttgaggagatgggactgagagggcagaggtagatcgtaggagtacagggctgcagagtcagggccagctctgggtttgcctgtcctctctcagaacattctggcattgttattgcattgtcacctctctaggctctgtctctgtcagttaacatttttattttactattttattatttatgttttttgagatggagtctcactttgtcactcaggctggagtgcagttgtgtgagcttggctcactgcaacctctgcctcccaggttcaagcaattctcctgcctcagcctcccaaatagctggaattacaggcgtatgccagcacatctggctaagttttatatttttagtagacatggggtttcaccatgttgccaggctggtctcgaactcctgacctcaggtgatccacttgcctcggcctcccaaagtgctgggattataggcatgagccactgtgcccggctaatatttatatatcttttagcagagacggggtttcaccatgttggccaggctcgtctcaaactcctgacctcaagtgatctgcccacctcggcctcccaaagtgttgggattacaggcatgagccaccgcgcccagcttaaaatttttaaaactcataatagctaacaaccctgagcacttaccatgacaagccaagctctgtacttagtccttctcctatttttttttttttctttggtagagacaggtcttgctctgttgcccgggctggagggcagtggcgtcatcatggctcactataactcaagctcctgagctcaagggatcctcccaccttagcctcctgagtagctgggactataggcaagtaccaccatgcccagctaattaaaaaaacatttcttttagagacagggtcctgctgtgttgcccagagtggtctcaaactcctgggctcaagtgatcctgtagccttggtctcccaaagtgctgggattagacatgagccactgcacccagctctcccgttcttttcagcatctaaaatgtcaggaaataaggactccaacaatccttgttgcacagaggagggaagtgaggctcagaaaggctggagaacttacgcagggccactcggctgggtagggagcaggacagggatttgtgcccaggcctcgttgcccccagaacctgtgagctccaaccatgcagtgccaccttcccacccatgttgctgagtggtgccttcaaactgtttggaccagactcacaggcacaaatacatttcatgtcacaaaccaggccacacctgcacgtaggcacacacaactaaaatattaatatcttttttttttttttttggtctcaaactgctgagagttttttttttttttcgttatctgcctgcctcggcctcccaaagcgctgggattacaggcatgagccaccatgcctgcccactctgatgttttctagtctattctctgatgatcccagctccaggaatttattctacagatccatccacattcatatgaaatgtgtatgaacagaattattgacgtgcaggtcgggcgcagtggctcatgcctgtaatcccagcaccttgggaggccaaggcaggcagatcgcttgaactcaggagtttgagactagcctggccaacatggtgaaaccctgtctctactaaaaatacaaaaattagccagacgtggtggcaggcgcctgtaatcccagctgcttgggtggctgaggcaggagaatcgcttgaacccaggagatggaggttgcggtgagccaagatcgcaccactgcattccagcctgggtgacagagcaagactccatctcaaaaaaaaaaaaaaaaaaaaaattcatgttaagaggaaaaggctcaaaataacccaagagtcaaatgatgggagaccaactaaataatctatggtatagccgcacaatggaatattatgaagccaaataaaacaatgaggtactggttggaaaaattccagaacatattgttaagtgaaaagagcaaaacataaaacaatgtgggtgagaggtgggggagtgatgcatgttcttttgatgtgcttgtagctgcataaggaaaagctgggaacatgcacaagaattgagtaagaaagaatgctttcctggccacctgggagtttctgggtccttttcctgcagttagccctgggcagaatgatcagggtagaattagaagtgaaacacagccaggcattgtggcttgcgcctgtaatcccagtgctttgagaggccaaggtgggaggatcacttgagcccaggagttcgagatcagcctggacaacatagtgagatcctatctttacaaatttttctttttttaattagctgggtgtggtgcacgcccctgtagtcccagctatttggaagactgaggtggggggattacttgagcctgggaggttgaagctgccgtaagctgtgatcatgccactgcactacagcctgggcaacagagtgagaccctgtctaaaaaaagaaaaaaacaggagtggaactcatagtttcctttttcttctcttgtcttttactttttccttttttaaattgagatggggtcttgtcatattgcccaggctggtcttgaactcctgggctcaggcaatcttcccaccttggcctcccaaagtgctgggattacaggcgtgagccaccgcgcctggcctattttttcgttttaaattacataaaatagaaatggggcaggcaccgtggctcacgcctgtaatcccagcactttgggaggccgaggccagtggatcacctgaggtcaggagttcaagaccagcctggccaacatggcgaaaacctgtttctactaaaaatacaaaaattagttgggtgtggtggcatatgcctgtagtcccagctacttgagaggctgaggcaggagaatcacttgaagctgggaggcagaggttgcagtgacctgagattgtgccactgcactctagcctaggtgacagagcaatactatgtttcgaaaaaataaataaatacaataaataaataaataaataaaatagaaatgggttctcgctatgttgcccaggctggttttcaactcctgggctcaagtgatcttcctacctcagcctcccaaagtgctgggattatagatatgagccactatgcctggcctcttttccttttcatatcaatttgatgtctgaaccacgtaagtaaaatcttttaaaatctaaggcagtcatatccacctaatttgatgttctggtggccacatgtccccgaggtccttacttacccagagctgccacgatgaggaagaaggaggcggccacgaggaaggccacgtcgggcttggtgtaggagagcagcttctgcagcgtggccccagacgcctgctcgggcggtggccggccgctcccagggaagccctcagcctcggtggccgcccctggctccagggcctgggtgcctggccgcacggtggacagcagccaccagagcaggaaggatgcgccgagtgaaatgtacgtccacacgaacagggcccaaaaccaggggtcccggatgggcctgcgcacctctgagaagagcagcagcttcaccatggcatagatgcccacgaagaggcacacgagggtgatgaccagccacgaggcccgcagccgccggggccccagcgcactgttcttggccacaccaatggtggctcccagcagcaggcagctgcggtacaggcaggctgcccagagatccagcaccgagtcaaagatgttgaagtggcggatgtcctccaggaggctgcggtccaggtggctgaagacatagatggccgtggtcacgcagatgtccacactcatgaaggccaaagtcaccaccaccgccttccacagccgcatcctgctggttggaggtgggcgggtgctgaaggccaggttgtagctcacgggggcaaggccatcatcatccacagggcgaggccaggcctgtagggacaacagcaaacatcagcacaaggggttcaggtttgccactcgctggctgtgtgaccttgagaaagtcacttgacatctctgagccttagttttctcatctgtaaaatggcaatatcaacttcccgggtactaagattccactcattcaagggatacttactgagtgcccactgcggccaggtgctgttctttgttctttgtcatgaacaaaaagaacaaagatccctgctctcctggagatgacatactcatgcaggagacagataataaggaaatgggctcacgcctgtaatcccagcactttgggaggccgaggtaggtggatcacctgaggtcaggagttgaagaccagcctggccaacatggtgaaacccccatctctactaaaaatacaaaatttagctgggtgacagagcgagactccatctcaaaaaaaaaaaaaaaagataataaggaaataatgtgtgtcttgtgaggccaaggttggaggatcccttgaggccaggagttggagagcagcctgggcaacagggtgagaccctgtctttaaaaagcaaacaaacaaacaaacaaacaaacattaactgagtgtggtagcatgctcctgtagtccaagctacttgggaggccaagatgggaggatcgcttcttcagcctgggagttcgaggccacagtgagctatgatcatgccactacactccagccctggtgacagcaagatcctatctctaaaaaaaaaaattttttttaattaaaaaaagagataagggttgtggtggaaaaaagaggggggtaaataggatggggtgagggtgaataggataggggtgggggaagacagagatcaattttattttatttatttatttatttgagacagagtcttgctctgtcgcccaggctggagtacagtggtgcgatcccggctcaccgcaacctccgtctccctggttcaagcgattctcctgcctcagccccccaagtagctgggactacaggtaccccaccaccatgaccagctaactttttgtattttttttagtagagacggggtttcaccatgttggccaggctgttctcaaactcctgacctcaagtgatccacatgcctcagtaacccaaagtctgggatcaaaagcgtgagccactgtgcggggccagagatcaattttaaatagggggccagagaagacctcgctgggtaggtaacacttgagcaagacttgaaagagttatggaagtctgccaagtggctatctggggaaaagcacttggcacaggtgaaacagtgccagagccccaaggcaggagtgccccttgggaaggcagcaaggccccatgagatcagagagggtggggagtatctggaggattttgcatccatagtgaggacgaagctgagataagcagagtttaataaacagccgctgtctttactaccactactcatttctctgaacctgtttcctcatttgcaaaatgtgagtgtgaggttcaatgtgtcagttctgggcagagtgcctggtgcataattgctgctgattgtaatcaaccatatacagtgtgtgcttaataaatgtttgtccacttttctcctcccacgtcaggccttctatctctgcaaccccaaataaactattttggtctaagagggaacttgacagctgtgggggtggcttgcaggccacacagcaatccagaaaccttggcatctgcttggaagtttccagaatcttttcctcctgcccaggttggccctcgtgcccagccctaggcccctttggttttctgaatcttgatgtctgctttatccaaggcatctcccggcactgggtccctcaggactcccccagagccgcagggacacccgggaagtgggcctggaggcctgagtttgtgagtggggcttgtccacggtagggttaggaccgggctggggtgtgtccctgggtgctacctcctgtctcagctccagtccttcctcccgtgggccttttgttgtcatatctgcaaaatgggctgggctctagatcccccaagaggaggggtgaggcgctgggtgacagcggggatgactgtcgtggctgggaaggggccatcctgagagagatcctctccccgaagctctggcgcccaggtgcccaaaccgctcacactgtggcatgactggaacctcacacagtcccacgaggccagggtttccatattcccgtttacagttagggaaactgaggcacagagagacaaaaccacctgatccagacattcagccaacaagggcccaagccaggatgacttgaggcagtcagtgagtgtaggaccccagcatctgcctctccacctgtctactgcatgcctggcacaaagcagttgtctaataactacaagcagacagggatgtaacactgcacttcctgtgagccctgccctgcaccatgtgcttcaaatccaggtggccccacctatttaatcctcacagcaactttgtgagatgtgcactgtcatcccttccacttaacagatggagaaactgaggcccagagaagtgaagaatttgcccaagattacacagcttctgaatagcagagctgggatgtggattcataggtgtctgagcccagaatctgtgttcttcacccctaaactaagataacattcaatatagaaaatgctaccaggggccaggcatggtggctcacacctgtaatcccatctgggcctcttgggaggccaagatgggcaacagcttgagctcacgagttcgattccagcctgggcaacatggcgaaatcccgtctctactaaaaatacaaaaattagccgagcatggtggtgcacgcctgtaaccccagcaactcaggaggctgaggcagaagaatcacttgaaactgggaggtggaggttgcggtgagccgagattgcgccactgcactccagcctgggtgacagagtgaaggaaaatgctaccgggaagtgttcatctaaggaaaagggtccccagcagagggctgggccgtgtggcagaggtgataagactgctgaggctaattgctggcaatgacagcagctggtgccagctgacattggctccaggcacttacatgcgtcagcactcaccagagccctatgaagtaggtcctatcattatccccattttacagttaggaaaactgaggaacagagagattaagtgacctgccctgggtcacagagctaggtgacccacagagttgggtcacaagctgggatgtgaaccctggccgtccagttccaaaatctgtactctcaactccatagctccaacccttcaaaacagcctctccaggaggtaggcacaacccctactaatgctgagaaggggtctgagatgcagagggggaatggagtggggggatataacaacctccaagcctgggccctgctttcacccccacacctccaggcacaccgaagcccatcgcagagatgacagttgcttagtcagcagctgcccctccaaagacggtcagggccaagcagggtcaagggcaaggggaagtgggtaggatggtcggacaccctcagcccaggtcctggctccctccccagccctgcctgtgctgcccacgcaggctcctgtctgctgcaatgcagaggccgtggggagcgagcgagtgggtgagctccagtcagagcccagggagggaagctcctggcctggtgccattccaggcctcccagccaagccactgccggctgcaccaggtgctgccagccgcctcagctgctgctctcctcgtggtgggcacatggggtccctcagtccccagaaaggggctcgggctcagaagtggaacaggaggcagatccgcaagagactcaaaacctggacagcagcccaggggcttggctgactctcccaacctgactcccagcctctgggggaattccttccccatcccccaacagcccagggtaccagtcatgccccccgcctccagaagcctatttatcttcatcagaataaacaaaatttcaaacactcatatcgcagactaccaaagccacattttgcagatggggaaactgaggcccacagagggagggggtgaggcttgtctcaggtcatccaccaggctggggcagagcagtgctagcacctgggtccctgcccccaagcactagtccttctaccacagactcctagcagagtggactccagccccgggtcgggttacagtcctcggtggggacagttactccgttatttttaaagctactgggcagaagcgtgaccaccagccaaggctgcttagaggcctgtcaccgctctccaactgcctgactcagaggatgcgctgggctcggccaggtggagctggagggcaaattgtgagcacatgggtgacctgcttggcctgagggacaaggacaaggtggtggccagaataggccccacccagaaccggacaaggcccaggaagacaggggtggctcgccctgactccgtgcactaaagaatggcacaggataagcaagtggccttgtccccaccaggggtcttgtcaaaggcttttcttcccagggtaggagacattggttggggtatctctaggcatcagctgcagagaaggccagaagacgatagatagcagttattatgacgctgcaacagagaccctttgcagagaaggccaggagacaatagataaaagttattatgacactgcaacagagacccttcaccgggccctactatgtgcctggcacctcccaaagcagccaggcctccccacttccctgggaggaccctgtggtcatcagcttcgttttacagctggggagacagaagaggttaagtgacacgcagaaaaaggacgaaggcaggatggagacccgcatccagggtctccaggatggagactcgggggtcccctgtccaggctattcagggattgcaagaaaaggggccaaagaacttgggtggcccagtggcctcggttcacccctgacatggtgagctttttaccccggtgtgggcccagacccagataagcccattccattcgctgcgcagcaaagcactgactgacagaggcctgctgggtgggagggcctgactgtgggggtccctggctctggggcaggagcgggctgggtctgcgtgggtccatcctgatttcatccctgctgagcctctggcagcccacgtggggcccagcctcactctgggacttgagaagctgtctcaggtgctctcagctctaggagaggcagagaggcgcgaggtgccctccctccaagcctcctcttgtcacccggccctgcactatccggaaaaggggaatgggcagaggcggggatcctgtcagcccagcttaaagctgtctcagttaatgtcaggccgggggaggaggctttttttttttttccagaggcccagaaataaaagaggctcccctgggaacctacaggcctcactgccagcgtggatggcggggagcagcggcagcccactggcctgctgaggagactgagaaaagggctttgcccaggtcagcaggaacaggccagatcccccaggcttctgccaaagccctggtgctcaggatccctgggaagccctgacatggacagtgggagccctcagaaggcgcgccagccccgtcctgggggaacgacagccatcccaggatcctccaacacctcccacattttccaagaggcagcggcgccttgggggttaaaaaaaatggcaacattcgccctacgggcgcggaaaggatgctgcagggatgggggctgggagctgcggctgcgggctccgggagggctccagggaggctcccaccttcaaccgagatgcctattcccaccgaggcaggggtgcccagacgccccccaacgcgtgcctggcctggcaccctggcctggaaaggtcccaaaaccaggggtctagggtgccttgcccttacctgttacctggcaccaggtgagctctgggagggggcgcgcagcaggctcgggtctggggtgcagtttccgcgctgctcattgaagactgcgccggacgcggtcctcgctccgctcttcccgctgctcctccccgcctcccacccgcgctgcgccgctgcaaggtcggagctgagactggcgtgcgttgagacaggctgatggacggggcggggcctcagtgacggagggggcggggatcctggggcagggaccggcggagcctcccgggaggggcggggcctcaggaggagtgggcgggctttcctggacggggcggggcccccgaggagggggctggcgaagcctccgggtggggacgggcctcctgggggcggggccacagctggccacctgctcacctgtggcaaactcctcccacatctggccaaccaggccctccacactgcgtgctggcctccacctggagccacgggcccatcctgaggggacggaaatggtttcacctgaaggaggccagctttttaactggcctttttccctggagggacagccagccagtccaggagggtgggttatggtcctcattcattcacttattctttcattcgttcacccaacagatatttatccagtgcctacggcgtgccatatgcccttttaagcatttgaaattaaacaattaacaaaacaagatccttgcccttctggagctgacattctagtgagggtgtcagacaacacatataagcaaatgagatatattggaagggaatacattttacggagaaaattggtgcaagatcagggattcggggcattggagaggggaggcagcgatatgtcctcagtgactgccaggtgctgggaacacagctgtgtgtgaaaagacagaaaactcccagccttcatggcgtgaaggggacagaacatcagcaagtaagtgcataaggccattcaggtactggatgcagtaaaataaataaaattgtgtaagtgaaaggtgagaaggcgtgagccacggggagggaggaacatcctacgctaaggcctgcaagttcaaaggctctgaggtgggaaccaacttggccacttgaggaccagaaaagggtccatgtggcctgaaccgtgggaagtgggtgggggagtggacttacggcccagaggggcagcaggtggggctagaactgcccacatccctggatcctctgatcagaggctttgttttttcctgagacagagactccaggatggagtgcagtggcgagttctcagctcactgcagcctctgcttcccagcttcaagtgattctcctgcctcagcttcccaggtagatgggattacaggtgtccgctaccacgcctggctaatttttgtatttttagtagagatggggtttagccatgttggccaggctggtctcaaactcctgacctcaagtgatctgccctccttggccttccaaactgctgggattagagtcgtgagccatgtgtgcccagccctgaacagaggctttttggagcactctctgaattggaaatgtcctctgctacttggtgggacagcttctttagaggggaatttgttcagaacttacaacactatgtttttttttaacccagaaggaatttcctctacagatagacttgtgcaagggagctaaggtactagcttaaaggtagttactacagtagcaaaagtctggaaataacctaaatacccttccatagggaactggccaaataattagagaacacctgttcaacagaatactctgtagccagaaaaaaaaaaatagaagacatagagttatataaaggtatggaatgacctcctaaatgtattgagtaaaaaccaaggagagaataaagttgaaccatgttactattggtgcaaaaacaaaggcaaatatctaattgtacttgaagacgatatcttggatggactgtccaaaaagcaggagtcactcagagctgggctctgtcatttatgctgtgtgaccttaaagaggtgactttgcctatctgagcctgttttctcatcagagaaatggggtaataaagatatcgactgcatcaggtaaaggtaaaatgtgacaaggccagtgagggcagcccctggcatgtgataaactttcagtaaaggagaacaaggattatttttaggagagatgggatgactgaacctttatgtaactactagcatagtatagcaaaaatcaacaggagctgtcagaaatgtgaaacggacagaaacaattcggcctcatcacatgctatttcttcacatggatgttgctttccagcgatcaagtttgcaagctctccagtctctcattcctctgtacctttttttttttttttttttttgagatggagtcttgctctgacacccaggctcactgcagcctccacctcctgggttcaagcattcttcccaccacagcctcccgagtagttgggattgcaagcatgtaccaacacgcccggctgacttttgtacttttagtagagatggggttttgccatgttggccaggctggtctcaaactcctgacttcaggtgatccacccaccttggcctcccacggtgctgggattacaagcatcagccaccgcacccggcctctctgtacctttgcatagcttgtcacctctgccaaggatgggcttctcaaatcctggccactgcgtccctttcacatatctggcccactctccttgcacttgaaacaatcttagaatgagagcttggtgaggcggggaaggtaagctgcaatgtcaggtgcactgcaggaggctgtcagccttgtgacaaggggagggtgaaacaggtgaggcacaggtgagtgggccaccagtcactgccttcccagcatcctttccaccccccccccccccccggctgccatgtggcagccaactggcttgagtggtcccatttgcatccccagcctagtcacagagactggctctggtaaacttggactaagaaccattgtgtgagtgactgctaatggatacggtgtctttttgggtgaggaatgttctaaaagttgattgtagtgatggttgcacaactctgtgaatatactaaaaactcttgaattgtaaactttaatttggtgaattgtatggtatgtacagtgtatctcaataaagctattattacaaaaggaagtccaggcaatgtggcttatgcctgtaatcccagcactttgggaggccaaggtggcaggatcacttgaacccagcccgggcaacacagtgggacccagttgctacaaacaatttaaaaaattagctgggtgtggtggcacatgcctgtagtcccagctactcaggaggctgaggtgggaggattgcttgaacctgggatgttgaggctgcaatgagctgtgtccataccactgaactccagcctgggcgacagagaccctgtctcaaaaaaaaaaaaaaagagaaagaaaaaacactccatgccatatgccataaaggaaatgcaaattaaaacagcaatgtgatatcaatacacacacactagaatagctgagatctggaacactgacaacaccaaatgctgtcagcgatgaggaacaacagggactctcattcattgctgctgggaatgcaaaacagtccagctagggaggaaggcagttcggcaggtttttttataaaactaactatgctcttactacatgatcaggcaatcacactctgtgatatttacccagaggaagtaaaaatttacgtctacagaaacacctgtccacagatgtttatagaagctttatcattattactttcgagatggagtctcactctgtctcccaggctggagtgcaatggcatgaactcagctcactgcaacctccgcctcccggggtcaagtgattctcctgcctcagcctcccgatcagctgggattacagaagcctgccaccatgcccggctaatttatttatttatttatttgagatgaactcttgctctgtcacccaggctgcagggcagtggtgtgatctcggctcactgcaacccccacctcctaggctccagtgactctcctgcctcagcctcccaagtagctgggattacaggcgcatgccaccacgcctggctaatttttgtatttttggtagagatgaagtttcaccatattggccaggctggtctagaactcctgacctcaggtgatccacctgcctcggcctcccaaagtgctgggattacaggtgtgagccaccacacccagcctggaagctttattctattgaatgtttccaacacgaagaaatgatagatgtttgagatgatatatatgctcatgaccctgatctgatcactatgcattatatgtattgaaacatcactacataccccatgagcatgtaaaatgatttatcgactaaaacataaacaaaaataaaataaaataaagctttattcgtaattgcctaaacttggaagcaactatgatgtcgttcagcaggtgaatggatgcactgtggtacacccagacaacagaatattattcagtgctaaaatgaaatgagctatcaagccatgaaaaggcacggaggaaccttcaatgcacattcctaagagaaggaagcaatctgaaaaagctccctactgtatgattcctaccatatgacattctggaaaaggcaaaacggtggagacagtacaaagatcagtgtttgccaagggttagtgagaaggaaggggtgagtaggcagggcacagaggatttttagggcagtgaaactactccatatgatactgtaatggtagatgcatgccacatacatttgtcaaaaactataggcctgtaatcccagcactttgggaggccaaggcgggtggatcacctgaggtcaggagttcgagaccagcctggccaatatggtgaaaccctgtctctaccaaaaatataaaaaaaaattagccaagtgtggtggcacacccctgtaatcccagctactcaggaggctgaggcaggaaaatcgcttgaacccaggaggtggaagatgcagtgagctgagatcatgccactgcagtccagcctgggcgacagagtgagactccatctcaaaaaaaaaaaaaaaaaaaatcaaaaacaaacaaaaacaacaaaaaaactatagaatatgtttatttaatttttaatgatttttttgagacagggtctcattctgtcacccaggctggggttcagcagcatgacctctgcccatgcaacctctgcttcccaggttcaagtgattctcccacctcagcctcctgagtagctgggatcataggtgtgccaccacaaccagctaattttcgtatttttcatagagacgggattttgccatgttgaccaggctggtctcgaactcctgagttcaagcgatctgcccacctcgacctcccaaagtgctgggattacaggtgtgagccactgcgcccagccaaaaactatagaatatatgaatcctaatgtaaactgccagctttggatgataatgaggtgtcagtgtgggttcactgaccataacaaatgtactggctcgtgtgggatggtgatggtgggggaggctgtgtgtgctgtggctatacttgctactcaattttgctgtgagcctaaaactgatcttaaaaaaaaggaaatctattaaaagtggttaaaatggtaaatttcgttatgtagatgttatcataataaaaagaatgttcatagcagcttcattcataatgtcttttttttttttttttttttttgttgagacagagtctcactctgtcacgcaggctggagtgcagtggtgcaatcttggctcactgcaagctccgcttcccaggtttacgccattctcctgcctcagcctcccgagcagctgggactacagacgccagccaccgcgcccggctaattttttgtagccaggatggtctggatctcttgacctcgtgatccacccgccttggcctcccaaagtgctaggattacaggcgtaagccatggcgcctggcctcattcgtaatgtctttaaactggaaacagcgtaaatgtctgtcagctgtagaatgggtcaatgacttgtggaatgttcactcaagggaatagaaagcagtcgagaaaaataacaggggcgcttctacgggggctggaatgttctgattgggatctgggtgctggttacatgggtttgtccagtgctctatgttgacttttttgtttttgttttctgagacagagtctcactctgtcgcccaggctggagtgcagtggcgcaatctcggctcactgcagcctccgcctcctgggttcaagtgattctcatgcctcagcctcccgagtagctgggattacaggcgtgtgctaccacgcctggataattttgttatatttttagtagagacggggtttcaccatgttgcccaggctggtctcgaactcctgacctcaggtaatccgctggcctcagcctcccaaagtgctaggattacaggcgtgagccaccacacctggcctctatgtcaatttttaaagtatgtgtaaatatacacatatacagacatatacatatgattgcacattcatatacatatattcacatacacatatacatacgactctggaatcaagatactctaattctggagcgttctaattctggtctgctactcactaggtttatgactctagacagattcctgtacccacctcactttccttatctgtaaaatgggggtaataataccttaagcagtcaacaaagatacatgtcagcgctggctggcagcacatgttgattcagtacttgctggtaaatattcttcttgctgctgctcccttcggtgactgagcccagagtgtctggaaggaggagagggtccatggagagggccaatctaaactgataagcaggccaggcgcagtggtctcagttctagaccagcctggccaacatggcgaaatcccgtttctactaaaaatacaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaagaaaaaaaaaaaaaaaaaaaaaaaaaaaaaaacaaaaactttgggaggccgaggcagggggaccacgaggtcaggagatcaagaccatcctggctaacacggtgaaaccccgtctctactaaaaacataaaaaattagccgggtgtggtggcgggcgcctgtagtcccagctactcgggaggctgagccaggagaatggcgtgaacccgggaggcagagcttacagtgagccgagatcgtgccactgcactccagcctgggcgacagagcaagactccgtctcaaaacaaacaaacaaacaaacaaaaaacaaaaaaattagctgggcgtggtggcgcctgccgataatcccagctattcgggaggctgaggcaggaaaactgcttgaatccgggaggcagaggttgcagtgagcggagatcgcgccactgcactccagcctgggtgaaactctatctcaaaaagtaaataaacaaataaataaactgataggtacaacacactcatcttgcaaactgctgcaaacggagagggggtgagggtggggtggggtgctgcatgtgccaggcctgcctggtgggtggctggggagccgacctgccctgggcctcctggggaaaaagggcagttaggcgggtaatgaacattgatctggggaaatggatcctttcctagatagcagggcctctcactatcactgggcaatcaagacgactgtaaaacgttaaacaccttctcgggccgggcagctctgcacgagaaaaccccaaatcccacatacttccaccactcccagaagccctgtggtggttaactggggaactctgtagggttcaaacgccatatttgccccttactggatgtgtgacctgcggcgggtccctgtgcctctctgggtctcagtttcctcatctgtaagacggtgatataatagtacctagctcaaaggtttaatgctggtagattcctgagcaaaggtccggggagagaagaggctcggtctgcaagagttgtcatttgttggctgcggtgagaccacgccccgtcgccctcccacacctgaccccgccctcccgcgtccattgggaacgccaccggaagtaatgcgagacggagcgttttggtggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgaggtgcgtcttcgtccttttccgcccttgggaacttagagcggccccttggccgctggttccgcgcctcccgcggttgggggcgtgcccgaagtctctctacggaagctggtagggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccggtgagtggccgctgtcgtccctacggagcagtgggcagagaggggtagtggaggagggaagttcgtccccagggtcgtttgctttgcgcacgccgcgcaccgtatcttcaaatacaagaatgacggcctctctctgcctcggttttctcaccgtaaaggggtaatagtatctccctgtgagattgtgaggaaggaatgaacaagcatgtagggtgcttaggacagggccgggctcagcttgccgcctcacagcaacaccagcccggagccctgtcctgagcttgacagggttccgcagttcattctctccatgatcctttgaggtcggggctcctctccccattttaagcaggggaaactgaggcttagagagtgaagggatttcctcaggtcatacagtcatgctcagtgttctttctgctcccagatcctgcgcagccgaggctgtgttagcgccaaggacttccagcagctgttagcagaggtaccagtcccctgcccctgcacagctcctcctcgttagatttgtgtccgcagcttgaggacacagcttgagcctagcctcagtccctgatccctgaagggtcacttaggccctcactttcctccttcctgccccccactcatccctccacacctgagtcttggcaccaggagagagaaggggaaatgctaagttgctaagttgcctagtcatgccgttcttaacagctctgtgagataagcacaagcaccactctcattttggattgagaagctgaggcttaaagagggatcccttgcccaagcttttacagcaggagcagatgtgatcccagccacagcttccaggcccctgggctcctcacaccttaccatataccccgcaggctgctgccagggctgctgccccactccctcctcctccttcccctggagtcagtggtgggaagcttcccaggagagtcctcagcaacctctggaacacaggacttggccatgactgtctcctgtccctgtgtgggcccagatggttgaggtacatctaggggttctcatcccagctaggctcaggttggggcagcctgaaacaggatgggtccccttctagaagtccctttcagctaacagtctggaacttgcagttgacccagatagattcaggagtgtaggctagacttggcttccagcctgggccctgtctggcgttctgggcttcagtttcttcatctgtacagtggcctcaggaggatgggaggccccacctggtaacaaccctgtgccaccccagcttgagcaggaggtggagcggcggcagcggctggggcaggagtcagcagctaggaaagccctcatcgcgagttcctaccacccggcacggcctgaggtctacgactcactgcaggtaccagccagccagagtgcttgaaggccggtactggaaagaggaggtagcatccagggctgggggtgctgcctgccccacagctggtgtgttttgctcccaggatgcagctctggcccccgagttcctggccgtgactgagtacagcgtgtccccagacgcagacctcaagggccttctccagcggctggagacagtatcgggtgaggtcctggccctgagacctggcaggaccagggaatggcagcctgggaaacctgggtgtgggatgctggggtccctccagccaccatctctgcctccaaaaaccaaaccagcaggagctggaagggtcagtgggaccaacctgccaggagcaggacatccgcattcattcattcaatacctgccatgagcctggtatcttcattctttccttcacccttccttcgtgccctcatccagcaaatagtggatatttgtgtcatgtgtgggacagctggcacactcaaacagggctgatccaagatcttaaagggaccattgagacaggtatgggcaggataaagggaccagtaaggaatggcaaagcccggccccccagggctggcaacaggagggagcagttaccacctggagttgtggctctgggcggaggcctgcggccatgccaaactccaagtagggcaaaaaatgccccacttctcttcggatttcttgctgggctcacttattggctaaacccagcaggaaatgctgggcaagggaggtttgcgtgttgtttaacctctgattcagtttcctcatctgtaaaatgggagcaacagtaaccccctctcttaaggcactgcgacgatcaagtgagttaatctgcatagagtgcctgtcacagggcccgcacgtagtgtttggaaagtgtttcctattcttattggcactgatagcctgggctaggggctcctgtgggaggcagatacaagtttcccctcatggagcctgtgctttgttgggagtcatgggtggaatgaatccccctcctcccagcctgggggtgctctcctcattgccttccactccccggcagctgagatagtgctgaggctgttggctggggcagggcctaggctgcgaggtggccccatcgtgggcacactagccctgcacccctgggcattggtgcgtccgccaagaaatgtttaggtttccattctcagcctggtttcttccccctcagggcccagcaagaaagaacagccccttctggccttcctgctgggggacagaggctcccagagccacttctgagttggggtacagacttcggtggctcatcagatgaaaggaggtgcagagagagcctgaagttggctctgtgatcccgacttggctgtcactggcctgctgggtgtccctgggctacttccttcccctctctgggcctcaggacccatatgtgagctcccagggccagccctgtggacacttgtagagtctggggaaaggttccgggcataagtggggggcatgggaatcggcctcccctgctcctcatgttacttccttaagtcatcacaatagccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgggtgaggcctggccggtggcagaggagggggtggctggggtcaggaggcagtgtcagaggttctgcagatgggctgcctgcccgggctgcgaaagaaggtcacagtgggatcaccgtggagtggaagcccagggttgcagccctctagtttccttgctgaccccaggaatcccctcccaggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggtgagtgtgtgacccatgcggcagggcctggggcagctgtgagtgcccaggcctgagtcgtgccatctgcaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatccctttgtgtttgcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccgggtgcgcaggcgtggggcctccgggcacggggcgggcccttaacaggcaccgctgcggggactggagtcggcggagaaaaccggggtccccagcgctgggggtgggtgagggtcgctcattttcccgggacggtgacgggtactgggcgtcgccaggccccggccccgctagagccacccttggagcccgcccgcggccggccttgggggcttcggctcaagcgcgtcttcttcgtcgccagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggccttccagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccaggtactgtgctgcccagcacctgagagggagaaggtcgcttcccaaggcctggccaccacctccgtcttcccttccagtcctgacggatgagcagaagtcccgaatccaggccatgaagcccatgaccaaggaggagtgggatgcccggcagagcatcatccgcaaggtggtggaccctgagacggggcgcaccaggtggggagctttcggcctgacttacaccacaggatctgggagtgttggctgaagatgtgtgctctcgggaggagtggggccgggcggggttcctggtgcctgaaaaaggccaaatgtgggcaaaaatacggtcacttggagtaagtagttgcaggggctggaagggcctggaggaggctcttgaaagggctgttgttggccgggctgaggctggcaaggcagagcccagctccactgccttcatcagggagagtgggtgaggccccagggtctgtccactcaaggctgcggggtgggagccctgggacccctctgccggctgcttgtggttctgctcctctggcattaggggacctgcctattccttgctgaacggagaccctcccacccccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagactttctctgttctgtggctttttgtgctgagtgggagggaagggtgctacatgactgccagggaaaaacaagggctccgggagcttttgggcaaagctggggtgtcctctggtggtcgtgagcacaggccacaccagcgcctgtgccttcctcttcaggtcagcctgcctggaccagacctcatgccagctgaaccccaaacccagagagctggctctgaaatgccatgcactcaggcatggagagagtcggcttcccctgccatgttcattccacagatcgcagcagtgcagagccaggtgctggggctgggtggcctgtgtggcaggtctggctctcactgcccagctgtgtcttccactctgaggcagggaggctcacagcacccgtttcactgaggtctgtgagggcaaactgagttccatcccaggaaggagctagaagcaggctaggcctagagtcagccccgcactcacgtgttggcgtcactgtgagtgtcactagcattactgttccatgcccccatcccaccatgccccacggtcgccactgcagtaaagagatccagaaggaagccttcccgcttctttaattggtgtaacagacatgacgttgtatacagagcacactcaggcccaatgatgcggggacagcagggacggatggggagatggggacactgctcacacatggcccagagaaacagacggcacacggacagaccagacgggaggggctgagacgtgaaggctgtgatggggtgggcagtgggactcagaccgagccagggaggggtggggggtctctgctgaatccctctttagaaatcaaagagaaggcaggtggtggggcgtgggggtgtggtgggagtgggactaaggcttctattctaacaggcctggggggtggcagtcagcaaggcctgcctcaccctttggttatgactggtcaggcctgagccctgcagctcagcacccaactctgtaaacatttttggtatttttaaaggacgctgccctccctctcttagtttcagaaagactggtacttcctcaagaggagaatgtgccaaaaggaatctgaagggaggtggaaagcagacctggatacagaagagacttcccatgggggggcaggctgcccaccttgccatctatggctgagggccgctgggagagccccaggggactattgctgttgtccttggcatggctggcggctgggcaggcaggcggggagtgaggagccgtgggggagctgcccccctggggagaggctgagcccactgcccacagggcctcccggcctttattgcaggagggcccgagactcttccaggtgcttctctggatggctggtctcccaggcagcaggcaagacaggataaggtggggccaagagaggaggaggcactggccacagggcccctgacaggggctgtgattgtcgggccaagcaacttcctgctgggagcaggggggtcagatattgcactttcactgcaacagttacatgaaaacttggtccataaaataatcgttgctttatacataatgcctgaaacaacaaaaagctacatcttaaatatgaataaaccctgaaggttccatccctccagacttttttctctgcacaaaataaatagctttcactctgtatagacccacttttgcagaacatttacacgaccctttggctgtacatatctacacacgggaaaaagttaacatcactctgtgcacctccccagcccggtccatgcgtcccaacaccagacccaggtcggccgtagcttctcggggacagagcctggtcgctggacaaaggccgaggccaggcaggctctcccacttccgggaaagccgaggagcagcagaggggccgccggagctggccgttgagcgccacagccaaggtcacgcttggtgctggggagagagggcagacggtcagacccagcgtgcaggacagcatggtccttgttcaggcgagaaatgaagtcatggctgcctgccctgaagctgacaaagcaagttgtggcttcttagattcggcatgaaaacggaattggcattaaaaaaaccgaagtgtgtgccccacccaccccagagtagaaattcagtgggattgccggggccaggtgaggcaaggagcccatgcctcgctaagtgggcaggagcagggcccacgggacccagaaccaggctggactccgtcacagtgctgggtgttttcagtgtggaggggctgctctcagtactgaaagagttaagaaaaggaagcagccaaggattgctcgtttaaaaaaacctcatagaaatcagattgagaagtagaaaggcgtagaaacgtgggcgggcggccttgactgatggcagggagcggaagaggcggccaggcccgtccagcccgtggcctgaggctggaaacaacactggcctgggctccaggcggggcaggcagacaggtgggcagggtccggggtgcagaaattaagatacagcctttctctcctgcttgcacgaggctctgccgcactggagccttcagtgtggttgtaggtcctgggtcagcaggtactgagtttcatgcatgtcaacggggctgtagccataggaggtggtaatgggtctccgctctcaaaaatcagtgcaaaaccagtgaggttgaacagttgagaaactcgagttaacaagatgcaggctggacccctgttggagctgctaccaaatgggaggggacctgggagtgagggtggccagtggatggggaggtggcaggctgcgcctgggcccacacctggcaccaggacacttggagatccacacagggcaaaatgtctgggagaacctcccgggccagtctgagtgggaggttctggtccctctgccatcctggggctggtggtccctgccagcttccatgacaagccggacccgtcaggcccgaggacgtgaggcagggcagggagcactgtgtggtgcggcccgtgtcctccacaaggccctgggacaatctcccaggcccacgtcagtgcgtgtgcccaggccaggcctcctggcggggctggccaccctggcctagcaccatggagaccccgcgctgcactcacggtgccctacttggggcccgcggctgcccccggctccaggcggccagtcatggcgcggccccagcagccggccgccacactcatgctgcgctggccccgctgctcgccatccgcctggctctgtgtccgctcgtgccggtggctgggcccgctgggctgggccgagatggtgcgaagcaggtggttccgggagcgcagaaagtcgccctggccgggcaggccgaagctgcccttgcgcagcgccatgcgggtggccgtgttgcgagcgggccgcgcccggtggctgtacttcagctgcgccaggtgggccgcgtagccatccgtgatgaactgcggggtcagtgaggacggctgtcacaggctggggctccccgagctgcccgcctgcacccgcccccacaatgcgcccactcacctggcactgctgctgcagcttcttggtgggccggcccacgatgtagatctgcatgggggacaggctaatggcgctgtacaccgccacgtccttggtggagccataggccgcgtgcacgcgcaggtgcagctgtggggagactggcatgggcacaggcaccatggtccctctgcccccacccctgccctgccccatcctcccgggccccacctcggagatgagcagcttcaggaagttggccttgtgccgcagcgggtcatgcaccaggccgtcacagaaggacaccacgccatgggggaagttgtgctgggccagccacgccaccacccgctgcttctgcatgtcgggccggcccgtcacgtagatgatgaggtagcccaggtcctgccagtgcctgggggtgaggtgtcgtctcatggtcaccccttcctccctcctgggcctccctgtctcctgcccagccagggcccacttgggccattggaaagcacatctctgattgagctcagacagtaacgacgacaatggttgacaatgacgtgctgcagcaggcccttgggtgcccgcactgggcggcagatgcccctgctgctgtgtccctggcttaccagcctcaccttccagatgcgggaattgaaagccgacattgagaagtgacatcgcttgcccaaggtgacacggctaataattgggggtgctgggctctgaactgaggtccttaaggcccagtgcccgagccaggcgtcccccacagaggctccgctgtcctcctccacctggctggtgggagcccctgagcccacccaccttgctacagcccctttgtgcccctctgggccactcaccgcaccacgtccacggccccggcccgcaccttggggtcgctgcccatgatggacacgctagcggcaaaggaaccgtcgatgctgaagaccacgaactctgtgcccttgggcagcacggtgatgtagctgtcggcaaacgtgtggtctcccctggcaggtggtgggggtgctcatcagaaccacccagagcctcgccctgcctatcccgccctcccagtgcaggcatatacctgaccaccatcttgatagggtagacacccacgcccaggcggtgcgactcagggatggtgtaggagacacgcccactgttgttggtcaccagcgtatccaggtagagccactcgcctgagggcggctgggtcatgatgtgcacatccacctgggcccagcaggctggtcacgggctggctgtgtctggcctctccaccccctgcaccccggccagagggcagcagggagctccccaaagtccctccatgttacccctacccgccgtgtccttaccttctccccagtcagggtgaccatgtccaggggcccatacatgaacctgcccgtcagaacctgggggccgtcctcattggcaagggcatcattgatccggtggttggccgtcacgttctgtggagggagtggcaagcccaggtcagggggtcggagggcaccccgggtccctgtgttctgctcaagctctgtgggcctgaggggcaggcttgagctgtgagctgcgcagcccatgtctgagtctggatcagacacgatgacgtggctttggagaaactaggaagccttgctgccttccctgtctgtgaagtgggctgacagctccaacctcatggcctgggaaggtacataagactgcaggcttccctgcaactcagtttcctcatctggacacggaggctggtgacagggtgacatcgtgggggcctgggcgcccgggggaccctcacccgcagcttcacgtgggtccgcttgcgctgccacttctcccttggctttgagggggtgaacaccgacacttccttgccatccagctccaagatgctggagttgtcatgcctcatgacctgggaagaggggacagtgcaggctgtggggcagatgccacccgggggcttcctgccctgggaggaggaggcccagtacccgggagcaagaggagcctgtgggttgtagggggtgttcttcaactcactactgtctgcccagtagccctcagacccctgttcgttcacctgacgaatgtgcagatatgttccctccatcccaatgtcctgaaaagcctgaatacacccgagcataaaggtgccctcatcttgcttgctctgtgatctgatggggttggagaggagtccccactgtcccctcgtctgtgaaatgtggccctgtcatgggtgttgtcactcagggccctcctgggaggtcccaggccccgggtacctgtctcagcagaaaggagaccacgtctgttgactcccagtagctggcgtggaagaggtgaggcagagccaccgtggggaaggccgtgagggcgtcagggcagtacagggcgtagtcgatccgcttctggccccaccactttgcagcgactgccaggaggggccgtgactgggctggggctgtatagccccagacagggaccccgaagggtcacccggcccctctggcctgctcagcccagcacagtccccccaccagctatagccaaaagtgagtcttctcccaggctgggtgagtgaggcaagcgggagggagcgcaggcaaaagcacgcagacccaggacagtggtgagtgccagccctgctgaggggctcctgcggttgcgtgggaggaccagtcgccatctgtgggatggtaccagctgtctgtggtcccttcctgactctggtgaccctctgccccgtggcaaccccatctctgccctctctgggccattcctgttctcctatcttcccccaggcctcaaggctgggaaaggcggcacagagatggggttacaattcctgatccccagggcaagggtgctgcccttctcgcacctgggccaccctacgagccctgagacacagcagtgtgggcggggaagcctgggcctccagatggatggtcctgggtgcatctggctctgccactaggggctgggcgaggacaaccttcctgaacaagacaagcttgtaaagtgccccctgggctgtccgcaggagaggcccagcagcagggcctggtttacaggtccaggcttccctaggttctgcccacagctttccccggagcttccttggtcctcatctggcctcactccagctccgtggggtccctggtcccccaccccaccagacaatgccaccagctcccacctcctccctagatggccaagtcctcccagcccagcccccagctccctgttaggccgaagcgggggtctaggtgggcagagcctggcagtgaggggtgctcagcagcagagtgacccccagtgaggggaaagtgtgtggggtggtaccttctccaatgtccagctcagggaggccaggggccctctccaggccagggcttgccttcctggctggagggtgggggccaggggtggtggggctgggggcgggcagggcgagcagggacagacgcctgacgctgggggtatggctgagcgcatcgggggcctctgagaagcaagagcaatggatggctcagccacgcggggatgaccgcactgccacgtctaccaggggccaggcaggacactgggacagtgccaggcctggagctatcaagggcgagcccattggccctcctcacggatgaacacaactgccagcaacccccaccccagcctcagctcctgcatggccaccctgaccacagctgcgagaatccctggcccagcacggggcgcagcccctggcggggactgagaagggaacccgggctgtgcttcaagcaccaagaggcttcatgcaggagctaagcatgaggaaggcggggcccttactaatgcgccttcttccagaatcctcctgagaaggcgaagcttctcagcctagacactgcagagtctttggacttgaccggtctctgctgtggggctggcccgggcactgcaggtgcccagcagcctccctccctctacccaccaggtgccagcagcagccctccctagcttcatcagctagaaatgctcctagacatggccagcagctgtcccctgtgggcacaatggccctggctgagtgaggagggtgaggggcctggtatactcactctgggcgatgctggatgccgtgtagctctcagccatgcctgacacctggctggcgatgctgatctcactggctcggcggaagccacgactggcaggggcagtgcccggcgaggagggggcgccatgctcttggaaggctgcattgtgggtctggagcacatccgctgcaggtggacagggaccagaggccaggtaagagaggccctgcccagccccggagcagtggggaagccagtgtgccagggtccagtgtgcacctagactggaggctgggcagcagctgtgccagagccacctgctcagggccgtgagaggaaggggcccagagctttagcaggtgaggaggagggctggggcagggtggactgacgaatggacacagacacagggcagggaggcgtggcagctgggctcaacctcagtcaccctcctgccccacacacacccctcagcttgtctccagcaccccagtggctccagggcctccagagctcaccctggcctgacctgacccacagcccacagcagaagcagcggctccacccaggtttgcagggcgctgacaacaggtgccatgggtggcttcctggggatgccctgcacatgcagagcacagagagaggcaagccctgagcatccctcacacaggccacagccagcagcccctgatgggcgtttggggacaaaggcaggtgctgggggctcaagccaggctcacccaggcgcaggctgaagacaggacagaacagggaggatggggctcagccagacaagccacacctggacggggtacaggaggtgcctgggtgacctcagaaagcgaaggagtgggccttggggaatccaacccctcgctgggaccagaagcttccccaggtgaggggtgggcccggctggctcaaggcctcagtctgcttctggcagagccctggaactgtcgctgacttgctgtgtggccctgagacggcctctgctgtctctgagctgctgcgcccctttgctttggctctgccctgcctctggcccacaatatgcagggaggaagcaccgacatcagctccccagagccgtcctgcccaagtctctgttcctcaccacccaggtcccacgaactgtgagtggccaaggagggcatggattggggggtgtccctgaggaccaggtcaaccaacgaagcagacgtcaccacgagcaggggagggtacacacactcggcacagcccgggcggggcccgtcttgccaggtgggcgcgggaacaggcatactggtttccaggaagccgtccccgtgggggagaggggccagggggccgccctccaggaccagctcagggtttctctgcacggtctcgactggaggcagacggggagagaacagaggacaagaacagacacttgcatgggccatccagacacgctctgacacagagactcagggctcctcgaggaccaggacgtgacaagacgctgggacacacgctggggcaggggtcgggccaagcctacctggacctcccctgccccaacgcatctcctgcaccctatctcggggccagccgcctgccatgatgggacccagccgacccaggccccctactaagtgagggtccctgctgggtccttagctctgtctctgttgggatggaggctcagctgtggagaggggagtctggtcttgttctgccctttccctgctccggggaccctggaacaaggccctgacctgtgtcctctgaaaggtgggaactatcatttgtgcctcacagggatcagtgcggagggatgcaccacccccaccccccacccccaacagctgtccacctccaagaggcattcagcacaagctgtccctctcacctggggaagaaccacgtagcatggaggacctaggagccagggagccacgcttaccccaccttcccccagaggagtggggcggaatgtgcctctcacccagcagcgtggagcagccatcccccagcgggtagcgttggtagcgggggacgctgaaaggcggcagggcgtgaaagcgccgttccagcagcggctccaggcgtgaagctgacgggtccgcggggtggaagaggttgtagacttgctggcaggccggccgcagctggaaaactgggggtgggggtgttggctgcagagctggggctggccctgaggagcagtggtgggggtgggaaatttgggaactgggcactgggttgtctgctgaaagttagggataagatggggggtgtgtctctatcaatttgggacctgtttgggtcattgtcacttttttgtttgtttgagacagggtcttgctctgtcacccaggctggagggcagtggtgcgatcttggttcactgtagcctccgtctcctgggctcaagtgatcctaccccctcagcctcctgagtagctgggaccacaggtgtgcaccaccacacctggcttttttattttattttttgtagagatggggtcttactatgttatccaggctggtctcaaactcctggactcaagtgatcctcccacctgggcctcccaaagtgctgggattacaggcgtgagccaccacgcctgacctctaattttttttcattgcaaaagttataatgattgtggtaaaaggtggtttgcagtacagaagagcatatgatgaagggcacatggtggaaaccccttccaccccagatccccccgaagctccagctcatcttgcgggagcaccaccgagtgctggctagggcagccctgccctgcctgtatcggaaaatgtttccccttctgtcaaatggggcagcagttccaaccacgtcatggagttaaggagatcacgtgaatgcaaggttgtgttaattattagtgctgtatctcacttttagagggacataaaccagaacatatgctatgccttctgaactttgccttttcctcccatttaacacaaaaaatgttggcgtctttcatgtcagcacgtctagtttctccttgctctttttcagtggaggcgggtactccactgtgtggttgtgccagaatttatttaaccagcccctccacatagacggacatttaagttggttctggtttttcacaatgacacataatgggaccacaacggtactgtccctaagtctccatgcacctgtgtgggactctgtggggctgttcagagcctgcagtggctggggcacagggatgccctccatggggctgccttggttgttggggtccccttaaagctacccatttctcttcctggcagtgctgaagtcgccagtttatggaaggggaaggcacttgggtgctgagtccagaggtctgcatttttttttttctttttttttgagactgagtttcgcttttgttgcccaggctggagtgcaatggcacaatcttggctcaccgcaacctccgccctcccgtgttcaggcgattctcctgcctcaggctcccgagtagctgggattacaggcatgtgctgccacacctggctaattttgtaattttagtagagacggggtttctccatgttggtcaggctggtctcaaactcctgacctcagctgatccgcccgcctcggcctcccaaagtgctggattacaggcgtgagccaccgcgcccggccagctctgcatttttaacctgcacttggcaagcatctaaacctctctgagcctcagtttccccctctgtcatctgggagtgtaacatgtgttgctactctcaggattgtgtggctcctggagctttgcaggctgatcccagggcacagggcagggactgctgctccaatgacgcccagccgctggcctgcctgccctgggtagacagagacgcacagctgtggcccctccagggctgggagcccactatacccaggaggctttggggatgcctggcctctgcatctctccctatgggaggaccttggacctgggaggctgggtctgtctccatctgactctggggtggtgccttctctccctggacctcagcttgcccatctaggggttgaccctcagcatccacaggcaccccggagatgaaatgaaacagcaggtgtcacggacggccagtgactgagctgctgaagcaggagcagaggatagcaaggggcccttggtggggaagacaggaaggagggcagaaacaggcctgggacgtggccatgatctcatcacaggggtccactgagacccccgcccccgcacccagtgcatgtaccccccatcctgcccctgctgggctctcaccatccagggctgggatgacagtcttcctcaaggccaggaccagccccagcgggcacccgaagaggaagaggtcggtgatctcaaagtcaaacctgcccagggcacctgtgccatccagcatggtggagctgctggaatggcgtgagcagggctcagtcctcagcacgctggcatggaggctgcagacccaaataagacttagctgtcatgtgggtgcagctgccatcatctgccacgacactgctggtggcagcaggtcccaacctctctcgggggcccactggcttcaggacagccctgagctggaccacctgcccctggtccattctgcccccaactctgccattccccaccctcaccctcaagacaagttgctccctcaggcccaagatggcccttggtgtatatgagacaaggcatccagtaagccactttctcctgggcccagactgggattccaggtctcaggctgggggaacctcaggcagacagcccgggtctcctgttggccatcacaggggatgttcctccctcttggagcctcttcccacacccagaggcaagccccagccccccagccctgcccacctggacaggaaggcctggtgctgctggatggtatccagctcgtaggtggatgagtcgctcctcttgcggggcagttgccttttggggtcctcagtgccgttgctgcgggggatgtcgacgttgcttcggctcaggtgccgactgctctccaggctggagccaccactactgccaccaccaccactgctgccaccaccgccaccgccgccaccgccaccaccgcagcagtgtgctgcattcatcaggatgcccggggacagcaggtcattgtcctggaacggccccgtggaggctcactgccaggtggccgctggcctgaccccttctccagtgtcctggaagctgcctcctccctcctaaccccaggccaagcggccactgtccagccggcctcttgccaaaccagaggggagggccccattcccttctgtcctcccacccaccagccaccctggacctcattggtctacaggccgttttccactatgcagcagaggcagggaagcagagaggggtcgcccatcccacctcctaggaaccagaccccactgcccgcagtgcagaccctggttcaggctcatgaaaccacacgcattcctaggcttggccacatagcagctgctcccctgcccccatgtacctgccctgccgcctctgggcacctatgctgccaacctttgcccttcccatccttttttggaagggtgaggggaaagagattgtgagaaaaactgctacagctctttcagggcccaggcactttccttgactctttggccagaatgtgctgggcttcctcagctcccctgcacccccaacccctccacagcccctgtcctggaggtgagctctggcagcagggttgggggtcaggggcttggaaaatgtttgttgaatgaacagagcttaactgggtagagtccaagccagatggactcaggaagtgctgccagcattctgcttggtggacacagcctggggccaggtgcaggaacaggcagggcagccaccctgggggcgtgcaggaggcttcaggccttggggactgtctgggcccccacttgggtacctgcatgctgaccacgctgccccggcggctgctgctctgactctcagacaccggctggttactgtagcacagggcatcaaatgccaggatgcccccgacgcagtccccaatcaggcagaccttgggagagaggggccagaggcctgagccattcacccgctcgctggactataggctggggaggccgtcaccttccccctgaggccagcccgccctacagggtcttccatcctcctcccctccccaacttccccgggactcacctgcccattgaaggtcatgccctcctgggacttgatgaagtccccataggcaaggttggctcgctgaatcactgtggcaactgcctcctggtactggggggaggaggtggccagcagggggagggcagccaggggaatgtggtcctgactgctggacagacagccttcgtcatggctgtaggggctgaggctggggagaggggccagtcaagagagggcaggcggctccagctcagcccaaagggcccctctcccctgacctgagtctcagccatggactcagcatacgctagtgaggacccttcccggccagggcctggataggcttgggggaccagggtgggtaagaccccatgtctcagaggcaggccaatatccccacattacacgtttggaaacgaaggctcagccatgggcccaggcctcctgggactcgaggcttagcctgcgtgtatacgtttgggcacctccaggtagaaggggctggccggtgggtctggacatcggggcaggagtcctgaaactggggagccacctgaggcccaggggtaggaggaggacagtgcactgccggaggctgcaatcaagggcagatgccactcacttggagaccagggcaaaggcgtcagagcagacgggcgggcagggcaccaggcggatggcaaggcggcccagggcgctggggtagtgcacgcgcatgacggtgtcgaacacgttggcgatggtgttagcatcgcccttcttggagctggggtccccggcgcctgtgtccaggatggtgcctccgtgcagcaccagtagcagcacgtggatcttggagggcggtgcagccagcggctggctaacctcgtcctgcatgggttgggggacagtgtcagctccccagggaacccagctccttgctgaggcccctctgtcacccttgttgggggtgtgcctcttgcacgcagcccaactgctccctctgagaaccccagttttggttactcatgcctggagcctggggtttggctgcctcaacccctcccctgggactcttgcagggactggagcctgcaggaggaggcagggaggtgggcctgtccactcctcctcctgcagccctgctcctgtctgccaccctcaccaggggcacagaggacatggagggagggagtccattcctttgagagcatgagctctgcttccttcagggagcccgggcagtggcttctggggcttccagctttagcgggaggcagagaggttcagcctgtcttggccttgggggctgcctgccctgtgtgtgtctgtcttggcctgagcagacagggccaccaccagctcaaagttacagaggtcacctgagaatggctggggtcagggcatccacagcctgagtgggcggcaaccccagctactctgcctgcagctccaagctctcccccaagtcattctccccaggcccccaccctaaggccctgccattcctggcctctctctaagaccagggtctccaaaaggagaggtgtcctggtggggacggagccccagcaccttagagaggaggtcgatcagatttcaagaggtaatgaccccaccttcctgccaggccaggcctgcctgtgaggtcaaggtgagaccctagacctgcacacttgtgtaggggctgcgaactgctccaggctgggggactgggccaatatcacatagcgtgtcggtgccaggctggatcagaatctgaagcctctgccactactcagcactctcctgccaggccaggctgtggccctgtccccagaggtcaccctcccctgccccaagcttctggtatgtgaccagaggatagcagcagggccagggcctgagaggggccactgatgagtacttgctgtgtccatatgatgtctggggtgtgggggcagggaagggagctgaagggagagtcctgcctccaagaacccgaggagacagaccaaggagccaaagccatctagagggcttgtggtggggacagctggccctgaactggccagggggtaggggtagcaccaggaaccaggtgccaacacagaggctgggtgggtggggagggcaggggctggatccaggacttaacaggccaccaggtggctgggcgcagtggctcgagcctgtaatcccagcactttgggaggccgaggcaggcagatcacttgaggccaggagtttgagaccagcctggccaacatagcaaaaccgtctctaccaaaaatacaaaaattagccaggcatggttgtgcacatctgtaatcccagctactcgggaggctgaggcaggaaaatcgtttgtacccaggaggcagaggttgcagtgagccaagatcgtgccactgcactgcaaactgggtcacagagtgagaccctgtctccaaaaaaaaaaaaaaaaagtgggcaccaggaagggcaagggaatggatgggctgggccaggagccactgagcagcaagaagcctggtgggtgctgctgagctggaggaggaaggctgggctgccctcaccccaggaggagccaagggcttctctcttcttcccaggggccagggcaggactgacacttgtcttcacatggggattagccaccactggttggcctggacacaaacacactcagcccagggcagagggggccaccagctgcccagaacacatggcaggagggaacaacatgagccctgttgggctttgacaagggcttttttccagtccagtgaggcgaagggcttatggaagaaatgtcttacgcagccttcacgacagggaggtgacatccagcggtactttgtcaccaggggatgagaagggcttggcactgggggctgagagaatcctgcataggcctgtctgactgggctcagccctggagatgatccagggacccccagaggcccctggaacacagcctccctacactcagcctgctttctccaaggggacacctggcctgccctgggctctagttggggctgagccccctgcagctgtagaggcatccccctactagtgtctccacaaggcaaggagcaggggctccggtttgggggttcttgcaagcaaatggatttggctttggatggcggtaccccagaatcagtgctgggttctgaacacacaccccaaggcagatccagagccccaggccccttctgcccctcccctgggggggcgtcagagctgtgtgtgctgcaggtggggaaagggatccgtttgcttatctagacattaagcagcaattggaaatcaactccccttattccatgaccctttctagaaagctgacctcggcatcagaccgcaaagcagaaaaccacaggagggggaggctgtgtggatgtccctcctcctccccgcctagattccccgggggcccgagttccccacagaagtggtgctgcctccaccttaggtagcttgaggccagagcagtgcggtgaccgcaggtgatggtgggacagcccagctcagccctggctcctgtcccagtgcaaacagctctgacggcccgcaggtggaggaggatggggcatgaactcccacagagaacccccgaagcggatacaggcgctctaccaagacagttttattggacacactgagctccgcctgcctcccgcggggccatcttgtcggccacggccacatcacttctgcctagacgactgtcgcttcctcccttttcgtctttttatcttcagggacagcagacaggctgggcacaaggtgaagatcttatttttgatctggaatttacaagtttctcattttactttcccatgggtggagcttggataaggctttctcaggggttgtctgtagtccctggttctcggggacctcagagacagagggcgacaggcgccttcctagcagggcagcaaaaaaggaggcccaggcctctccccagacagtacccaggcaggcgtggaggtgaggctgccaggcccagagttccacctctgtaacccctcagactattcctctgcaccctgcccctcccttggcggccatgcccctgtccctctgacacccgggcacccacctctatgatgttcagctgctccacactggaggccaccctgaactcaggggcaccctggcggtacagaccatctgcaaagacacagaagccgtgctgtgagctgaggggcagcccaacctggccgaccggacagaggctgcaactgtgacgaggggagcttgggggtccccaactcacatgtatgcccagcactgtgcagaagctggtcagaaaggagggggctgaagccctgcaaccgccctccccaggctctgcagcacccccagacctgctgaccttgtgtgtcttccggctctgggctctcgatcttgtccatgaggtcattggagctccacttggtgatgtccttggggaacatttcctctgtgtcggacaggtcctctggagaggagagagggaaactcaggtgggactgggaacgctggggaagcctggcttcccgaggtggggacgcccctgtgtacggctctgctctgaccgttcctcaacaggacggccacacagccccacaccttgggcatcttcctgaccattacaaaaaatagtggtaacattcacataagaaaagtcaccatttataaagtggcatttagtatattcacagtgccctgcaaccatcaccactatctaattccagaacatctcacctccctaaatgggagcctcatacccgggagcagtgggtcctcagtcttgccttccttggcccctggccaccaccaatcaattttctgtctctacagatttgtctattatggacatttcctataaatggaaccatacaccatgtggtcttgtgtctggcttcttgcactcagcatagggtttctggggctcctctatgttgtagtgtgtgtcagatgcttcattccgttttatggctgaaccatagtccattgcatggacacacccgttttgtttgtccactcatcagctgatgttcctgactgtttttttaaaaatgctatattgaccaggcatggtggctcatgcctgtaatcccagcactctgggaggctgaggtgggtggactgcttgaggtcaggagttcaagaccagcctgaccaacatggtgaaatcccgtctctactaaaaatacaaaaattagtcaggcgtggtggtgtgcgcctgtagtctcagctactcgggaggctgaggcaggcgaattacttgaacctgggtggcggaggttgcagcgagctgagatggtgccgttgcactccagactgggcgacagagcaaaactcttgtctcaaaaaaaaaaaaaagctacatttaggccaggggtggtggttcacgtctgtaatcccaacactttggaaggctgagtcaggtggatcacctgaggtcaggaattcaagaccagcctggccaacgtggcaaaaccccgtctactaaaaatacaaaaattaggcaggcatggtggcatgtgcctgtagtcccagctactcgggaggctgaggcatgagaatcacttgaatctgggaggcagagattgcagtgagctgagattgcaccactgcagttcagcctgggcaacagagtgagactccgtctcaaaaataaataaataataaataaaaataaaaaatgctacatttactttattccatcttcaccatttttaaaatttcttatatattttatttttttgagatagggtcttgctttgacgcccaggctggagtgtagtggcacagtcatagcttactgcagccttgacctcctgggctcaagtgatcctcccatctcagcctcccgagtagctggaactacaggcatgcgccacgacacttggctaatttttttatttttatttttgtagagacgaggtttcactatgttaccctagttggtcttgagctcctgggcttaagcgatcccaaagtgttgggataacaggcgtgagccaccgtacccagttcctgttttgtcaaattgacaaataatcataattgtacatattcatggggtacacagtgatgtttcaatacaccagtgcatggtgatcagattagggtaattagcatatccatcatgtcaaatatttatcatttctttctgttgggaatgttcaatttccaccttccagtgatttgaaactatatattactgtggtttaaaaaaatttttttatttttggtattgacagggtttcgccatgttgcccaggctggtctcaaactcctgggctccagcaatccacctgcctcagcctcccaaagtgctgggattacaggtgtgagccactgtgcctggcctaatacattactgttaactctagtcatccagcagtgtcacagaactagaactcattcctcctatctagatataatttcatatcctctaacaggcctctccctgtccctccacaaaagcacagcttcataagaagtgctgctatgaacaccgcctccaagactcctcctcctgctcctctgagaacttctgcccaggaccaccaggctcatggctactgtctggctctggcacttgccggcccccctccagtcctggatgggctcctgggcccatttccccaggacaccgctgtcctggcacttcctgctttgctgtcttttttacagctttttctatgtgaaatacgtattgtcctctcatcagggtcagagagccacctgggaggggtgggacgccaagaggcccctcctccgtcctgggcaaggctcctggtgcagaggccagctcgggagtccccagccaccattccaggtcctccagtcccagggccaaaccaggcacctttcttctgcctggacactgactccccaggttccttcccttgagggcagctggccagttaaccaaaatgccaccttatgtggttcctgtgcccctccaagccacagtggtgacatgagatctggtgctgcctgtgtctgctgagtgcctatgggctcgcccccatccctttctgagcctctgagctgctgtgtgaactttgggctggctcagccactggcttgcagagggacccaagcccccaacccctacacctgctggcccctccagcttcctggagaggaatggctggggcaccaagcaggcgagcgctgtatgcatgcctcttcctggcacaggtggtgcatctgctgtatggtcatgcgcttattttgggactagtgggaaaatgggcacttcacatgttttctgcttattgcattttctaaagtgcctgcattagatgtggtattaatttaatcaagaagaaataaggtaagtacaaaaaattagaaaattaaaagaagttatgcttccatggaaataaattcacatacggaataaagccctagtctgatggtgtatccttatttggggtttcaagagcgcagtccccatctgccaggcccacagcacatcctgatatcgggttctgagaccccagactcaagggaacaagatgacctcatctcatcctctgtgcactgccccaaacaccaggctgtccacctgggacagtgcaggtatagggactggatatagaatagtaacaggcaacacccgcatcagtccacacccacaccctaagccctttcagacccctccccacctcgcccaggaaggccccaaggactgcagagcgctgcctgcctaccgtgcgcatcgaagaactcatcatctgagctctcatccgagtccctggcaatactctgcatcctccactctgagatgctgtggcgggaaggactcgctggaaggcaaaaccccagattgaccgccaactggagaggaagggcccagaggctgccctgagccggcaggaggcagggagggccacccacaggcctgacaggcatcacagaggctgccacaggagccaggaaggttccgaagagaatgaagtgtgtaaatgagtggggagcggcctaggctcatctcctgtccgcctggcacaaggcagtcatgtcccggggagcatgggtggggaagagcatgacagacataagcccaggacgtggggtaagacaggcctgggtccactcctgggcctctgacctgagtctgaccaagagcaaactcctgaaatttggccacagcagggcccaggcgggagatgagtgagccaggcctgcctgctggagaagctggctccacccagggtgcctgggttgatccttaatctcagggtctgaagtctcctagggtccccatcaggaggggtggcccctccaccgcgctgcaggagcccagccacctccactgctcctatgggtagcactgtcttccctgggcatggaggggaagtgttggggagcccactggggcagggcccaggcttccctgtgtgcgaggactagcccagggctctgactccctctgggcttggtgcctcaatgtccatgggaaagaactctgaggaggtgcagtgatccagcagtgtgtggggctgccttgaggggagggaccttgagtgtgggtggcaggtggcgcagggccttacctccccgcttggacgaccgagacgacttggaggatgtggaccactgtttcttgaggccgcgccccactaggggctccccattgctgctgctgggctccgggggctccccagaggtctggtccgagacggcttcgtgcttgacgagctcagtggcctcctcaccatcctcattgaactgggccatcttacgggaaagcatgagctgtgcctccttctccagctcccggatgttctccatgctcagcccataccactcgtcctgccagcaccaggcctgccggtgagcccgcaccatcaccctccgtagtcctgtgccccatggggatcagagagggagagacgaggggagggaggtcagcgcaggagcctgcacggaagtgtggggcccaggcaggggctttgggaggctgtacccatgttgcaggtcaaactaaagtcactgcctgtctgtgcctcagtttccccatttgtaaaataaggggactggctcacagatagtctcacaagctcatagtggttctataattagagtggaggggcctcccaaagcaatgtgtccggtcagaagccacagttggaagggcgcagtggctcatgcctgtaatcccaacactttgggaggattaggtgggaggacagcttgagtccaagggtttgagatcagcctgggcaacgaaacaagaccctgtctctataaaaaaaaaaaaaattaaaaaaaaaaattagctgagcatgctggtgtgcgcttgtagtcccagctactctagaggccgaggtgggaggatcacttgagcccaggggtttaagcctgcagtgagctatgattgtgccactgcactccagcctgggtaacagagtgggaccctgtctctaaatcgataaataaataagaagccacagttaattttctgggagattcctgcacaggggaggtagaataggacttcctgagagtctcgtgtctcagtgtctgctatatttttcctgttaaatttcccacggaaaatcaagttcaagttcaaactgggttggttctccttttcttttgtttttttaaaaaaagcttttagtagaatatattatgcacgtgagatatataagaatatattatacatataaattaagatgtagaataaagtaaagaatatataccttttaaagtataaaaaacaattaaagggccaggcatggtagctcacatctgtaatcctagcactttgggaggctgaggtgagaggatggcttgaggccaggagcttcagaccagcctgggcaacacagggagatcccccatctctaccagaaaagacaaaaaaaaaaaaaattagccaggcgtggtggtgtgtgtctgtggtcccagctacttgtgaggtggaggtggggggatcgcttgagcccaggagtttaaggctgcagcgagccatgatcatgccactgcactccagcctgggtgacagagtaagaccctgtctcaaaatagtaataataataataataataataataataataatagaatgataaagactaaaagcagactgggggttgccttgggccagggtgggatggggatgacagtgaaatgggaacaaaggaccttctggggtgatgaatgctctgaagttgtgcccagctgtgaatatactaaaacttaccaaactgttatcttacaatgagtgaatcatatggaatctaaaattatgcctcaataaagctgtttaaaaaacattaaaaagcaatgagacatccacatccacagccccagcgaagaaacacaccatcgccggcgacagggagccctccactcgcctggcccctgacagttggccccgaattttgcttgtcatgcgttttgccttctggtctcagcacacagatgtgttttcctgcacactgtatcaggctggtatggctgttgctgaattccgcatctatgtgtcacgctgtatttttctgccacttgcttctctgggtgagttttgtccatggatgcacgcgtgggggctttggctcatcaagctgggattgtgtggcatccgtgtgtgtgtgaaatgccacatttcattgattccttttcctgccaatgggcctttggctaatttacattgtttctccattttgctttcataaacctggtgctctgaatgaacattccagaacaggcatggggatttctccaggggacaaacctgggagaagcaatctcagggcatgtacccccgcctcccctagagcatgctgagcgggtttgcaagcagttgggccacgccaggctcccaggctggtctcctgtgtaccctcttttcctgcctcctcacttcccacccctggctttgctcagccttcctttctaaatcccatccattcttaaagacctctctgtgggatggagtcctgtgtcccctgcccaagccccaggggtggcctcagatgtggcacactgaagagccttggttaccttttctgggactgtctgctggcctcacagggctgccaggaagggccgcatcccttgctctaccctatatagggaaatgcctcctcctggggtgaccggaagggctgggacatgcactacatctggggccaggcagtaatgaggacagctgagagctgtcccaacccccaggagttgcctcctcaaggcccccaagaagcccagcgtagctcacatgagttcacgagatcatccccgtgatattataggactagtactcacagttgtcatcaagctccacctatgtgccacaccccatcttcagttctgaacccacggtctcggcccacaacagtccgataggatcggtgtcattacacccattttacagaagagaaaagcaaagctcagtgaggctgagagaccacagagccactacgtgtgagtcaggcctggactctaaagttgtcttctttcttcccaccagccacaagctcctgctttctgaggggagaactgactttcagggagctggggagtctctgcagcttggccaggatctcagctgctgggtagggctagggagagccaagcagacccacagagccagagtgccaggagctgcagccttagtaggtctgctgggtgtcctgtgcagggctgaacctagagaagccttgaggagagggtgggacgagtcaccagcgctgatgtgttcaggttcctggaggtcgagaagggcggtaggggacgccctgcccaggataggggagcccctcccagtcctgcccacatgctcctccactcctcatattgcctgggaagtgagaaccaccattcccattttgaggcttcagcactggggttgcaggtcccagtctgtgagccctgggtaatggagagaggcaggtttgggccaatctaagctcccatggggttagagagatggattgtgggaatgcatccctctcaatggatgggacagcttccttctcttcctgccacctctcccagctgctgattgacaccgcagcagcccttctggaaaaagaatggtggacaatgtgtctgagtgttctgccctggggatggaggtggtgacaccaacacacccatcgaggccctgtccacgtcttcgcttctccaagtggaagaccgcgtccttggaccccaatcctttcgggtacacatccacccttcccttggggtcacagccccaacactgaacatggctgtctagtgagacacctcccttactgatgctaagaacaggaggatgttaattcaggacaagggtggctgggatgggaggcagatctagttcagccccagtgttgggtctctgcttcctcctgcataagtggagtgacaatgcctaccctcatgggttatcgtaagcttacgtgacaagcgtgatatgtactgtcaacagtgtggctctgttcaatcttaaataaagtcacccttgctcatggcatcacaaggtgtctggctggggtgccttttgggtcatgggcctcagggaccggaaccagctcttggaatgacatcatgctatgacctcggcagaggggggtttagggctctaggtgaggaaatggcactcactgcaccaggacccccaggccatctgctgtctacctgttccatgggcacctactctggctaggctggtgtgggtgtgaaggccactatgatgtctgagacaccctgctcctgggagcttccagcccagtgagggaggctgagctgtggccctgggttctgggcctccttgagtagaggaaacaaaggcctgggagcccagaggcccagatgagcagcagggaacctgtccccaggggctactcagacctgtggagtgtgggctactctttatcaaatgcgaactaggtcaggaatgtctgggggcagtgcctagggcttcttcatccaacaacacacactgcttgtctctgcagatgctcagtaagtattcatggatgttcaagataacccatggctggcgggtagtggggaagctggacatgggctttggtgtcaccttcccagaacaaaacagaaacgcagactcccaggcagacatgcaaagagaggaggcagacaggcaggtgacaggagacagaggggttgggtagcccagccactgcccacctggcatgggtgtgctcaccggtgtcgtggatgaacctctcgatcttggactgcatgccccagtagcggaactccaccttgcagagcttgtatgcgcacatgatggggaagacctgcttcttgtactcctcgatccagttctcggacaggggcccccgctgggtcttggttgactggaacagcttggggtcctcttctgtcttatactcgttgtggggcacagggtctttgacaatgtcgatgaagtctgtgggtaaacccttagagtggccacttctgccctgacctcaacccccacccacatctctccatgttcctccacccccaaatcctcccaggactctgggccttgccctgccagagggaccctgggagtgaggatcatgttctgggcagctctgacctcaaaatccctgacagtggggcctgcagtttccttggtgcattcattcattcagataagggtcttgctatgttgcccaggctcaagcactcctcccacctcagcctctcaaagtgctgagattacaggtatgagccaacgagcctggccccttgttgccttttcaagtcatttcagcaaaacccatgttctgagtgcaccctacctcttggcaaagcagataaataaggcaatgaggaaacactggggagatgaatttccatgaagaatacagggtgggaggaacagaagagaaggctaggaaaagcttcccacaaagacggtgtttcagccagaggggtggaatcaagaggtcaagaatgtcccagcagcaccggcccttgaacaagaggtggggggttctggggaaggaaccaccagggtgtctgcgtgaggagaaggatggcagcagtcacagagcaatggggatgccctggacatgccggccacttctctccaagctaggagaccggacagttccctgagagccaagtggacccaggtatagatctgaggctgagagggatgcaggcaggctggcctgttggaaaagccttcctggacagagaccggaagagatgtctgaagaggcctacagggggtgtctggccaagcttgctccaggctaggcctgagagcaggggcagatgccacagaggtaggagtgcagaaaacaggcttaggggctgacaggacctggtgagggtgacaagaagatgggtgatggctctgggcaggacgtaggccaggccacttatgatcacaggcttcccctccacagcagcatctcagagccctcctgtgtgctcactcccgaggcacatgtgtgttgggcaggactggggcactcactgggtgagaaagagccccagtaaagggtttgtggctcacagaacccttttttgcggtcggttctgctctagccaggcccttggctgcctcattttctccaatgtgtgggcccctctgtatccaggctgcagactgcagacacagacatcagctccaccaaaatcagcagggtcaggagcaagtctgaggaccacagaatgccaggagggatgagcactcttcctggagcagaccatatgccctgcccatgtgagccggcaaagaccctgcatgggaaatgtcacagagacttaggacccatggcagctggcctcagagggagcctgcagagctctggcagtgtcagggctgcctgctatgggaagagctatgtacaccccaaccccaattcctacgctgacgtactgaacacagtgcctcagaatgtgatcttatctagagataaggttttcaaagaggtaatcaagttaaaagtaaggccattaaggtgggtcctaacccagtatgactggtgtttttataagaagaggagacaaagaggtagacagacacagaggggagtgaccatgtgacgaacgaggcagagattggagggatgcttctacaagtcaaggagcaccaaggactgccggcaagcagacactgaaggggcctgaacagagtcttccccagggggaagaacccaccatgctgtgatctcagacttctggcctccagagccccgagagaataactgtgtgttgtgcaagccactcatgctatgacgctttgtttcgcagacccaggaaatcccagcagaggtgggggggttgggcctggagcagctcctgggccatggacacccacccccaacccgcatgccctgcctgagatgcctccacagtgacttgggccttgtacccagaggctgcaggagggtggctgctgagctgcactggcccacatatgtgttttgtttcactggcatacatttatttacaaagatttttaattggttgctaacatttagtattgggagatttctcatgaacatccttatcactggcttctcttgaaaatgaagatttaacaaatggggcccatcccctacatgtcactgtcatctggaggtagtgggtagggcacccaccatcaagaggacatagaccccattatgtgccgggggcacttgtgcatggctgtcagctagagatggatgcccgagcccatatgtacttctggggagtagggatcccgcaaagggatggagggaagcagctctgggtggaaaaggcacttggacttggtgtatatatcaggagaatggggctgagaaggcctgccctgcctcccccatgggccccatgcttgctccaactctgacctgcctgcccaggacagggccaggtctggagtctaccaggtgtggggaaaaggggcaggacaagagggacctgtgggtaggaaacccagagtacagccctgtggggctctgcccttcctggttaccgattgtcagctggttcttttccacaggagagaggttgaacacgtcggggttttctccagcatcagttttataaaaggtttcaatgtcgatggagaatttctccacgaaaggacaggtgaacctgtgcggaaaggaaagcactcatcaggacctgtccttggagaggcccagtgtcctggccagggcctgttgacccactgggtaggagtggagctggtgagcgggcatggaaggagggtggagggtagccgagacttgcctgccctgtccacctcttggatcgccactttgtcccaagaacagccaggatgggggcagggaaggatttagggggagcagaagacagtgtatcctcagtggcttctagaagccccatgtccaatgtccacagcatggcaggaacacgggcacagctatggcagcatactgccaagcaggaggaagctggggtgctccatggggcatgccacctctagttcccaagaagccagctctgacaatgggggaatagcctctctctaggctggagatgagcttagaggggaaagtactactgggaagaggaaaaagctccgtggatccctcagcaagctccaggtgcccaccagcgtggggaagggagccccaggagatttgtggggaccccacctgctcagcagtagacagcttgtgggaccagctcccatctattcaactcagcagtgataagctacacactgcagggcacagagtgaagaaccctctgccagggaatcccaaggacagccctgctcagcatgggatgtgggacaacactgtcacagcagctgaaggtctcagagttggaagggacttctgggtcatctgttctaccctcagtttctttccagaaggctgtctcagccttcttagggagcctgaagtgggtttacattccctgcatcttctggaatggcaaaggagtctccaacagccctcgcttgactcacgccttcatggcctccacacgtaggcagtcaggaggcatctaggggtatatccttccctctcttgcctgtgcctgccctaggtgaccttcggggcacctgtatggaacaaagcctgggttccctggggttatgggttgttgaacctgcttgaaggctgatcccatcccctggatctatgccacaagattgcttcccgccagatggcatgtggaggtgggaggcacatggaggccaaagcaggcgcacctggttcgggtgtaggggtaggcattccaagactcctccaccacccgcagggctgccttgggcaggatggagcggaaccagctgggaatgtgcatgcccacatgatacaccttgtgtgtgtactgcccagagccgcctgggccatctgtgtacggccggttctccaggatctccacgccgctgccttcgccatatgtctcgttacggctcttcttctgtggggacaaaagcacctgcaatgtgtgtggggccagagcactcttcaggagggaaggggcacaggagactgggcccaggggtgtggaaagggaggaggggctttggtcaacgaggctggctcctcctgtgtcacttccaggcccccaaatctatatgccagggcttgtgcaagaggctgaaggggccacagactccctctcccagacctagtgctgcacacacaagtcctatattctgactcccacctgtcccaggactaaaagcgttcccaagatcaggaacaagacaaggatgcccacttatttgcttttcctcaatattgtgctataagttctagctaaagcaattagacaagaaaaggaaataataagaggcaactgggcacattgggtcacgcctataatcccagcacttcaggaggctgaggtgggcagatcacttgaggtcaggagtttgagaccagcctgggcaacatggtgaaaccttgtctctactaaaaatagaaaaattagccaggcatgtggcacatgcctgtagccccaggtactcaaaggctgaaacaggagaatcgcttgaacccgggaggcagaggttgcagtgagctgagatcacgcctctgcactccagccttggtgacaaagtgagactctgtctcaaaaaacaaacaaaacaaaacaaaacaaacaaaaagaataagaggcatccaaattggaaagatagaagtaaaactatttcgatttcctgatgccataatcttatatatggaaaatgctaaacaatctccaccaaagcctgttagacctaataaataaattcaacaaagttgcagaatacaaaatgacacatagaaatgaacaatgtcaaagaaaattaagaaacaattccatttataatagcctctgaaagaataaatacctaggaatatatttaaccaaagaggtgaaagacctgtgcacttaaaactacaaaatgttgctgaaagaaattaaagttctaaataaatggaaagacatcccgtgttgatggattggaagatttaatattgttaagatggcgacactgccccaaacaacctacagatataatgcgatctttatcaaaatcccagcagctttatttgtagaaatggaacagctgatcctaaaattcatatggaattacaggagacccggaagagccaaaacaatcttgaaaacaaaacaaaaccaagctggaggactcacacttccctatatcaaaccttactacaaaactacagtaatcaaaaaagtgtagcactggataggatagacaaatagatcaacagacagacagacagaatataattgagagtctagaaataaaccatatatctatgatcaattaatttttgagaagggtgccaagaccatccaatgtggaaataatagtctttaaaaaatggtgctgggacaattgaataacaacatgtaaaagaatgaagctggaccctatctcacagcagatacaaaaactcgaaatgaatccaagatttacaaataagaactaaaactataaaactataagatgcttgagaaatggtagtttaaaaaaagaaataaaatcacaaaatgataaaacagaagaaaactggggcaaacaaggtcatctttatgaccttggatttggcaatgctttcttaaatatgacaccaaaagcacaagcaacaaaagaaaaaatagatgaactggacttaactgaaattaaaaaccttagtgtatcaaagagcactatgaagagagaaaaagacaacccaccaaatgggagaagacatttgcataccatgtatctgataagggacttgtatccagaatatataaagaactcctaaactcaacaacaaaacaacacaattcaaacatgagcaaaggacttgaatagccatttctccaaagaagatatacgaatggccaataagcaatgaaaagatgttcaacatcactattcattaggaaagtgcaaatcaaaaccacaatgagggccaagtgtggtggcttatgcctgtaatcccagccatttgggaggccgaggcaggcagatcacttgaggccaggagttagagaccagcctggccaacatggtaaaactccgtctctactgaaaatacaaaaagtagctgggcgtggtggcacactcctgtaatcccagctactcgggaggctgaggtaggagaattgcttgaacccaggaggcagaggttgcagtgagccaagatcgcgccactgcagtccagcctgggtgacagagcaagattctgtctttttttttttgatatgaaatctcgctctgtcaccaggctggagtgcagtggcatgatcttggctcactgcaatctccgcctcctgggttcaagtggttctcctgcctcagcctcccaaatagctgggactataggtgcccaccaccacatccagctaattttttgtatttttagtagagatggggttttaccatgttggccaggatggtcttgatctcttgacctcatgatccgctcgcctcggcctaagactccgtctcaaaaacaaacaaaaaaacaaaaaacacaatgagatagcacctcacacccattaaggtggttagtattcaaaaaaacctagaaaaaagaatcaatgctggttggcatgtggagaaactggaaccctattggtgggaatataaaatggtgggaatgtaaaactgttgaaaatagtttagtaggccaggtgcggtggctcacgcctgtaagcctagcactttgggaggctgaggtggctggatcatgaagtcaggagtttgagaccagcctggccagcatggtgaaaccctgtctctactaaaaaaatacaaaaattagccgggcatggtggtgtgtgcctgtagtcccagctactcaggaggctgaggcagtagaatcgcttgaacctgggaggcggaggttgcaataagccgagattgtgccactgcactccagcctgggcgacagagtgagactccatctcaaaaaaaaaaaaagaaaaaaaaagaaaagataatagtttagcagggcaggcatggtggctcactcctgtaatcccagcactttgggaggctgaggcaggtggatcacttgaagtcgggagttcgacaccagtctggccaacatggtgaaacaccgtctctactaaaaaaatacaaaaattagtcgtgtgtggtggcgcatgcctgtaatcccagctatttgggaggctgaggcaggagattgcttgaacccaggaggcagaggtcacagtgagccgagattgtgccactgcactctagcctgggtgacagtgagactccatctcaaaaaaaaaaaaaaaagtttagcactttctcaaaaagttaaacatagcattaccatatgaccagcaattccacttctgggtatgcacccaaaataactgaaaacagagacttgaacagatacttgtacaccaagccttcagatgactccagccctaccagctgctgccatgtattcacagaaaaacctgtacaccaatgttcattgcagtattattcacactagtcaaaagctgtaaacaactcaagtgtccatcaacagatgaatgaataaaatgtggtctatccatacaataatagaatattattcagtcacaaagaggaatgaagtaatgctacataccacaacatggatgaaccttgaaaagattctattaagtgaaacaagccagacacaaaggaccacatatcctgtgattccatttacatggaaagtacagaaaaggaaaatatatagagacagaaagtgaattagtggtggcctgctgctggggaacatgggggaaatgaagagtgatgctaatgggcgcagggccctccctccctccatccatcccttcctccctccctcctttcctttccttcattttcttttctttcttccctttctctcacttttccttccttccttccttccttccttccttccttccttccttccttccttcctccctccctccctccctcttttctctctctctctctctctctttctctttctctctttcctcttgctttgtcacccaggctggagggcactggcatgatcacagcttgttgtaacctctaactcttgggctctagtgatcctctcacctcaaccacctgagtagctgagactacaggaccattccaccacatctggttaattttttaaaataatttaataatttaataatttttaatttcttttcttttttcttttctttttttttttttttttttgagacagagtctcattctgtcacacaggttggagtgcagtggcacgatctaggctcattgcaaccttcgcctcccaggttcaaccgattctcctgcctcagcttcccaagcagctgggattacaggtgtgcaccaccatgcctgactaatttttgtattattagtaaagacagcgttttgccatgttggccaggagtttggggtctcaaactcctgaccccaagtgatccgcctgcctcggcctcccaaagttctgggattacaggcatgagccactacgcccagacatgctcaactaattaaaaaattttcttttgtagagaatggagtctcactatgttgcccaggcttgtctcaaactcttggcctcaagtaattctcctgtctcaaccacccagagctttggcattacaggctggtacaggttcctttttctttttcttttcttttctttttttcctttcctttcctttttttttttttttttttgagacagagtctcactctgtctcccaggctggagtgcagtggcgagatctcagctcactgcaacctctgcctcccaggctcaagtgattctcctgcctcagctgaccaagtagctgggattacaggcgtgtgccaccaagcttggctaatttttatattattagtagagaaagagttttgccatgttggccaggctgatctcaaactcttgaccccaagtgatccacctgcctcggcctcccaaagtgctgggattacaggaatgagccaccgtgcctggctggtacaagtttcttttgaggtgatgaaagtgctctggaattaggtagtggtgatggttgcacaactctgtgaatataccgagaacctttgaactgtacactttaagtgggtgaattatatggtgtatgaattatagctcaagtagctgtcaagttatttcaaaatcccgtgggtcaagggggcctgaggggtttgctgaagaatgttctgttgcttggcctggtgctggttacacaggcatattcactttttgcaagaccatcagggtagacacttatgaatcataaacttttctgtatatatacaacacttgaataaaaagtgaaaaagaattaggaatgaaactgggaaagaaaagtctgcaggctgctcagagcaccccacctttagaacaccaggccgatgagggccctgccactcagccatctccctgacacagctccagcacaccactatgagctgactcttgccaggcagcagggtctctgagaatgagcaagcgctcctctctccctccaggaaagccgcaagccccatcagccaaatagttaaagctgaaataaccccaaatagcaaaatcccccacccagtggagggcctgtgcagccctcacccagaggagttcacagaaagtagaagaaagagatgtcattgtccaggctggtctgctttgggaagaatcatccctgctccagacttggagtacgtggaagacctaccccaaagagaacaactatcatgtgattagaagacatgaggggaggccttcactcagcctcaggggggtcagggaaagtgacctgcaggggagctgggaggtggggaggcactcaccaggcaggggtggacaggacagatatgctgggtagggaggcaggtgacagagctgaaggtctgtgtctagagggagccctggaagcgtgtggactcagttgcctgggtgtagcctgcgaggcaggaagtggcagggaagggcctgggagctaggcagaagccatatcacaaaagtttttttatttttttatttttgtttgtttatttgttttgagacagatgagacagagtctggctctgtcacccaggctggagtgctatggcatgatctcggctcactgcaacctccgcctcccaggttcaagtgattctcccacctcagcctcccgaatagctgggattatagtcacgcgccaccacacccagctaatttttgtatttttagtagagatggggtttcaccatgttgaccaggctggtctcacactcctgacctcaagtgatctgcccgcctccgcctcccaaagtgctgggattacaggagtgagccactgtgcccggccataaaaggagcacagttttgatgctaagggaaggaaagggtttaagcaggagaggagcacaatctaatctgggtcccaggaagaacgtcctggtacatgtatagagaatgggagatcccctggcatgggcagctgcccacaggggtgttctttcctgggtttagataggaggtgaggcccccagctccgggagcagcaggagatgcctctgtgctcagcaggtaggccaggtacttagcggctttatgaacatgaaatcttggtagctgagggcaaaggagagaagggagaggccgggctgcagttgaaagtggtcagtgggcgaggcacagtggttcatgcctgtaatcccagcactttgggaggctgaggcaggcagatcacctgaggtcaggagttcgagactagcctggccaacatggcaaaaccctgtctctactaaaaacaataataaaaaaaaatagccaggcgtggtggtgggtgccactaatcccagctacttggaaggctgaggcaggagaatctttgaacctaggaggcagaggttgcagtgagctgagatcatgccattgcactacagcctaggcgacaagagcgaaattccatctcaaaaaaaaaaaaaaaaaaaaaaaaaagaaagtgattagtgagcccaggtacacttggtacactacagaccagtgactcagccttttcctgcccaccatggtgggatagaggccccatgcccctgcgcagccacccaccctgcccatgggctgagatctgctccttaccctgtgcccaaacatgtcctgtgctcaaactgggtagaggccacaaggtccaggcaaaagggagccacatctttaccatgtgggccacaggggccccagccctgtttactgaggacccacctgctgagaatttcagtttatttatttatttatgagatagggtctcaatctgtcccccaggctgaagtacaatggcatgatcatggctcactgcagccttgaccccccaagctcaagcaatccttctgcctcagactctagagtagctgggactacaggcgtgcaccccaccacacccagctagttttttatttttttgtagagtgccttggtctctcaaaatgctgggattacaggagtaagcctctgtgctcagcctgggaatcacagtttctaaatcaagccccactgcggtgtcaggtgaagaccattccccttgaacagcaagctgcccttccctgaggatgtggggcatggagtttaccttcagctatcagggtccaagaggggctccctctcagggaggtggcagaacatgcgggcttagagcatagtttctgtggttcaaatgtctgggtacaaaccctcctctttttctttctttctgtgtggtctctgataagttaacctctatatgtcatcatctccccatctgtaagaggaggagaagcaatagtactggctaggttgttgagaaaattagatgcgagcatgtgtagctgacgtacacaggatgagctcaggttgtgtgcacactcagcagcagggaacatcatcccaggatgccacgccctggctttatcccagcaaggagagtggcaggggaatcgccatggctccaaagccagatgtctccatggcttcaaagttcccctgaaggatggagtgaagagccaggcctggaaaacccttcatttccggtgctcagaggctcccggtacagccaagaggtgcggggaagggcggtgaggaggggccaggcagcacggctctccgctcagcctttttctggtcctggatcagccattgatgtcagcacttgggctaaaaggacagggcagaggagtgcagctgggtctcagctgtgcctctgatcaggatgcggctgcggaggaaggcccttttcatagctataggcaccaagaccgctcggaagacccacagagcatcagacaccagcgctcctcgtgcacactagggctgagactcagatagcggccacaactgctcaactgtcattatcaggagccaatgcaggcagggagagagggcttcctggaaaaagaggctaccaagggaggcaaagagcatgaatgagagccccaagcaggagatctcctgaccctgtctcagtttacaacttgcctttgcacccacctgttctctgcacttcagagccctgagatgttgtgggatcatgctccccactccacaagtaagaaactgaggcacagagtactggagccaagtctcccaggccatgagtgactgtggtagtgcagagacagagaagcagccacagattgcattaaactgcagaaacctgcatgtgcatcagaacccccaacccctacctaataggcaccaggcatggtgggtagctggtctggcaggaattgaggggaaggggaggtctgttcctgaaggaggggcaccggccagatgccacatctacactcagggatctgatgtgccctgcctcttcccccagggccctccacccaaacctccctccccagagccccgctgggaccaagcaaggcgggctgtgctctgcttgttctcccagctccctgccacaggggcatgactctgtctcctggctgggccagcagcttctcctgcccattagccctgacatggaatttattgcacagctgaatgaggtaggcagttcgaagcacaggctgggctggggccagctcactggagggaggggacagctaggagtggcccttgctgccaaagagcctgaccccagggtagaaatgtgtctcctggacttggtgtatggcgcagggaactgagggctgtgctccctgtgaggggctcactgaagctgccactcagaatgtcagtgcgcaggcgtgcatgcgtgcacacacatgtggcgtgtgtgtgcatgcaggagccaaggcccatggattcagggctcttctgggtggagcagaaggtgcacgtgaccagagccatctctagagaaggcaaaaaatggaaccaggaggacacttacaaagacatcctcaagatgacctacttgtggtatacatggggaaactgagggccagggactggaagcaacatgtttgggccacaagctggagggttagaggtagctggcgaggcagaagggattctggtgggactcctgggcaatgcacaagtccacagactccccagaggacgccaccttctcactggctgctgccaacagctcattaaaaacacgttctcctaaatgtaagggctcaaactataaaactcttaagagaaaacataggcataagtcctatgaacttgaactggcaatcgttttggagccatgacaccaaaagcacaagcaacaaaagaaaagacagataaactggacctcatcaaaattaacaacttttatgcttcaaaggacactaaaaagaaagtgaaaaaacaacgtacaaaatgggagagaatttttatatacaatatatcttatagtaacttatatccaaaatatatacagaactcctccaatgcaacaacagagaaacaacaaccccattcaaaaactggcaaaggagctgggcatggtgctgtacacctgtagacctagctactccagaggtgaagttggcaggatggctggagcccaggagttcaaggtcagcctgagcgacatagcaagaccccatctctaaaaaaatagtaagaataataaaggcaaagaacttgaacagacatttctacaaaaagattatacaaatggtcaacgagcaaatgaaaagatgctcaacatcatttgtcattagggaaatgcaaatcaaaaccataatgagataccacttcacactcactggggcggttaaaaagacacacagcagcaagtgttgttcagggtgtggagcaatggaaccctcgtacattgatggtgggaacgtaaaatggtgcagctgctgtggcaaacagtttggcggttcctcaaaaagttaaacatagagttaccatatgacccagcaattccactctaggtaaatatccaagaaaaggaaaacatatgtccacataaaaacttatacatgaatatttatggcagcattattcactgtagccaaaaagtggaaacaacccaaatgtccaccaacagatgaatggggaaacaaactgtggtctaccatggaatggaatattatttggccataaaaagtaacggagcactggcacatgatacaagagggatgaaccctggaaatattatgctgagtgaaagaagccagacacaaaaggacacatattgtatgattccatttatataaaatacccagaatagtggaatctatagagacagaaagcacattattggttgcctggggctggggtgaaaatagtgatttcttttttggggtaatagaaatgttctaaaattgattctggtgacggttgtacaactctgaataggctaaaaaccaccgaactgtgcactttaaatggatgagtcatgtggtgtgtgacttatatctcaataaagctgttataaaacaaaacaaacagaaaccaatcctgccttttgtactaagatcaaaaaaatcaaatgtggcaagcaggaaggggcctcgctggcactgtgagagagacatgggtcacctctaagcatctctctgccatgaatgtccctccccgtgtccaaaagctcagttttctgcttatgcaggaaacctcatgtttgaggcagtggcgactttaagccgagcatctgtttccatggtgacatgatgggctagccaagggcatcctcggtcagcttcctgaacagcaggtgtgtatgtgtgcgtgcatacacctaggcacacagatgcacatgcatacacagccacaggcctctctaaggcacaaaaaatgtgctatatctccatggcccagagcgattgagtccccttccaaaacaaaaaacagacaagactctgggtgaggccataggtgaggtcagggcaggcatgtgtcatctctccctctttaaaagagctcctggaatgtggaccagatttttttttttttttttttgagacaaagtttcgctcttcttgcccaggctggggtgcaatggtgtgatcttggctcaccgcatcctctgcctcccgggttcaagcgattccctgcctcagcctcctgagtagctgggattacaggcatgagccaccacacctggctaattttgtatttttactagagatggggtttcaccatgtccatcaggctggtctcgaactcccaacctcaggtgatctgcctgcctcggcctcccaaagtgctgggattacaggtgtgagccaccgcactcggcctatgtggaccagatttgtagtgaaaacagcaagctcttcctggatgctctaagctcccacctcttccagtagcatcatttatttgtggctatgctaagtgctttgcatgtacattctcctttagttactgcaacatccccttaggaaaggtgtattagcactattacccccaagtcacagatgagacgatcgaggctatgagaggcacaaacttgtccaaggtcacacagttactaaatggcagagccaggccttgaattcagacctgtgtcattccagagcctgctcagcccaaagcaccaaggtggctcaaggaaaagacctcagcataagataggtgctccgtaaattcttattgaacaaataaatgaattctagtcccaactctgtgaccagctccctctcctcctggacaagtcacttctctttggtgtcaatttccaaactctaagtggagacaggactacctatctgtccatgccctggcgtaatgggtggaatgtccccaccaggcccttggaatgtgaccttatttggaaatagggtctttgccgatgtaaatggagtgacgtggccacaaactaaggtatgcttggagccaccagaagctggaagagacaaggaagggtctacccgtagaacctttggaggaagtgcagccctgcggacacctgcctctctggtttctggcctccagaactgtgaaagaataaatgtctattgtttcaagctatgcagtttgtggttctttgttatggcagcgccaggaaataagatacctgggatgctggcaggctcagtgagaaggtgtgtaagacagggggtccagagctgcctgcaggagtttctttgggcagaggcctggtgacccacctgccagcagctgagggtggagccaggacaggggccaggagggtcccttccaccttggccttgctgggtggctgcgcagaagcccctgcccactcaggcagacttcacgccttttccaggacagcaggctcacccagtagcatcctgtgcggtctagggaggatgcctcctgcctcttccagctgctgctggctcccagtgctccttggcccatgctgtatctctccaatctctgcttcatctttcctgtgtcttggtcctttccttttcttatagggacactagtcattcattcagggacctctctaaatccagaatgatctcatttcaagatccttaacaaattacaccttcagaggccctatttcaaaataaggccacattctgagactgcaggtggatgcagattctgggggggacactggtcaccagtggggtgagtgcccacaatggcctcctgtgagtgagcttcagcctgcctgctggagaaacaagcacactacactgatggccccccacctgtccctcatctctcggtggggcaggtggagtcctcaccacctcccacccagcccttggccacatacatcttcagtcaccagcactttccccagtgtatggtgactcttcatgctgactccagtacccctggccttgccacccataggtgaccctgtgctatgtgtagctctgagtatctgagcactggaaggcagagctgtgaaagggagagcactggcttcagagtcagacagggtggagagcatgtaacctccaacagctggaacttcagagaaggggtgaactaggagacctcaaagtgctccactaaaagcaatgtgaaaaaggcagcccaccacatctctgggcagactggtatcattaggccagctatgcacccttgggcaagttccttgatatctctgagcctcgagctgtcatctggggatggggatgaatggggatgagtaccaccaactgtgcaggttatcgtgaggattaaagcaggttctgatcatttgctggacactgattcagtcggctgtggaggggtgtgagggctgcagtcagtggcagagccactgggagccagacgggaccccctgtatagcactttggtgtttcctgaaatagatgctaggtaaagattggtcaaatgaagaatggattctagttccaactgtcaccaggaacttcaaagctggcatcaccaagggcagccagtcctccccaagctgacctctggctccccaccagtgatggcgtccaaggggggcaggcccctcctggcacagctactcagtcatgccacttaggagcaagctcttctcgaatcactctgatctctgccacatgagcagccaccccctcgtccctgcctaccattcccctaaacagtgctgcggtactgttttcagagacagcggcagttggacagcagagacaggcctggctccccaggggctaacgaaggagttgggggaggatgcaaagaaagatcaagaccaagaaacccctgaaagcagccgctcccagggtcctggccaggccacctccggccactccctcggcggcacacattcgctgaacacctcggacggatggccctctcccagccaggcagacgattttgttttctcacctttaacacggtgtatattgagtgctgctccagcagggtgccaggtactttgacgcgcgagcccagcccatctttttcacaaccttccagcggggcagcttgcagagaggaaggcctattcctagctgccactggctggcaagtggcagaagtgggaaatgatgaactaaggtcttcttattattctttccacaaaaacacagcagtcttcttgaaggcctatccatcttgggaggccagtgcagactgtgcccttgagcctgtgctgaaacgtatgtgaaatctatcttcccagagaacgggaaggactttcatccccctctgcaactcagcccttggcacaggaagtgcacaggaaagtcaggtgactttaacttactttttagcaatgttactgaggtatgactgacatacaataagctgtacacatgtaaaggagcagctggtgattctgacgtacgttcacacttttgagtccatcaccccacagtgacaagaaccccaggaaccgcaggttagaaaaaggctagagcgggcacagacgggcaggtggggctgggaagaatgagtgccctcaggacccagagggtcagaggaagctgcctggaagaggggcattcacaccagccctgcaggaggggcaagagctctcaagatggaaattgggctgacagtaggggtcttggtgacaggaagggcacaggtagtgccttgggtctccaagtcggggtggcctgaacctctcccctcctgcccacctgctctgccctcaggcctgggagccacagcacaggctggggttgagaggggagatccctcccaatgctgcctcctccccaatctagacactggcacctcctggtcctctccgcctgccagggtgccctcacctctgagattggcagcagcctcccttggcctactaggggtcccaaagaggccacctaggagcccggagatctgagctccaaccctggccctgtggacctcaatttccccatatgtaaaatgggaaactatgctctctgagagcctagcttaggttacagataaagaaactggctgtgcatggtggctcatgcctgtaatcccagcactttgggagactgtgggtggatcacctgaggtcaggagttcaagaccagcctggccaacatggcgaaagcccatctctactaaaaatacaaaaattagccaggcatggaggcgggcacctgtaatcccagctactggggagactgaggcagaggaatcgcttaaacccgagaggcaaaggttgcagtgagctgagattacaccactgcacttcagcctggggaacagagtgagacttcatctcaaaaaaacagaaaaagcaaccaagaggagcactacccccttgggtcttgtggtgtatgtgtgtgtgtgtgtgtgtctgtggagatgcatgtacacatgtgcacatatgtgtgcatgttgtgtgtgcatgcatgtgtctgtataggtctgtgcatgtgtctgcatgtatttgtgtacatacctgtatgcataggtggctgtgcttgcatgtacatatgttgtgtgtggacacacatatgtgtctgtgtgtgtgtgtgtgtgtgtgtgtgtgtgcactagagccatgggtgagggagggaggagcagcccatgtgcactaaagaggatatgagccagaaactgggaaaacagacccacagacctaaaccctgccctgagacactcactgtccagcaggaagcagacagacacccacaaagaggtggaaggcactaggtgcccaggtgtgggactgacaggaaactgcgaggattcagggaaagaaatcactcatgctgcccatggagatcagaaaagcctccgagaaggacacagcatgctggctggtctgaaagatgggcagaaggacccttgagataacctggggactcttctgtttcaaaacatactcactagggtagcatttatttaaaaagaggacagtaagtgctggtgaggatgtggagaaactggaaacttcatacattcccagtaggaatgtaaaatggtgcagccactgtggaaaacagtctggtggttcctgcagacatcaagcatagcgtcaccatgtgacccagaaattcccttcctaggtgtagacccggaagaattgaaaatagatacttgtaggccgggcgcggtggctcacgcctgtaatcccagcactttgggaagctgaggcgggcggatcacgaggtcaggagctcgagaccatcctggctaacatggtgaaaccccgtctctactaaaaatacaaaaaattagccaggggtggtggcacgcgcctgtagacccagctactcgggaggctgaggcaggagaatggcgtgaacccgggaggcggagcttgcagtgagctgagatgacgccactgcactccaccctgggcgacagagcgagactccatctcaaaaaaaaaaaaaagaaaacagatatttgtatgctaatgtcaacccaaatgtccatcaatggatgaatggataagcaaaatgtggtctgttcatacagtggaatatgattcagccataaaacgtaatgaggcactgacacatgctatgacatggatgaatcccaacaacatgacactgagtgaaagaagccagacacaaagagcaacactgtgagtgatgccatgcacatgaaatgtccagaacaggcaaacccagggagacaggtagtacattagtgattgtcagggggtggggagggggagtgaggagtgactgtttaatggatatggggtttctttctggggtgatgaaagtgttttggaactaaagttggtggttgcacaacattgtgagtatactaaatgccactgaattgttcacttaaaaatggttgttaatgttttgtgaatttcacctcaataaaagcaaaacaagacaacaaccaatcaagtaagcccaaagcccctagtcccaaaagaatttcttccaaatgctatagagacctgatagcctgagccccgtccatgcagacagtaggcaggccagcgttttgcccctcagagggcacacgacctatgggcctggcaatatcttggagctcattttgttggagctcggactgggggctgtggaggccagaacccagcgatgcatccgcctgtctaagacccagctggggcagggctggccagcaggggccttaagtgcatgggaaacttcccagtcagtagctctagcaggaacctatggcttcctggtaactacatgagggctgaagcacctcaaacacagcaattagtcctcaggccggagacagcacacaccaagaacacagaggacacaggtgcagggcactagcacctgtgatgtgcagcagaccccctgcccatcaccaagctgtctatccgacacccccagcctcaaggcctgcccagaggagagctgcccagccagccagcctgagcaggaacaccaacagccttgcccccaatctcccctccaagcatgctagtgcctgtcacagaagcacctctcccggcaatacctggtttctttcacctttcttttttaacaggaaagcagacgtgtgcacacatgcttgctcacccagaaggtgcacagggaaaggctctggaagctcagaggagcagcaatgactccagctagcccttagaggccacagtgtctctgcctagctggggaggatgcccatctgtccaacaagctctcacgaagggccctgagagtgctgatgctcacgatctgcaaggcgggagatgtttccatcctgccacaatcctaatcaatggagcttctcaaaagacactgcatgtgtcggctagatggacggggcctggctgcacagctgcaggaaggtctgagcgtctaacagggaactatatgatgcttaacagttacattcattcgaggcataaggataggtgttcaaaaaaaccctgaagtggctgggcatcgtggctcacgcctgtaatcccagcactttgggaggccaaggtgagtggatcacaaggtcaggagactgagactgtcctggccaacatggtgaaaccctgtctctactaaaaatacgaaaattagttgggtgtggtggcgcgtgcctgtaatcccagctactccggaggctgaggcatgagaatcgcttgaacccaggaggtggaggttgcagtgagccgagatcacgatgctgcactccagcctggcgacagagcaagactccatctcaaaaacaaacaaacaaacaaacaaacaaacaaaaacctggagtgacaggtgttttgaggagcccagaggtgattctatgctccagaacagctttgggatctcctgggggctggaggtcagtcctcccgatcttgacagccaccgggaggccaggtggagctgaggggctcctgtggtctgggttcaccctggcttgggtgggaattgagaagcagtaagacaacagcagcactggcagatcagcctggtccttgaacacgctgagctatttccagagtgctcagagatggggggctgatttaagctgcttcctctctctccactctctagaaataattatcgggtaagtggttcaagagggaattgagtggtccttctgaagcagctcagagcaaacagccccccggagaggctgggttcaccttccgttcttttcccagccaaggctcccacataggggagcctggacaaacccttgcagcttcctcaagctcctcccagaaggcagctggggctgcaggctctgctgcgagctcacagctacctcccctgacctgggtggaaggtgggagcccaataggcgaagccagtgatgggaggtggaggccctgctgaagcctttcccccacaccaacgactcagtctgatgctgtaattaaggggttgtacagcaagaagctggaggagggcaagccccactgggtcacagggactggaggcactgatatgcccagaggagccagagccaggctgacagcaggttcataatcagtgtgggaagcccgaagaccctcagcctggagggaagctgccgggctaggccatgccaggcactgagggtggacagaaggccagcaggagagctgggatggaacctctacatagaaaggactgcagccaggactgcagcaagtgggagcagtggtcccatctggggtcagccagaggcagccaggtcttgtgttccaggttgatcaggcactgagtagggagactggaggtgtctcctaagcaagagtctctggctcgtcaaaggagcctgtcatcctcaaactcctgtgtgcgtctgtaagtgagccacatgtctgacactgcttttttgcaagcagtcagggtggtgaggaaagcatggagctgggagctaggagacaggccctgtgctccttggcaaggcatttaacatctctgggcctcatacgccttcctgtctgtagaatggggtgttatggactgaatgtctctgtccccctaaaaggcctgacccccagtgtgatggtatttggagatggggcctttgggtggtaatcagggctagatgagatcatatgggtggggccctcacaatgggactggtgtccttagaagataaggaagggtggaagatgagggattacttaatgagtacagggtatttgagtgatagataccctacaagcaccattttccaatctgtgcatgcaacaaaattacagttgtatcctatacatttacacaaataaaaaacagaggagaaaaagaaaaagagaagacaccagagcctgctcactctctgccatgttaggaaacagggagaaggcgcccatgtgcaagccaggaagagggccctcaccagaaaccgcacttgccaggccttgatctgggacttccggcccccagaactgtgaggaagtgtgttcctctacgcccccagtttgtggtatttactgatggcagcccaggcaaactgaaacataggaaaacatagggataacgtctgggccagggagataatggtgctgaacgcaagggcaagtgttcgcgttgtaggcggcgggacacagtgccggaaagcaatctgatgccgtgcgcccatggtgtgctctgtgcgcctggcatcgtgcctagaggccaggggtccagcacaattcacacttaccaggaagttctggggcaggcactgcactgtgaaggccacaactccacctaacccacatgtggtgtctgtgcgctggcgcgacccaccctcaccccatgacccacccttgccccacgacccacctgtatcatgtacagctgggcgatgcggtactcctccacggtcattggcagaggaatccgatattcctttataatcatcttggagtccaagccttcccgtcgatggggaactgcaagttgggacttctaggcaaggttccttaaataaccatgacaaaattcaccaaggacccctgggagacagagaggacagaacagaacagtcactttctgcaaaggctggtgaataccatagcacagaggaaaggcccggtctacacctgaggctggaattgtggcctctgatcaggcatgatccaacggtgcaactttgagcaggttctctcctttccaacctttatttttcttgtttgctaacagctaccaaaaggacaagtgagaggctatgtgtaagctctctgatcaacaaacagccacggggaagtaaagaattgtcactccataaacaagggccagggtaagaacaccgtgctcttgttttactcacaatcctaacaaggtacagcatctatttccccggtactgacacagtgagtaatgatagctggtcatggaaaagcaggcagatcaaataaaactaagcagcacagacatgagacattcacaagtcagcagtctgagccatgccattaggggcagatgacatcactacatcccaagggggagactctgagtgatttaacgtttggtttcagttcaatccaataagaaacatttattggcatctattttattccttccattgggctatgtctgggaagtagatgagacaagataagcagagagtgtgctcatagccacctctatttaagtgacaaagaatatatttgatgaagatttgtccctaagcaatcacatttttttttaactgggccgggcacagtggctcacacttgtaatcccagcactttgggaggccaaggtaggcagatcacttgaggttcggcgttcaagaccagactggccaacatggtgaaaccccgtctctactaaaaacacaaaaattagccgcaggtggtggcaggagcctgtggtcccaactacttgggaggctgaggcaggagaatcgcttgaacccaggaggcggaggttgcagtgagctgagatcgcgccattgcactccagcctgggggacaagagtgaaactccgtctcaaaaaaaaaaacaaaaacttggtgcttggaagaggcgcatactcagttatccggaaaatgaaatcaccccttaaaacccaagccccagatggctgaagctttgccataaatatcatttggtcacctccaaaggtcacatgctgttaacatgaagccaagtgaaggttttcaggatggatgataaataaattttacatttatttattgtttagagacaaggtctcactctgcacccaggctagagtgcagtggtgcaatcccagctcactgcagccttgatctcctgggctcaagctatccttctgcctcagcctccagagtagctgggactacagatgcacgccacccacacccggctaacggtagtattttagcaagactactccaaggacagcagccagggaggattcacagtgaccatgggcaggactcctgctaagtgataaaagcaagggcctggccagtcaggcaacttccccagggcacggctctctatcgggcattggagtatcacccaggtgctaaagcattactgggtagctaacaaggttgagaaaaacatttatcagaactctcaggaataccagtagacagggttaaaagaagttcttaaataagccacttagggagaaagacagagagaggaaaggtctgataaaggggctccatcccttgtgctagcctaaaacagcggctcccagttgtttagttcacagcaggtaggaacgtcagcccgaagcccattcaaattctcacatccatcctggcattatgggatgccaaggcaggtggactgcttgaggtcaagcaagctcaagaccagcctgggaaacatagcaagaccctcctctctattaaaaaagaacccaattctcacatccagttgctttaaatatagtccaagtgaagctcttttttagccgattagagcctagatactttatataccccagaaactgcacccaacatctgctggctgtagataagataaccctggatcccagaccccaactgccccttggaggtctctgacccagactccccatggtgctgctgagcagcatcacctggacacagaaatcccctctagctcccctctctctgggaagtttccttgccctgttcccctccttggggtggccccaggccctgctatatccataaggactcttgctaggaggggcttcccctctcctgcgacctgtccaccagcctttctgatccctgatcaaccccaaagctccccagaggctgtgctcaagtgaaaaaagaccattgctgaccttcttcaaggtcaatgggtctagctaacagcccatgggacctgcaagtttagggcctgaggccctgtggagttcttccccatactcccagactcagctccgcctaggcccacatgtctattctcacacctggctggaagctgaggacacaggagagagaagcaatggccctacagtccccaggctgcaccttatcctgtgaggtgtgaaacaagagctggctgggccgaagtagcaagggacccaagtctgacacctggatggacttccagctggctgggagggtagcacaggcacctgatctgagaaacttacatacataaaggagagagagctttatgtttgagggaagttggaggaaattagggttggagacgggaagggaaaattgaagttcaatgggggttgtttctgaagcttcttcacgtggttcttcattgaagccccagcatcgcccaactaggaaggcacagcaggtgcttggtgtgaagcagtacacctgtgtgacgtgcagcacccactccgcctctgtggggcctcaggtgggctcctttactgtggggcaaatgcagtgacccagagtgggcaagtctcatttagtcatctaaataacatggtcagacacagactctaaatgttcttcagaaaccttacgagtctaagcattctgccctttgggagtcttaacccctccagcgtacatgacctgccctgctcatccccatgcaaatcagtcctttctcaatcctctcagattccaggctcaccaggcactagcaaggtaggaccccctgagccagattcataatgttccttaaatgtctccatcacctcaaataacaaccaggggtgaaatctcgcagcctgagccagcacccagacactggcttgggtctctgatttcaaaggctctgtgagcacatgtctggaacagatacctaatgatgttcccccacggacaagctgtcaggtgagctgttaattgcacaggtgctgtccacagctccgctgggatatttttgcgtgcaggcagagggacagagacagagagggaacacacacctggagggcccagaggccccttggaggctcctggcacctgggtggagtggggcaaagcttaggaccgtgcaagggcagcagccacatggtggaagagcatcagaaagtgcaagtgctcaggatgcaattccatcaaggctggcttagggaaaagcaaccgtgtttctgcccacaaggaactaaagagctgtagaggtaagtaagtaggtacatacatggataggaagaaggaaaaaacaaataaatcgttctatatcttacagttaaatgcacgggtgactaataggagagaggactcagaactctaagagtgacacagaatgtgacgggaggtgacagtttggagctcactctgggatctgactgcaaagcctcacaatgcctttaccagctgtgtgacctcctggaaaagcccctgtatctgctgagcctcggtctctccatatataaaatggggataatactatctgacttctggagttaccatgagtgtcatgaaaacaagataagttgctcagtccagaggggtctcaggaaaggcttcatggaaggcggagccaggctctctgagatccatgggattctgctcggcagagctgagggcgggtgtgagaagtactcaatccagtaagaaggaacagcgtgagcaaaggccccagggcaggaacgtggggctccattgagtggcttcccaccatgtgcccctggcatggccaggctgcatcttggggagatgaggtggggctctctgaagcatgagtttaggggcttagacatccttaaagtcatctaaaaaataattacctggccgggcacggtggctcacacctataatcctagcactttgggaaaccaaggcaggaggattacctgagcccaggagttcaagaccagcctgggcaatacagtgagatactgtctcttcaaaaaatcatacacttaaaaaaaattagctgggcaaggcggcagacacctgtaatccagacacttggggaggctaagggcagagctgagggtaggtgtgagaaggactcaatccagtaagaaggaacagcgtgagcaaaggccccagggcaggaacatggggctccatcgagtggcctcccaccatgcacccctggcacggccgggctgcatcctggggagatgaggtgagaggatggcttgagcacaggaggtcaaggctgcagtgagccatgtttgcgctactgcactccagcctgaatcacagagcaaggccctgtctcaaaaataaataaatacataaaattcaaaaaaaaagaaaaaattatctgatgttgaaatccaactaaccaaaaagataagtcaaaatgaggtaataaatggagaaatcctgatgaacacggcattgatattttgaaatcatggcaattatgtgattgaactgactatcaaaacctcaacactgtacacaaatgataatacaactaagacaaatttggagaagaacaaaggtagaaatatcgtttcctcaacttccatagcatagaagttggttcattaagtaggtagaaaaattagtgagagatgaacaggcagagaatggaggatttttagggcagtaaaagtactctgtgggatactacaatggcggatgcatgtcctcatacatttgtccaaacccacagaaagtacaacatcaagagtgagcccttgtgtaatctacggacttagggcgatgccatgtcactgcaggctcattcattgtaacaaacagggcacattgatgtgtgatgctgagagtgggggaaggggcatatgggaactccgtacttgccactcaattttgctgtgaatctaaaacagctcttaaaaaaaataaagtttaggtggctcacgccttaatcccagtactttgggaggccaaagtaggcagatcacttgaggtcaggagtttgagaccagcctgagcaacgtggtgaaaccccatctctacaaaaaatacaaaagttagccaggtgtggtggagtgcctgtagtgccagctactcgggaggctgaggtgggaggatcccttgagcccgggaggtggaggttgcagtgagccaagatcgtgccactgcactccagcctgggcaacagagcgagaccctatctcaaaaaataaataaagtttattattaaaaaaaaattaatgactttaaccttttaaaagtttttctctcagaaaatagattagaggtcaccaggggctggggttggaggaaatgggagtagttgtttaatagttacagagtttctatttgggtgataaaaaagctttggaagtggtagtggtgatggttgctcaacattgtgaatatacttactgtgatgaaatagtacacttaaaaactgttaaaatagcaaagtttatgttatatatatacttaccacaatttaaaaaaatcaataatataccaaaaccatttaatcgtatactttaaatgagtatatgtatggtatgttattatacttcaatcaagctattttcaaaagcttttctctcacctttaaccttttaggactattatcacttacaataaagaaatctttttcctcagtttagcaactcccatttcacttgagatacatgaaaattgatacatttgtctggttaaattcaaataacattaaatttaatttttaccttaaaaactcatgtagaacatgatacttttttaaaaaaagatcatgtagaacacgatacttttttaaaaaaagatcatgtagaacatgatacttttttaaaaaaagatcacgtagaacatgatactttttttaaaaaagattaaatttaatttttactttaaaaattcatgtagaacatgatacttttttaaaaaaagattattactactctgtacatgtctgtttgtatgaagagtgtggaataaacgttgactgaatgctggagagggttccatcagatggatggaatttgtgggcaacttttacctgcactttattacctgatgtttcagaaggcagcagctgtagcatttgagtggtgtgtgtgtaaacagacagagaagggctggtagtgttgtgattaaaataaaacaatcagctagaccttctgccacctgttagctgtgacagtgggcaaattgcttaatcctttgatctttcattttgtcttctgggggtaagaaccacccctgcccagctggggtgtctgtagattaaatgaggtgatgcacatgaagtgctcagccctgttccaaccagtgttcaactagcaagagtgaacaacaaggtggcactgctgtccctagcagggtctggaaggcgggtccctgagatatagggcctgtgggcttcctggtagggctgcctacccccaggtgcagacaataaacctaggcctgaaggaggagcagccctgctgtggtgctggttggccttacagccaggcacggacctactggggtgagatagggtcctcctcactttctccctggttgagctgaggccagggagcatggcagaccctcccgtatcagagcagtgtgacttgtgtgtctgcctctccctggagcccccttggcccgaagctgaaccctcctcactcagacaatttcattacacccagtccggctgcctgggtgctagcgagacagacacacatttcatctcgtctctgccggagtcgtgacgggttagacagaattatgttttactgctgtctgcagggcatcttttggggcctggcacagacagagaaaaaaaaacacatacaggtctccagaggcccttcagggaggaaggccaggcaaggggtctgggtggtcgcccacatgcacagcccacatggctctgctccagggatgacagggacccttccctgggcttcaaatgtggcacctgggccctggccttagaaaagtcttcaggttccagaccctggcattcacgaccctagaaagaacccccagccccatgttcactgatgtctttgagtaaacacctggccagaccgtgtcagagtggggccactcagggaggccatggagcaagagaccagccgtgggcaaggcgcgaggtgcaggatgcatccagaccagggttccaggcacaggcagacgaccaagaagagctgtgagggatgtcacccaaagaatcaagggcatggcttcccaccaagacacagagcaccagctgggcctcccaggctggagcccaaagatcttcctgaacctcccagggagtagaggagaaaagtgacacagaaagagcttcagattcatgaggcaggggtggccaggctggaggcatgtgatgaagacttaaagtggattactggggtttggcccaggacgaggcgacgtggacagctcctttaagcggaggccatgagacaccctgactgggaggggaagcacgagaattgtgtttatagaacttaatctgtttttccatgattagcaggggtctgacgtcacagatggaatttagtgaggctgtgcaaagttaaggggggatggaatccatcccaacgcagttcagctgcattctggttactaagtctggaagctactccaagccaagccagcgggagccccggtttttgcagtagtgggaagcgagggagccaccggcaggtctgggggcctgggactcaggactgtgggtatccataacctccttctgcctcccttgagtccctctcctcttgctctaagagagcttccttctgctctctgcttcccaaacctactggttcccaatcaggagctgaagcaggcaatggtaaaagtacttcctctccagatgcagccagacaaggctccccaggcctcccctaaccatctatgtgtatccagggacccaaagctctggatgaatgggaggcagcacagacggataaggggctgttctttgtccagcaaccatccccttatgcctgggctggggttgcaggagtgtgtggctgctctgaaggtgtgtgttatgaggttagcactgatcagctgcctctctgtgtcctggagctgaaagcaggagaggtcacagacccacagaatcgtccaatccctgccccagagtagttccacctttatgtgttagacactgggcttccagcagagatttcttttgaagaaaggatttctgggctaagaaacaagcagaggaccctgctgcaggccaaccctccccttacaaatgaggagactaaggctcaggaagcaggcagagagctgggttgggaaccaggaccctgactcccagcttctccctccacccagccacaaactcccaggcattagaggagaaaagtgacacagaaagagcttcaggttcatgaggcaggggtggccaggctggaagggcaaggaccaaggagactttgagcaggaggacacagctcctacccccaccccccacagattccttgacacctttaagcaggacctgactccttcctctaacgctggcctgggcagtgaagagggggtcccagagagctttaaagccctgggcactgcggcagttaccccaaatcccacagaaagtcataaatctcaccattgtacacctggagtgccaagctggggcaactgccaagccactgcaggagttggtcaccagatcccacagcacagcggccacctgggggcaccgtggggcttgcagtgctctgcagctccaggagcaggagtgggatgttagagttaagttatgaggcatcgctatgtaatgcctcaacccaaacaacagacccagggaagcagtggtacagaccacagagcaggctccgagagggcgcatcctgctcaaggactgcggcaaggcaagggggccctgtttttatgactcctcctccctggctgtggctatcagcatggcaacctcagttgggtggaaacgggcacaaatgtgcatgtgaggaaataagcttgaaactcagagcctccaagatgataagcatggcatgaaggagaattatttggaactcacctcctaccctggtcctctagggaccctgctggtcacagagctactaccaccaccacactggcctccagggttggtgctcccctaatttaacactgagtatggctgaaataagactgggcccttaaacaaaatgccacgggaggcttagatgtgacaacagaaacaagcccagaggggaccttggccccagcagttagggtctaagctgtggctacaaaatcgtaggctggggtttgctcaggggccttcctttctcactcctggtcacctccctgaggccaccaccatttcagcagcagcacccagaccatcctcctacataagaagtgccagggcttttcaggaggccactggccttagaaatggccagtcctttaggggtgaaaggtctcagcttctggggcatgcagaagggagggccccctgagatgcttagaggctgagagcctgttggcagagagctggctgtgctgcaggccctgtcccaaagcaaaactcagctcaatcaattctccagggaaatcagagctttccggaaccatccaagacaccagagttgataagaggcactgctgagattttcacctgggttactcctgaactggtgataagcccttgtgatgacagagtagatacataatgagaatacaaaggcccctgagtgcttactcctctgggccagccttcaaaactctgacaggacactccaggagggcacagctcctgcagtcctacttcagtgattcagttccttcactatttcccactcctgattttataccttctctccatcttgagtcttcgttacttttttatcattaatttttttggagatggagtctcactctttacccaggctagatagaacacagtggcgtgatcttagctcactgcagcctccaactcctgggctcaagcgatcttcctgcctcagcctccttaagtagctgggaccacaggcatgtgtaccatgcctggctccagtcttctttgtttcctcaaattcccatcatcaaatggaccaacccattgcaccaatccactagctgctgttgcaatgcatggacggctctgctcctactgaaggccaactctctgtcactggggcccatgccctcttgtcattcagggaccttctcccgaaatgctcccctctcttgtctccctaatggacctcctcattcaccatcagcattcaaacatgcaagttatagctcccatatatctgcaaaaccaaaacaaaacaacatgccacagcccccctcaactctacctccttggcaccatcccgcttctttgatcccctttatagcaaatcctcctcaagcttagctatacttgctgtttccattgtctcacctcctgatctctttccaacccactttgaccacccccactccactgagaccatattggtcaaggtcacaaatgacctccatgtggctaagtcggcagacaattctcatcaaattcagtctttccttaattcctgcatttaacacaaatggattgaatgttggctgcagatgcctccccatggcttgtgagcaggtgggcacaacgctgggactgagtttttccctggacaaggttctcctctttacttggccaacatacctcccaataaacttccacttggagcccaccatgtgcaagattccagcactgaggctgtcagccaacttactcgggtgcctgttagttatcagctgcaaattatgaatttttgttgctccaaaacaacagctggtattgtgcagcctgcaaggagcgctgtggggctaacctcaagtccagagaggcacaaacgccatgctggagtctcagtagccagtgtcagtagccagtgtccctagtcctgtctccttaagcccaccctactcatggtaccaaaggcgcaccagcccaccactctgagcccccgtgactccttctgcaatagctatggctgagtggggtacagacccagccgtccctgggtgtcccagcgagggtgtcacagccctttagctcagagaaattgcccacagctctctgtgtcgcctaagacagggtttcccaaacttgccacattacaacagtcaactccttaaagacacagatgccagggcagctaacagtcagagacttagtccccaccccgaccctggcccctcatccttcatgcatcctgtgaggaggagggtgtaggagaaaatacacagtctgcccagtcctgcctttcctgaaggtattcccagtgtgaatggccccctcctgaaaatggtgccagggtctcatcagaccccacatcccaacagcccccaccctctggcaggcacacttggcaaccagactcttcttcttgctacttggtttataaatctggcccatggttttacacacttgggccctattaatacattgtaagtgacttaatcctcacaactcccccgagttagatgtattgtccccacttatttaagtattttattgtgatataactcacatgccatgtaattcaccactttaaagtggtttttagtatactcacagagttgtgcaaccatcacccctatctaattccagaacattttcctcacccaaaaagaaagcccatttctcattaagctcattaagcagtcacttcccgttgccccagcccctggcacccactaagctgctttctgttttgatggatttgcctattctggacatttcctattggtggagtcatacaatatgtgctttctgtgtctgggctttttcacttggcatcatgtttttgaggttcatgttgtagcattgcgagaacttcattgctttttatgactgaataatattgtgctgcaaggctattagccccgtttttataactaaggagacccagggctttgtgtcattatggtaccttgcccctattactcagtaagtgatggagtcaagtgtatcttactgtacagccaggatagtaaatagcttaagaattgaaccatcatcttctatacttaaatcaatttatatacatatgcacccctagcattgataatagcattttatgacttacaaattcttttagcctttttattcttgcttcttcagaatgatctcccaaggtggaaaaggtaacaatgctcccatttttggaagaaatgaaagcccccaaaatttaagcggtatattccaggctaaagctatgtattgatgcgtgaaaggtggctgcacctgactctggatacaacacaagctaacagctgctttaatgctttttaataaagatgcatgatttagagaaacaatttctgtttttttctttcagaatattttgtaggaagtacaaaccttctggctgagggaaagccccacttaaactttatcagagtggttacttgtttttattctaatgttcttaaatgatctaggaaataaaggttggtatctctttcaaaatacaggcgtcttggttccagcccaaatcagctgcattgccaagggaaagacctgggaataagaatttttaacaagtcccctaggtggcttagatcaacagaaacatttgcctagaagccaaagctccacagtctggcaaataaagtctttaatattgtcatcccaatgccaaccccctctttcagtaagaattctagtcactctgaactccatgcacctaacaaatgttcattaagcacctcttagggtccaggttctatgatgggtgctaaggatacaggggaccaagacaggcctcagggagcctccaggctccaggggagacaggcatcacatgagttatcaaaacctaatgagaaaaaaagggtggggggaacctgaggggaaacactatttagcctcaaaaagagacagaattggccaggtgcaatggctcacgcctgtaatcccagtactttgggaggttgaagcaggcagatcatgaggtcagaagatcgagaccatcctggccaacatggtgaaaccccgtatctactaaaaatacaaaaattagccaggcattgtggtgcacacttgtagtcccagctacccaagaggctgaggcaggacaatcacttgaacctgggaggtggaggttgcagtgagccgagattgcacaactgtactccagcctgggcaacagagtgagactccatctcaaaaaaaaaaaaaaagagacagacagacatcacatgagtcatcaaaacctaatgagaaaaaaagggtggggggaacctgatgggaaatattattcagcctcaaaaaagaaggacattctgacacatgctacaacatggatgaactctgaagacattaagcaaagtgaaataaaccagacacaaaaggaaaaatactgcatgattccacttacaggaagtccctaaagtagtcaaattcatagagacagaaagtagaatggtgggtgctagggacttggggaaaggagaatgggtagttagtgttttttttttgttttttttttttgagacggagtctcgctctgtcgcccaggccggactgcggactgcagtggcgcaatctcggctcactgcaagctctgcttccccggttcacgtcattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggctgggtagttagtgtttaatgaggacagagttttagtttgggaagatgaaaaagtcctggagatggatggtggttatggttatataacagtgtgaatgtccttaatgtcacagaactgtatgcttaaaaatggtcaacatggggccaggcacagtggctcatgcatataatcccagcattttgggaggctgagacaggaggatcactggagaccaggagtttgagaccagcctgggcaacatagtgagaccccatttctacaaaaaataataaaactagcccagcatggtggcatgtacctgtagtcccagctactcagaaggctgaggctggaggatctcttgagcccaggagtttgaggctacaccgagctatgattgtgccactgcactccagcctgggtgacagagcaagaccctgtctctaaaacacacacacacacacacacacacacacccctcctacaaaagctctgacaggagccacagtggagaagccaggtgctgcctgagggttccataaccagagggacctgacagcagctcccaagcgtgcttgtccaggagggttccatgcctaggacgcccttcaccctgccttgtctcctcccgatcctgtctgttgcccgcagaactttgtgcatccctcaactcagtttacttccagcttccaggtctgtgagatcccgtgtgccctgtctgcctgctcgtgagccatagctcctccatcgccactctccagccacatggctgcttgctttgctaggaaatcactatgttagctctccattccagctgctgccatgcccaggaagcacccattccccaggccagggaacagctgctccctcactccctggcatcaaccaggtctgggcacaaatgccatgccctccctgtcccttctacagtgtagatttcctctcctgcccagttcagtcccattgccacactttgcaatgatctgatttgtgtacttgaagactgcctccctccatcccagcacaggtgacaggagggcagggaacttgtctgtcttatttgttgccataatcccagtagataatcctagaatggtgcctgcacaaaagagaaaaagataacacctttcatttgtctctccattcacagcaggtgctaggcagccagggcctggcacttagtaggtactcaagaagggtaattggcaaatgttcacaaaaaaaccctctgcaggcagataacgctgccgccaagcagccaaagtgctaattacaaactgctctgttagctgttccttagcgcagctaagattctccaagaatagtgcacgctccctgccatgtccctgtttcttgacagcgtctgtgactcagacttttcatggagccagacttgccctcctcaagagcatgtgcagggcataaacgtcaaacaggacaactggatgttgctgcccatggtgtgggctgggggtgggggtatctgaagtcatctcagccctttctgatgggcaggtttgggagagacaagctgggccctgaatgagatatggcaatgccaggcagcccaaatgcccttagtataactaccacctcctctcagacacactcagtgcagctcagtttataaacactctgccacaacaatctcgctggaaactcaatgctcagaagcagtcagggcaagatgggaacacaaaagcccagagggactgagtcatttgacaaggccatacagtgagtcagggcagaatggtaccagactctgtatctcctgggctgtgacccaggactgatctactgtactcttaggtgagcaggaaacccaggcgtcttaggtcaccaataaccaggtccaaatgcttaactcagaagggagcaagcaggcagagccagaggacctagaggacaacgaaaggcccagccagtgtccttaggggatgtgaggacaggcacattcacgtgtctgtacaacttcacccaggccttgctccacagcattgtgagcggtgtggcctttacagtccagcctcccagggctgccagaaacacaacatgcctggaaagtttcccaggtaactggctcttctttacagagctattagcttcccttcatcatgccataaaatcctccagccgatgacagatctcatccttctccagggagggaaacagggaagaaacgaaacacaaaggaaaaaaaccactggtcaaatttggaaagccccatgggcacataacttgggcagaaaaggcatcagagatagctgggttgctgcattcagttgcacaggctatgcactgtccaactccaagcgatgccattctcatgtactacaatatgaatgacactcccttgagttaggaagtgcagggaaaggaccttgcatgattttgcgcaatgtcttcaatatcctcaaggcccacccctcgctgacaccttgtcctaggcctctcagttctcagaaacttctcattgatacccctcttgcaggaggaaatgaccaaggttggggaggagtcaaggcaaagggtttggcatctatttcgtgagccacttgactggctgggctgaaatcaagcactaagcccaggactagagagaagtattagccaccttttaagggctgaatcccacttacgtagactttgttctatttctctcctctttctggctctctaattagataaatgttagactttctccacgtatgtgtcttattctctctgcagcttccttttcttccagtgttgtattctggatttctccacgtttgacttaaagttctgtttcgttgttcaaatctgcttcatcattctttagagcttttaattctctgcacatattctcaactttgccttttatttatttaaatgcactgaacagttattttattggctatgcttaaatattgcagcatctgaagtctccagagtctgtttctgctgtaaattgttcgtgctggctctggctcttagtgctttatctcttcttctactcagttatttttgactaagaactgctcactttctgtggaagatatttgtagaaattcttttgaggcttaggatgagggtctgtttttccagagagggctatatttgctccagcaaatgcctgagttaacacccatctgcgatcactctaaattctcaggtagaggttagtgggaaccagcaggtcatgtaagttcatctttctcgtttttccattctattctttttttttttttgagacagtctcactctgttgcccatgctggagtgccgtggcgccatctcggctcattgcaacctctgcctcctggattcaagcaagtctcctgcctcagcctcccgggtagttgagattacaggcacataccaccatgcccggttaattttattgtttttttttttttttttttttgtatttttagtagagacccggtttcaccatgttggccaggctggtcttgaactcctgacctcagatgatctgcctgcctcgacctcccaaagtgctggaattacagtgtgagccatggtgcctggcctagtttttccattctattcttaccccggaatagacagcgggtttgtttgtttcctagggcaaccatcacaaagtgccacaaactgagtgtggctttaaacaaaataaatttattctcttacagttctggaggccagaagtctgaaatgaaggtgtcagtaaggctggtggatttcttgaggtcaggagtttaagatcagcctgagcaacacagggagacctcatctctacagaaaatttaaaaaattagctgggcatggtggcgcaagcctgtaatcctagctacttgggaagctgaggttggaagctcatttgaacccaggatatcaaggctacatgagccatgatcacacaactgcactccagctacagcgacagagcaagagccttgtctcaatcaataacaaaataaaataaaattttaaaacagccaatataataaattagatgaaaattcttttctactcttgaatctcccttccattcttggaataaatcctatttggtcatgctgtaataatatattcagttgaatgaaatttgctaatattttatttaagtttttttttttttttttaagtgaaaccagcctgtagttttgttgagttactgagttctcctttgattttggtaacagggttccttgtaaaagagttgtaacatttatttttatattatttattttttaactctgcaccccagctggggtacaatgtcaccatcacagctcacagcagcctcaacctcctgaattcaagcaaccctcccccttcagcctcccaagtagctaggactacaggtgtgcaccaccacaccacacctggctaattttttattttttgtagagacagggtctccctatgttgcaagggctggtctccaactcctggcctcaaggaatcctcctacctcagcctcccaaagtgctgggattacaggtgtaagccaccttgcctggccctttttaaaccctctgaatttatttttctagcttcttgaattgaaagctgggttcaataatttttaacttgacttgtctctgaataaattaatttagggctatatattttcctttgagtactgatttggcttcatcccataggtttttacatccagtgttcttactgccgtttagttcaaacacagtcgcttaaaattttcattttgacatccccatttaaactaacagttatttagatttttgtaactaatctgttactctcaagagatttttctattgaaatttttattgataattgtaaattcacatgtggctgtaagcaataacacaaagagatcccttgtatactttgtccagtgtcccccaatggtgacatcttttttttttttttttttttttgagacggagttttgcccttgttgcccagcctggagtgcaatggcgtgatctcggctcaccaaaacctccacctcctgggttcaagtgattctcctgcctcggcctcctgagtagctaggattacaggcatgtgccaccacgcccggctaattttgtattttttagtagagatggggtttctgcatattggtcaggttggtctcgagctcctgacctcaggtgatctgcccgcctcagcctcccaaagtgctgggattacaggcagtgacatcttacaaaactacaatattactatcaggatattgacattgatacactctatagacttcagtcagatttgccagttttacttgtatttatttgtgtgtgcagtgtgtgcatgtattaagttccatataattttatcacttatgtaggtttgtgtgtataataaaacacctatcctggatttttaaaactctacattattcactccatatctgtcatttttcacttgctatatcatcaatttatttatttataattttttatttttatttttatcctagggacagggtcttacactctgtcacccagactggagtgtatggcgcagtcatagctcactgcagcctcacactcttgggctcgagcgatccacacctagaaacctttctacctcctgggtacaatcttggctattgtttcctttttcagttgaatcccattttcactacaccttttcaggattctgcatgatttcttagcccctaaaggcatttgtttgcctgcatggatatgggtttttaataatatttgttctatcagatttagggatttggagcatgtcctcaatctgcagccatgatctcactcctgcttacacttcccagggattttcttttttaaacttggggtcaaagagagaatgtgggtcaatcctttactggtggcaaaggcagggaagctgtcggcagctgtgtcctcttccatgcagtccaagagaatcctgggctccagcagttgctgtccttccacggatggtgaacatgaacattccaattaggtctcctttttgcctgagttcaaactggatttctgttgcactcagaaaggtcctgactaagagtaggatgatacatcttgctttgaccttctgcatgttattcacttgctgagcaaaccctttcctcctgaagggcagaaagatacatttatgctgaggtatggtggctcatgcctgtaatcccagcactttgggaggccaaggcgacaggatcacctgaggtcaggagtttaagatcagcctagacaacacagtgaaaacccatctctactaaaaatacaaaaattagcccggcatggtgggatacgcttgtagttccagctattcaggaggctgaggcaggagaatcacttgaatccgggagcagaggctgaagtgggctgagatcacaccacagcactccagcctgggcgagagagcaaaactcagtctcaaaaaaaagaaaagaaaagaaaagaaaaggtacattttactttactccaaggtcaaaaaatggttgaaaactccaaataagttaaggtgttttctctttgtatgatggttctgaagtctcgaagtctgtcctctgagtccacagaagacgtggtgtgaatctggtcaggagaaagacgctgcagctggttggagaaaagggcagatgcagctcgacataaagtccagtgttcccaacgtgccaccctttcatcatgtgcagactctttctgccaaatgaccacccatgaaatatgagctctttctgtgaatctgaggagttgctctgggcccagcacgtggggcctggaactacctcaaaggcttctcccgtctaaggaagcagtatacgccaccagctcagcctgcccagcgtgcacacggcaccaagctggctgggtgctaaacagatacaatacttggaactaaaataaaacccaactcagtgacatcttgatgcagctttgtaggaacagcaggctcctgtgtacacaccgttctgctctgcacgcctatttgtaaattaatcacacatcagtagacttggctcagattcacatgtttctggaccactgtgagggtagctcaggctatgggatcttccattcagcttcaaaaccagatcctttcaacagattctgggtgagaattcttcttcttgccaggctctcttaagccacccacatcttgctcccttccccagcagaagcaaacagggcagagggaacggtgactccccacaagccccctccataaaagcatccccaatatactaatatcatagtttgaagacacacacacacacacacacacacttgcaagatgttagtgaaagcacgacgaaaagaaatagagtggcacctttttatgatgtgttcatactccaccagccaatgtcctgcctctgcctctccctggggttctttcctgtggtgttaatctcacctctgctccacctggatcctagaacactgcccagtcccaagcccagttgggcttccttgagttcactcttaggagccctgcagcttgagttccaggctctggccctgaggtcaaggcagtggtgatgagtcacagctgcaggtcagtggaaagtgactgcagcgtcaggccaagcttggccacttacatgtctggcatgacagtggcctcagagtactcgtctgagaagaagagctatcacctgagcgctctggagaacttagccggagctttcaggcagtctgggagcctacatggaggcgtgtaggcttatgtctcatgtccacgttgcccgggagacaaaatccttttctatttagagctgccccaaaatgttctgcaccagcttctcactgcggtggcttcaccttagcatacaggtatgtggacggccactgtgctggctcaccttggacactgccttcatgggcctgggtcaggttctcagtcagcagctcttgccaactccaggaggcccagacccaggagtggcctcctgctgccggacacgaagagggaaagagctgagctgcccggccctcttcttctaacaagccctcctgggttgacaaagaaagtctctccctgcactgggtgacactggacactgtccctgtcctctcccgggatgccccaggccaggggctgggatagcctcagggcctggctctctccatacccagcccaatcaggggtcctgtgcccaagatcctatcaagatgggtgctaagaatcacagagaatggggacaacctgcaggtccctgcaggactttgcagacccaggaggtggcagttcactgaggtctagcccctggccttgaatgggaaccaagcaggtgtgaactgggagtagaggccaccgatctgctgctcagccttggacaagtcagagtactcagaagcctcggatcccaaatgtgaaagagaaaagcgcgtctgagtgtgtgtgagaattccttcctaaccggggagcatatcttcagggcaacttcaggttaaaaatctaaattcaggccaggcgtggtggttcacgcctgcaatcccagcactttgagaggccgaggcgggtggatcacctgaggttgggagttcaagaccagcctgaccaacacggagaaaccccgtctctactaaaaatacaaaattagctaggcatggtggcacatgcctgtaatcccaactactcgggaggctgaggcaggagaatcgcttgaacccgggaggcagaagttgcggtgagccgagatcacaccattgcactccagcctgggcaacaagagcaaaactctatctcaaaaaaaaaaaaaaaaaaatttaaattcaaaaacaaacaaaaagaacttcttcctaacaggaacattcagaagaactaaggaaagaatgtctctgagggtgcaaatggtaccattggtctcctcaccctacaagtatttacaaagtgccgtagacaagaccgcatctgaaatcagagctgggcgggaggcaggacctgtggtttctaagtgctctctccacttccccaggcaatgggcctatggacaccaaagctggggcgcccggccagaacctgaagccccagggcacatagaggctgtaggctctggtggtgacggttcatctgagttacaagcggctgagcctcctgggctccccaccgcgacgcccacccctagttgaggaacaagccctaggaggctatgggaaagaaggagggggaaagcagagccatctggcttgtcctgaattattaaccacagaggaggaggtacagctaaggccctgggggaatcaggtgcagctgctctcagagttggagaggggaactggaacccttttgcagatccaagggatccagaggttggaatgtgaccctccgtgccagctgggccccaagtcccagggacccctcctgtacacctgacaggtgctacctcctctctgggccactaggcagcaaaaaacaaactatgccttcatcccctgaccttttactcttcaaagtacttacgaacccacgttcttcacttcttctttttgggcattttgtcggaaggataaaccaaggccaggtgagatcagacaattcagccaaggttgtagggctgccagggaggtggtcagggtgtataccaggtctccgtctccaatgccaccatggggtcccctccccaagaattccaagtcacccatggctgagccatgggaagaacacctgctatgtctccctctaatttgccttctgcctccatcccttttgattctggccctcaccagcactccctgggtgtcagagacagccttctaattggcctctatgtttccagtttggttcctctgaaatcctccttctagaaaccattagaggacatcttcccaatgcagatgcaaccatgtttgccagctccccagaatgtcactggaagccatcatgccccacccacagcctctccagggcctctctcactccaccattcacctgctgttccctgctgtcattcttgttgttccctgtttgcggtcctcagctccaaagccctcaagagcagcacctgcctcttacacctcggccccaagcactgcagaagctggtaactgttgcctgaggcatttgctcaaggccccaagcgctgtagaagctggtaactgttgcctgaggcatttgctcaagtgctcaacccctgctggttcttttgtggaaaaagccctttcccacggggtccacctggaaaattctcgaagtgtctattaagaatcagcttacacagcactcactctgagaagccctccgagactactctgggcaaagctgagtgcccaggtgcattgagagcacctcagccccagctcccaccacaccccattcccattgtctgggcccaaaccatgaagctcagggcagcacccgcatctgcttcatttctgcatcttcagggccaagcccacagcgaggtgctctacagatctccataagtacttaggagaggcacagctgtgggggcagaggtcagcatctaggcagggagagaaccaggcagggagaaggccaaccaaggatatcacaggctgaagagcccatgtgtttccagtcagagaggaggagctcacaagcatgggaccttttctgggggctcttccaagggccatctggagagcagtgagtcaaccagccacctcctgtgtggctcagcccctgcccctttccgtagcagcactgagctacatagcctgaatttggtaaaaggtctcggatgtggggcagagggcccagagaaggtcagggaggaactgcctgggaagccagatgcccacaaggctctgtgacttcacttccagggttcggtctgtactctctgcagtcaggagtactgtcccagctttaccaccttctggccctttagcacctggccatacacacccactaatgcccccagaagggtggaggcccacttctcccccagaacaagcttgactgatttgttttcatatcatctgagcttctctcttggacagtgggaagctgggagctccacccaggctgcacacaggactggcttgagggccatagagcaggaaataaatggtgagcttgtagcacagcagggacaaggcagagcctaagaaagggcccagagtctggtgtatgcctgattctgtggctatgaaacatccggaatagacaaatccatagagctaggatgcagacagatggtggccaggagctgtggggagggaggaatgggaagtgactgcttaaaagggacaggggttcctttcagggtgatggaaatgttttagaactagataaaggtggtggctgcacaatcttgtatgcatactatatgccaccgaattgtgcacttttaacatgtttaagcttactgaatttcacctaaaaagaaacgaggaaagaaaggtcaggcagaactccaagtatcagtttcctttttttctccaagtcctggcagcgctcccttttctgcaagctagcatcctggctctttttatcaacccccaggccccaagggctcagagcacaaatcgagggtgagttttccatgttgacctttatttttttatttttaaccaaagatgctccagcatactgcaggagaaggaacttgactgggtcacctcctggttaaaacccttcaagaattcaccttcattcaccaaagcaccctgagctccttgccttggcactggaagtctttgcacaggctggtgaactgacaccctcacccgtgaggacccagcccgtctgggtgccatcacctgggtctccacctccaccgggaaattctgacctactaagttgacctagctcctgacctaactcaagagccaccttggcagtaaagccaccctgaccctgtgacagtccctctgccaagcccccagcgcctgacacttccacccaatgctcactcagcagctcatcctgcatgaatgcagagtggcctggagggaagtgactgcacacaggatatacagactctcccaccacaaataaacaagcgattctgtcaacaaaagagccagaagaaaactgcactcctattggaaagggatgaggagcgcagaggctgcaaggagggtaccaagtcagagctgggaaggcccaaggcagggtggaaggtggagctcagagagggttccagggtccctgggtataggcacggtcctccttataggtcaccacctaagggggcagcagtccttaagggtgccaggttgacataggtggggtcacaaacctcagaaactgaagaacttgcaatccaaccctatcattgggtagatggaaaaattaaggcccagaaaagggcagacagttgatctactcatccttccacctatgcatccctactcgcatctacccatgcatcccttcacccatgcatccacctatccatctacccatgtagctaccgcgccattcactcatgcatgcatccactgatccatccacccatgcattcatccacccatgcatccatccacccatgcatccatccatcatctacatagggcaggggtgggactagagcccagagcctctgcctctaaacccaaaggtcttcacaacgggtcacagttgacttctttacactcacggcagctctgggaaactttctgaccccttaatgggtatacaggaagaaagaccctgctagtggaatgggggaagggtaacagggctcatgacaaggcacggtctatgcaggatgcctgccctaaggccaatcctcatcaacagctctgtgagggcagccaaccctaagcccactctgcagatgaggaaacaggaaacaagctctggagaggtctgctgacgtgcctacaatccaaggatggttaaccactacagccataaccctgtcccagatctctccactgtccaagagtaggccctctcactgcactatggcacgtcaggcatggcttgggcagggtggataggaggcgtcccagtgggcaagaagcttctcagaccaaaggcttctgagccagggtcaatgtggtggatggtgggagtcattggtcatcacaagatgatgcgtctcacaggaaatgggaaagaacttgtacactggggagtcagaaaaagggggaagcctggggctttcaggccctgacaaagctcctgcatccaagggagcttctgaaggttgtaggagaaggtggctgctagcagggtccccaagaacagctgccgacagagtttggacaaagttatgccatctccctatgtgccagtggcttcagagagttctggaggaaagacccaagagccggagcagctatgagggctggctgctgggaagagatggagttgggtgcggaggaaggcacaggtgttctaacaaagggactctgagaagcaggaactacggtgtagaggtaggcggtaagttcctagggaggccctgcagcaactgaggggcccctgctcctcctcctccttctccctgccaagtagagcagcctggcttgcatctgtctgctcccctccggtgcacctgggaccctgatgcttgctgcttcccatttcaacaaatccagggagacaggttcctgagtccccagactccctcccagacaggcagccaggtggaagggaaagtttggggtccagcgcctgcacttctcatctctccgtccttagatctgatacttgcaactgagccttggtttactcatctgtaaagggaggtggtaatacgtccagtgagggggtagaacactatgcctggcaaccaagatgtgttctgtcacccacaggaatactaaaaatatctaacccctgggcactgctgctggctgtggggctgggggaatcctggaggtgcctgtggacagcattgcccacttagctccagaaatcccagggaagggacaataagggggacggggcaggggcagaggctatttaccagcaaaaaaaagtacagcactcttgctcttggggctagatgtatctaggatttcagaatatcctgaactttagacaggtaaagctgcatatctcagcagcatccaataaacaaatacattgaactctctgcagtgaaagacatgaatatagaatacataaagactataaatagcctcacttggactataaatagcctcacctcagttcaggaaaaattttgctgccaaatgagttacaaaaaagtgtctggttttcagtgtgctggattttggaattgaggataaggaattgtggatctgcacatcaatgttttcaccacatatctgtgtgaaccaactgcatatcacccctgcttcaccccactaccaatgcaggacagatgaggggtgacatgtgctctgcctctaaaactcaccaggccctgtgaccttggggaacacagtccaaagagatgagtcacacacgaaagcaaatgtgcacacacacacaaacagcaatgcctataaatatattcataacacaggcctgcgggcacataggtccacaaggacgcagagcccagctctgctgacggaacctgtgttgccccagggcccgctgacccctgctcagggcaaggcctgtgtttccaggcctgtgactgggcaagcaagggtaggcaggaatgaggaacacggcagggcttggtggttgagagcttcctcatctctgcagtgtggagaaggggcaggtatgccaggcagacctggctctggtaccagcactgccactgcccagccggtggccttagataggtggccttgggcaggtggcctgcgcccctggctgggctgcatttcttcacctgcaaagtctgagtgaaacaggcctcttgggcttggtgagaggcacacaggagcccccagggcttggcacacagctggtgcttaggaagtgcttgctgactctgttctgtgacgttgcttaaatgcataatatttaaaagagggggctaaaataagtggccccttcagtcccagaagcgtctccctctcccccagggctctctttggaggcagagccccttgtgggtctctgtcctacaccagggctctctggtcagaatgcagatgagacctactggatgctctggctgccaagagcagcccccacgagaccaggctccaggtctggaaggaaaagcctagagcagggacccctggaggaggggtcacagcattgcaggcagaactcaggctttgacatcagaatggtgctctgatcacacagctccacccctcacttggtcttaaggaagttacttaaactctctgagcctcagttcttcattttataggtgaaggtatgtggaccttcattttataggtatgtggacctagtccaataccacacacacctcatagggtagtaaggggaataaattaacagacaatcaatgtaaagcacccagcacacaacacccaagcaacagcagcagccgctattattactataatgatgatggtgatggtgatggtgatgctggggatcagccctgctaaagaactgtgtccccacactcaaaacagtcaggactaggggaaacaaatcattgatatcattttgtcactatgcattattgccagccttcccagggttggggccgttgctcactgtttcgaccctcccagcaacgctgccagcaggcagacagacgcactctccccactccaaattggaaaatggaaaccaagagagcgacagggacttggtcaaggtcatcgggcaagtcagtagcagggaagggatgagaactcctcattctgggcccagggtgacaccaaaccgatcccaaccagcaccccaaggcctgcagcccacaggaggctctcagccaccacggggcacaggtatgtgcaggagcatcaagacctgggctgggggtggcacagggcaggggagctgaggggagtagggaaccaagacatctttcaactggcccaagcccatcgcgcacagtctggctcctctatctttggcggggagcctggggctatttcgggaagctctgcgcacagcccgccacttccctgccaggctgactgggtcaaaaacaaaacgagcccagcaacacccctgtgtcaacagggtgggaagtgaggaggcactgaacagccccaaatacaacagcaggaacaggagaaaatcagggaaggttgtgggggtaagcacatcaccctcaccctgcaaaaaaaagctagtgggaaacaaacaacacaatgaatcagatgcagcaggacacagggagtgactagctctggggccagaccacgttcacattcaagccttgtctttgagcaagtcctttacctgctccaggcctcagtgtacccatttgtggaccaccacccaccttggagggttgagtgggattaaatgaggtgacagtgaggcactgggcacctgagatgtcctcagcctgggcctgccatgccctgctcacccttcagagccttgctcagagtctcccattgggacagctgagctacagcccccattctgcaggcacttgccacccacagccgctggaggcccctggacggctgcacaaggccctgtccatccttgtgcaactgcagtgctgagcctggagcagctgcctcatcggtctgtgaggtcaagctcaaggggccacccagaaggctttccgagagcatccaaaaaaccagaagaaagggtgaagaggtccccgatggcatccagggttcccccatagccctccagtcactgtcatggggcaggcagcaggactcagctcatctctagctgctgctttgcaggggcagcatgagagccacctggtgccagggacagcgcacagggctctgcccagagcaggtgcacagcagacactggagacggagtcaatggggaaccaacggggctggcaggagaggcaggaggatgcaagacaggaacaaccatttatggggcatttccaaggcaccaggctctgtgggagcagctgacacaccttgtcccagcagattatgtctttttgacaggtaaaagcaaggggcccagaaaagggaaaggattttggcaagttggtgtgagacttgcaggaggccagcaagctcagaagggctgttcattttaaatgattaattgtatgtaaagcctgtgggtgtgaggatgaggaggcagctccccaacaggcaccctgggctggcctgggagccttaggggacatcatccccaaggtggtctgttggttctctcacagcaggaggatgggaaggaatggatggtggtcaggcagccacaggggcactggtactggcaacactcagcacttcctgcattcaggggcaccctctgtcatcctggacagcagagacttctagaagtcagatgcaggaagtgcttcccagagcaagattgtctttcattaactgctggagacgtggggcagagactcacccaaggtctgcagcaggcctaagccttgtcccttgttgtatccagccctgtatgcgtttgtgtgcgtgtgtgtagacaaatgtcaccttcacagctgaggtgtcagtgtgtctcatctgcgatgggccaggggaaggagatgaaagctcttgcaggtgccatgtgttgaaatggccactccaccatgtgcccagtgatgtatccgagaggagctcagggagccagggctggatgcaggcagacagcctggccaggaaggaggccaagtgtcaagatcgagcaaggggagggcctgacgaggggtagagaagaccaagctgggaaacacacggagtgggctggtgcaggcaggggcagagggtgaggggccgtcactgtagatgccctgaagactgagcattgtgggtactccccacaacccacaaactcatgagccagccaggagcaagagcaggggtctggctatgtatgccaccatcatctccactgcctttgtggagtgagtccgtgacctcaccccacagctgttgggggtgggggcatgaacctctgagacaagcacagactgagagctgggagacagacagactcctctctgcaatgcccatcctgtgagaggggcttaaccaccccctgggatgggctacaaggtactgctattagagaaagttcctatactgaacagtttgccccactgggactcaacctggggtcttgattgactttttggagccacatgcagcctttctcctccaggacaccttaaaatacgtgtctgactagtacaccctctccacagtggctgcctactggaccccctcggctgctctgggctctctgattctactcgtggaggcaaagtcgcccttgctgatgacagggcctgaggctgctaaaagccctgggtgtgtttcctgggacccgctgccaggccacactccccggccagtgcagtaggtttgccctttatctggtgacattctgcctgctgggtgcaaggggttgaatagtgcagccccctccccaaattcacatctaactagagcctcagaatgtgaccttatttggaaatagggtatttgtggatatgattagtgaaggatttctagatgaaatcatactggattgaggatgggctcaaaacccaatgactggtgttcttataagaagaggagagagtctacagccatggccatgcatggtggctcatgcctgtaatcccagcactttgggaaccaaggtgggtggaacacctgaggtcaggagttcgagaccagcatgggcaacatggtgaaaccccgtctctaccaaaaatacaaaaattagctggacatggtggcacatgcttgtaatcccagctactcaggaggctgaggcaggagaatcgcttgaacccaggaggcagaggttgcagtgagccaagattgtgccactgcactccagcctgggagacaagggtgaaactccatcacacacacacacacacacacacacacacacacacacacacacacgcaaaagaagaagaggagaggacacaggagacacaggagaaggccatgtgaaggcagaggcagagactgcagtgatgcagccacaagccaaggaacacttggggccaccagaagctgcaagaggcaaggaaggattctccttggagctttcagagggagtgtggtcctgctgacagcttgatctgagacttctggcctccagaactgtgagagaataaatttctgctgtttaggccatgcagtttgtggtcatttgtgacggcagccccaggaaactagtacattgggtttgtggcattgggaaacaggacacactctgagctgaccacatataggtcagctagtgtctcctgctccgggcaccctgcaggagaacagccaatgggtctcttggctggaagggtgacactagcatctgggcaggactgaggcagcctgtcaccaggctgttagcagggctgcagcccaattagctcagggcatgcgaggagccaacggtgagaaacccgtctgcatccaggctcttaagacacttgaggggaagtagtcatgtggcccaaagtgcactggcctccccctgcccagcctccccactttctccacctccccacatggtacctgaacagctttttctaggcccccatgtcaggtcaggccagctcagctttgctaaaaatccacgggcacggccgggcacggtggctcacgcctgtaatcccagcactttgggaggccaaggtgggcggatcacaaagtcaggagatcgagaacatcctggctaacacggtgaaaccccgtctctactaaaaatacaaaaaattagccgggtgaggtggctacttgggaggctgaggcaggagaatggcgtgaacctgggaggcggagcttgcagtgagccaagattgccccactgcactccagcctgggcgacagagcgagactccatctccaaaaaataataaataaataaataaataaataaataaataaataaataaataaaaataatccttgggcacaccagccctaagcagacagccttaagaactaacgcagggactgcaggtctttctaatcagaaatgcttgaagcgagatctgagaaatacttaacagccccctaaccccaaggggctcagcatcccctacctgtctccacttttggagaccctcccataatggggagctgagggagttggccaagacttttggaagctttaggactatgaccaagggtttctctgagattctgcagagtttggaatctcagagagctccagcacttacgaaccccaggcacctccaccaccccaacaccataggctctgcccacttcaagggacatggtcaggacaactgtaggattgataatgtcagagccaagatggttaagtccagcttttctcaaactgaagtacagggatgagctgctttagaaacacccagtgagcttgtttaaaatgtagattccagggccaggtacagtggctcacacccttaatcccagcactttggaaagctgaggtgggaggattgcttgagaccaggagtttgagactagcctgggcaatatggtgagaccccatctatacaaaaaaattaaaaattagccagaagtggtggattgtgcctgtagaaccagctactcaggggactgaggcaggaggatgacttgagcccaggaggctgcagtgagctatgattgcaccactgcactccagcctggacaacagagtaagacctactctctaaaaaaaaaaaaaaggaaaaaaatgcagattcctatgcgctgctcccagacctgctaaatcagaacctctgtgtgagaggcctcagaacctgcgttttaaacacatctcctgaggttatcaggaagccctccagagaatgaaacacggggcctggtacaatctcccctgcagacagatggagagactggagacaggacagggattgctgcaggccacgcagcaaagaaaaggccagagtccacacctctcctgggcttgctggggtccctataggcctggaatcagatggccagagtcctctgtgctcaaagagcccttcccccaggtgaagcttcctcgccttccaggccccctggaagccttcccaagccccgtgggccgagtcagcaccccgggcaccttgcgcccactttccttttggcatttatcagactgcactgtagccacatgtttgccttggagctcagggcccgagccttgttcaaagttgtgtccccagggctcggccacagcagttgcttaataaaggtaggtacccagcaaatatttgttagataaaagattttaattccaaactctgtcccagaacagttgtctgaccttgggcaggtgacccaacttccaggccccttcctggaacagattctggtcatctgccctgaccgtttcccaaggtgacagtgaaaagccagatgcaatgcactcaggaagctgcccagcagtggggctctgcacccggtgctcatatgacaagcaggggctcactgagtgactggcaaggagctaagagtccccaggttggcaagacccagccaggagagtctgctgataagatacagcccagggacagacgagtccagaggttctactagccttgagcctggggcaagaggtcgccatgccctggcccctagcccagctctcttcactgctcttggggcttaaatcatgccctaagcccatgtccactgtggggagcagggactgggccctgaaagctatcagactgcaaacagaagatcacatcaagtggtggtaacaagggcctgggagctgaagcaggtccctggcctgtgtgggccttagtgtcccagctatagtgaaggggtttgagctggaccgtatccaagggccccaggaccgtgtgggcaatggcaccgctgtcacagctgctgtcatcagcaccctcagggcctcatggcaggcattcatgttggtgtgggcatcagggaaggtctgctcctctggacagaggcctcctagaacacccaggccgggcagcccagaggaacatgacacacgctgagtctgggaagcaggcgatgtcccccctcccagctccactggctgccctgaggagcagagctgcccatgggatgggctccctatgagacaggatgctcctcggtgtgccacttcctcaagccaggcagtaacagcttacacaggccaggcctcttccaaggaggagctggggagcttaggcctgccccccatgccttctaaataaccccacaggaccaaccggttcttcagaccaggctagttgtgggggcagccctaagggccccacatcaacatgccccttcgcgcatctgcccaactcagagaatgccgtgacgtgtgactcatgttggggccacatggaagggatgtcaccgagtcaccaggtcagcccttcctagctgcaaacagggggatgcagggaaggaggccagcagagagagggagttgaactccgttctgcctccaggagcctatccagctggcccagctcagtgtgattccaaggaactcaggaaagctgccctgggtctgcctggctcagtgtccccatctagcaggtccgacctgggatcctcgagtgtccactgttgcttgggagggagcaacaggctgaactcttgagtagggtgggcagagggctgcaggcagcagagggggacaggcatgccggctcttctctaagttgaagctgccagctggtgtctcaagcataacttccagcccctgctctttctgggtccaggggaggcccctccttggcactgcagccatatccaagtttcagccatgaaatatggagctgctcatcttttccctgtgctccccataagccacactgctgaccacgtgttgtgcttcctagggtggaggacagccagagagagacccgcaggctggataactctgctgcccaccttcccctgagggcaagctcagtccagggagtggctctgggttcaggtggctggcagggtacaaacggctcgatgatcacacctcctgacagaaagctctgctggctaagacaccgcactggctctccaaacatttgggagcatgaaaagcagcggttggcctggccctgatcctaggacagcctctggtacagagcaatctgacactggaggagagccccacaagacgatcatccgcttcacacgctcctgcgacgaggcaggcaagaagcacagaatcttgaattctcacacaacgcccatggggggaccatcactcccattccacacaataggaaactgaggtgcaatgggattaagcagcttctgtgggtcacacagccaggactcaaaacccgagcctatatgactaccaagttttgctcttctaccagcttaggaaggtcctagagcagcccagtcccgatcctttccatctcaggaatctagagtcctggaaaggggacttcagccatgcaattagcacaggcccagcaggcaaatgaagtcaggcggaaggagtgttttaaatttacccattccccattctctgtctgcacaggcttgacaaagcctgttcacagccacaggctgtgataatggtgtgcccacgcctagaaagctgtgaagtgctttacaagggcacagggtgacaggaaaagtgaggacgctggcatgaaacaaagtgctgggcacacaccatccatttgtccttcccattctcctgagggcatccatcgctaactctgctgtgcacaccaggaaactgaggctccgagaggtcaaaggaattctccaagatcttataatcaggctgatggtagacaggggacagggacaaggtcttctaacttgcattctcccctgccctccagcccctgagcatagtcttgcttagagaaaggtgatggggacttgatgaggaaaattcctctcactatggcaacaaggtggggaaagtgaggcacaaagtagacagcaagttaaggctggcaattgtccctctcctgtcttctcccaagacacacctaccatttgcagagtgacagagcatgttcaagtccctcattcattcattcccaccaaacttggctttgtcagggagacagtcaggtctcagagagatccactggggcagagctgggaccccagactctcagactccaggcctagtgctccctgtcaacagctgctcaaggttttgaggttaaacattcatctgaaaggggctttcaggatgccgaaggcagcagagagggccacaaagctgacctactgggtaaacctgcaactgaacgttggaccaaataaaaccagcacccagtcaggaaaccatcataagatacaactttccctcacctggagctctggaagaagaggctgtggccaccaggcaagggccctggggaagtcatccaagccagaatccggagccccaacagggatcagggaaggagcctgacttccgaggcctggtgtttagggagagccctgcctcttgagagtttggctggtgtgattccatcgcctgcccccctccccagagctccctatccccttcagggatggccagctgtctccagcttccatgaggatggagcttccgttttattcacttggcttctcatgggtcgttaaggtacaaaccctctgctatttgttacatcggtatactttcaacctcttaggaagagctcttaaatggatgagccttttttcttccatatttcattttcatatagtctctaagctacggaaaaattgcaaaactaacataagaactcccctctacactacccaaaagcagcaattgcttcccttttgttccatctgccttgcatctgtgtccctcctgctctctgtgtgcatctctgggcataaacactcctgacccattgaagagtaagttatgggaatgccttgtctctaacaacagcctaccattcgccaccgcctacacaggtggttcatctcctagcacatcacacctgttctctgtggtgagacacatgaagtagacagtgttatctctatgttacagatgaagaaactgaggcacatatctcctcatgtgcagtgctgctcctactaccctgagccaccaatgctgaaatcctcagcctaaaacacatagaccccacgatgcagactgtctttctgatgatacatgatgtagcaatttttaaaagaaagggagccactctgctcctatagcagaataacagtggatcaggatcagagtgacccggattttccacagtgtagagtggcctcgtactctgggtggaagccctggggcaagtgagtggtagggcagatgcagggggctctcctccagctcatccccaggctgcctgctccttcctctctctaattccttccttttctcttctcagacaactaaggtgggtggccgtggagtgcagggagagtgagcaccccccagctctcctcacccaacctccttggcctcctcccatactgagcacccgctgaaggacaagggctgaatatagtcttcaggccaagagcccagcagccatgcccggtgcagagcaggttgcatgtataactaatgagtgaggcagagggagggagggagcgaaggagtgaaagagccaaggatccaagttctggttctgccttcacaggcaggctactcaaccctccgagactcggtctacttatctgtaaaatgggagcaacgccaagtacttctagggtggctgcaaactgttaaatcagatgagacttgggaaagtgtctgtgaagtggatttaagatcccagtgcagacataggttaaggagtttgctgagccctgctctgggaattgaagcagaaaatgggagaagcagaatgcaaagttaaagatgcccaaatacaaatgccacactcacattcactgcacacactctcacataccccataggcacacacaggcacatatacatgccacacacatgcacacacacctcacacacacaacataccacacatgcacatataaatacacacatgtccatatgcacacaacacacactcacatatacaccccccacatgagcacaccacacacgcatatgcaaacacatcacacacctcacatagacacacacatgcctacacatacacccacccacccacacacacacacaaacacacacatatggcctcacagctcagtacaccctaagcttatcagtctctgatgaatcccttccctttgggctggcggccctcagaagccctggacagaaagccagcacccagaggctcccctgcagacacaaacatgccaatccctgtaatacaccagaccatgcaacagagcaccagggaggaaaagagggaacagaggcagctctttccagaagtggacagggacagttgtctcactcaggtgagacactgagctgtaaagcaatgcataaaaaggacagctgtctgatcttaacaatcctgggaaccgtttacatgggatcatgttagcatgagaagaatgccaaatggtaggtacacccctgctagcaggcagggaaaacatatttgtgtgtgcgtgcatgtgggtgtgagcttgtgagttgcatgtgcatgcctgcatggcatgtgcacatgtatttgtgtgagtgtgcatgtggggaggctgtgtgtgtgtatctgcaagcatatgtgcacttgtgggcaaaggcgtgtatgtgcatgtataagtacgtgtgtgttcaggaaactcacaagagagactgggggagagtttaatgttcatgagcttctctcttcctgcagtttaagtcatcatgcaacaccaccaacagactttttcaaagctaggcacgggctgggcgggggccaaggcagatgttctgagtcccagaatctctgacccgcatcagagcggcctgtcctgcccagcacagcctgggtggtggattccaccatgctgcaagccaggccagggaaaaataaatcagactttctcctgggagcttcactggcttcgtggggtctgtctgaaccacagggcttcccaccacgcccttccctgaatcccagcgctcctgtcaaattaaagaaagaaccactcaccgcctgaaagccagccaatgaggtgattattccaattttcctggaacgagctttccacactttcacaggctggagccatcggcggcccaggctcccacctctccaagctgctctcacgccccctgcggctcctttcaagttaagtcaccactacgtgaagttatactttagagcagccgctgagaaaggacacaggagggcggagaggctggggcagagcactcacgatctacctcaggcaaatgcagccaggctggaggagccggcctctctcctcaaaagccagcttggctctggctgttcttttgacttttgggcttggtaactgaacacacacttgcattgccctgagctcacacgaaagccctcagggcagaggaagcccagcagcaacggcagggccgggtgcctcccatagaggctgagagcagagatgacgatcaggtgctgccacttgtgggctggcctttaaggtgtcacatcagattttccgctcactagcaaaccaaaaccaaactaaacaaaactagcacatggcctccccgcccatcacataactcgtaaacccatcagaattcccagcaaccaaccagaatccagatgcccgtaatgttgttaagaagcctgcacaccgcccagatgccaggagggtctgggtgattctccagccccaaagcagaggaagaaacagcacagacctgtgcagacacaaaagcattcctctcatcctgcccagttgtaacccatctgattgctcaaagagaagcaccaagaattgagggtctctggggggctcaaaggcagttttaaagaaacagggctttggggagataaacatagtttaaagatgcccaaccacagaaccacacagggagtcctgtctcaggccaccttcaaggctctgatgctgttattaaaacaatctgacagagagaatgctgaaacaaaaaacagaatccaatcaggtgctcatgaggctgaagtcctatattcaactattcactttgtgagccaattctggtcccaccctcaatccccactgcaccctgagacacagacacatactggaacatctagacttctctgcagtcagccctccaagttgagtgcctctttcagagttgactatgggttccctggtacctgaactctgaagctccctggtgagtcagacagggctacttggtgtaacacttcctatttaaagatcagagaggggttactctcagacaccattcaaacccataacttctaagaactgggtgctaaatccggtttctttggccctcactttccatcaacacgggagctgttcttgttgacaaccaggggttcttttttccattgcctgctgcacaggaagcagaggtcacggtgggagctgcctgtgccgggcatgggtcggagtgtgtctccccgggctgcgctgctgaggggttagcctcacagattccctctgggaaagccacttaagagtcattctgaatgcatctactggggatggggaagaaatgatgcagaatgttgacccactgggcagcaggcttgaaatcctgcctgaccaaactgtgccgaggggctgtcccaaacagatggtgctatccagacagacacactggcagggccgctctgcctgaagccagccagcagacgatcctccctacaccaccttcttggaaatcttggttatgggggatatcggggtggggagggacaccccttgttatcaggggtggagagggacaaaacatttcctcactgaactctcattttcagataatgaaggattggtcagagagacagccaacgtgtggccaacaatcaccactccagagccctgccccatctagggcgcacgtgcatgcctctgaatttcctcccctttccttggtccaaccacagtccaggaaagcagattttctatgccccgtggcaatcacagtggaaaatggaagtacaatggagtgctgtacctacccaagcaccaggaggcaggagtcgagctactcacagactccctagaggagaactccacgcacccaaactctgctgtgccccctctgagttctgagcatgccaggtgaggcctctccctctctctctccctccatcccagctcttcggagagaaagcaagcagcccgcgtgaccagacagagccttccttgctaataaacccatcctgaggctgtgacatgtttcagaaggagcagaaaattaccttttaggaagccaatgtgagggaaggggtggggggacaaagtatcagagccaggaggtgtgcaccacaggagccaggctggggtcgcgcagcagcctcccatccctgcagaggtccgctgagctccccatgctgccggcctcagggggccgcccccagcacgcagctctcccagcagcccatgcctggagacagaggacactgaggagcacgcgtgtccccaggatgggtggacggaggagctgggagactgggcagggatgccggaggaagggagaaaggcaggccggagaggaaggggtggggagcggagagggagggcgggaaggagggagaattgattttctctcctccactgggaccactgagctgagttgccatggagaaaggggagccgctggcagagcccaaggcgggcggaggagccatatgccagagggaaggcatcagcagagagccaatcccacagttctgctgctgcagcctcccccataccaggcctcagggtccaggtggccaggcggggaggggtaccggccagaccggtgggcaaaagcagcagctggtggccaccaccatgccaaggaaaagggaggagatgggggctttctcgcctggctcgtggtgctccgctgccccaagagcctgggccctccgtctcacgccacgatgcccagccagagcctgaagtcgggaccccagagactaaagtgaccctctccccgggcttaggtgataccttgtgttaggggaggcgttgtggatttccacctgcccggcctccctgtttctaaaaatctgttgccaaatcctgagtcacatcttcccaccctcagggataaggggatacccacctatggaagggctccgatggcccagtgccacccatgtgggaagcagaggagaagggaggctgctgggcacagcagggggagggggctctcctggacacactggcaggtggatggggactcccaggctccccacgctgggtggcatctcccatcacgcctgtgccagcctcactgctgcagctgcccacgtcccagcttcgatactggcttcagccacctggccccactcatactgggagcagcgaaatggggctgggaagaaagccacgagacctcagtggggtcgcagtctctcttcttggagatcacatgaccaggggcaagtctggtcacttccttgagcttctatctccttattacagacagagatgataccacgttctaccaactggcactcccaggcactcagacgtggcaggacttggggaaggctcagggcaggcactagtgctgtcctgggcccatctcaggagctgcggtctccttagggctgggagcacagtagcagcatcctccagcctcctatctctccctgctcacttggtagactcctcaggactaaaactacagcaggtctgcatccggcaccagagcctaccaggcccagctgccctgacacagagacatctaagttggggcacagcccaatcccatcgctttctccctcagtgttttatttcacttctttttcttttttcttttcttttttttttttttttttttttttttttttgagacagagtcaggctggagtgcagtggtatgatcacagctcactgcaacctccacctcctgggctcaaaacaattctcctgcctcagcccaagtagctgggattataggcgcccaccaccacacccagctaatttttgtatttttagtagagacaaggtttcgccatgttggccaggctggtcttgaactcctgacctcaggtgatccacccatctcggcctcccaaagtgctgagattacaggcatgagccaccgtgcccggcctctctctcactgttttatgatgaaagtgttcaagcatatggcaaagttgaaaacattttataatgaacatccatatattcaccatctagattctaccgcttcttctcactttttttattgcagtaaaatacatataacacaaaatttaccattttaaccattttaaagtgttcacttcagtggcattgagtatattcacaatgttgtgcaaccaccacctctatctagttccagagtttcagcatcccaaaaggagacccattagcagtctctctccagtcccctctcccccagcccctgtcaacaaccaatctactctctgtctgtctctatggatttgcctattctggacatttcatataaatggactcataaactacatggccttctgtgtctggcttctttcactcggtatcctgttttcgaggtccatccatgttgtggcgtgtgtcagtccttcattctcttttatgattgaatcatatcccagtacatggatggaccacattctgcttatgcattatccatcagccaatggacatgtgagctgtttccaccttttggctattgttgtcacattttttttttaagacacagggtctcactctgttgcccaggctggagtgcagtggtgtgattatagcttactgcagcctcgacctcctggattcaagtgattctcccacctcagcctcctgagtatctggaaatacaggccagggtcatgccactgtgctcagcttctcacttttaaaatgaagtcttcagagcccagtgaaatattccagagcccctcctaagggatttgttcccaaagttgcaggcccagaggccccaaactgagtgctcatctcaccctgcctttccactaaagcaatgctccccatgggtgaccaagtaagggaggctccagctggccctggggcccaaggcagagatcctaaaagcctgtgtgtagcccacaagtgggcctccagcctcctccaacccatcccaggtaagcagtcagctgggcagggagacacatgcatgtgccaaccccacacccatgctttgagatcaaatgaaacccggtgccaggaccactggcactcactgactacgtgactagccagtcatcacccctctctgagcttcagcttcttcagctgtgaatggggcaacaatctctaccccatgggtttgctctagagatgatgctggcgccacccaatagaactttccccagtgatgaacatgttacacacctgcactatccagtgcagctgccgtgacctgccactggccccaggtggctactaagcacttgaaatgtgatgaatgggagtgggaaatagaacttttccattttatttcactttaatttataattgaacttaaatagtcacactagactggtggtcagttctaaggcctgaggagatgacaagtgtaaaaggacgcatggtccaggcccaggcctagctcctggtctcttccctcaacccctcctctcctacttaccccacagtgtctgggcaggggagcaggctctgtccacagcctagctccagaggcacctctaaaaggagagaaggtggatggtggggctctcagggaacagcatagataccaactggggagtgggcaccatagactccataatgacgtgggtctggaactgcaggcctctcctctgccctgttctagaacccctcaactgctgtttcccctagcaactcctgcggttatccctggaatgtctgggcaggggctgtaaaattggaataggtccccccccactccttaatgtggtggcagagacccctgaggggaaatgcagagggccttggttctcggctgggctgtggagctgggcactcagggagtttcacatagccacgaagctgctttctcaggctcctctggcagggagcgtcaggatgagaatccagacctgactgccacccagccctctcacttcgcagatgcaaaaatccagactcagaaagggaggtaacttctccaacagggcggggtctgaagcccagggtcccgaccccaccaagctggccctgcaggagcctcctgagaggtgtctcgggagcagacccaggggaagggggcactgtgcactcttgccgggtaggcaaaagtctgtctgcttcttggcagctgtgtggcttcaaagcccagacagcagggactgaagactgagcaagccacccctctcctgtcccagacccacctgaacccaccaaagctgggaaaggaggggtagtggagactccagaaaaacaggaaaaatttaaactcaaccactaagtaaagcatcattaactcctgttgtgctgagcccacaaacaggtaggagtcatgcagaggtgggagctgtagctgaggatgggcctgtacccccaccctgcaaagccttctcctggctccctcaacagactggccagaaggaccaggacatgctcaaagccctgaatggcctctctccacccactcagagtgagggcctgcaggctctgccctgccacctctccgccctggcaaggccgtgggcaagttcctgccttggggcatctgtacttgccactctccctcccctctgctcaagggccccttctcactaaggccttccttgacaccctgatgtaaaacttggccctgactctaaccctggcattcctctgaccctttctaattttcttcagagcgttgatcgttatctagtacccgacttacttttctttcttctttcctttttattttaaaaattgtacatgtaacataaaatttaccatcttagccatttctttattttcatttttttgagacagagtcttgcccaggctggagtgcagtggcacgatttcagctcactgcaacctctgcctcccggttcaagcgattctcatgcctcagcctccaaatagctgggaatacaggcgcccaccaccatgcccggctaatttttatatttttagtaagacggggtttcaccatgttggtcaggctggtctcaaactcctgacctcaactgatccgcccgccttggcctcccaaagtgctgggattgcaggcgtggccaccgtgcctgacccatcttagccactcccaagtgcacacagttctatggcattaggcacattcacattgttgtgcaacatccccaccatccttctccagaaccaattcaccttccccagctgaactctacacattaaacaataactccccattccctcttcaccagccccagcactcactgttctactgtctgtcgctgtgcatttgacaactctagggacctcatcatataatcatggtaagtggaatcatacagtatttgtccttctgtgtctggcttctttcactgagcatgtcttatgggttcatccatgtgtcgtagcatgttctttttaaaatattgcctgcccaggcacagtacagtagcatacgcttgtagtcccagctacaggaggctgtggtgggaggattgtttgacccaggagtttgagcccagcccccttgggcaacatagtgagaccccatctctaaaaaaaaacaaaaaagtttttaactctctgtctctcctactagaatggagtctctacgagggcagggatgttggttggctgtatcctcgggctggaagagcactggcacgcagcaggcactgaatagaatttctaaatatacaaacggatgaaccaatggatggatggatgaatgaagaccctgtataggtcaatgcctcaaatgtctgtgcctggcctggagttatgtccctcacccccactgtagactaactcctggtcccaccctacggctttggaactgaagccacaggcctaccatccctgagaggtagcggtgctcagcgtggcaggacgccccacttgatggtaggcttctcccagatggctaactgcttcgagtctttcccccagatgtaacatgtctatgggaggattatgacatgggtagatgagagtccccagccatggaggtgacaatgtgccctggagcctcacaaggcagcagccaccaggaagaggcatggaggccaggaaggtcctggaacaccagaatttggccaacagagcctgaagccagcacatcgtggaggggcagcagcctgggggcattcgggagacctggagatgtggcagctggccaggagctggggtacaaccttgacaatcactaacctctcacttcctcgtcctgccaggctatttatagcctccctctctctgaaaactccttcacccatttttctgagcttaacaagcttggtgaattgaaatcaggtggaccacctccccaacctcagcaagcctgctggggtgactgcactcaggccaggcctgctggcagctcctgctccatgacagggacccttgagggcctgctgagagtcacagggttggggtgaccccgggaaggtggcatctaaagagagggcagcagctgggcacccaggcagacctcagccagagatgctggacgatggtgaccccagaagggctcagctcaccccaggcctcctccctgcttcaggaaaaacaaacagattgggacagtggaaaaacagctgtacctttaaattatctggcccacagatatgaaaaacatttgcatgctgaagctgtttgcatcttcggttatttttagggtgaacccagttgcctccccttggaaccagatgaagccccagaggcacgtagtcctttttcccagacgggggtcctggtcctgtttccctgggaataaggcttgagcatgagctctctgggacccagcccccgaccagaaccacaccgtgcattcaggcttgggaggaactggagcaccagggagccaaggctgcaactttgaacatttgccactgctgacatcgtggccacccacctggggccagaaagagcccctccgctgcccccagagcatgggtgaagagacgaacgcttagcctactacctcctctcatgccaggcccagctgatgggaatattttgctgagatatttctagcaccagcagcaattaaagcagattttctcttccactccccttccccaaaacaagaataaatcagttctaccaatttcccagctaatgatttcctccattaaattaaaaagaagaagaaaatgttttcttaaatggattaccagccctgtgctttcagagaccatgtgacctgtcaactccttttaaagtctgatacatcaaagtccctgaattaatttttaataaataaaaaagtcataatctaagaagcaccatcccacacacccccctcccccatcaagggtcagctctgagctgactctgggaagccagcttaatcgggccaagtatggctcttaatagagaaccagatccattccacagatgggagagacaaggctgagagatgtcaggtgcccaagcacagaaatcaggccctgagatgaacctagagttgtggcatgcaccgtagagtgctacatgtggaactgagtccttgatttcgaggggcacctgtctggagagatgcaaacaggtagatccaggagctgaggagtaactaagtaggtgtgagctagcgccatctgcgtgacccagatgggggctcctgggcaggacctgggcttctcttcctcttttgctccctggcagcacctggtatagggtcagcacacagtgctgacatcccctttgcttcaaaaagcccaccccctacaacacagacaaacctcaaaaacatgatgctgagcaaaagaagccagacacaaaaggccacatattgcaagactctgttcctatgaaacatctagaagacgcaaatccatagagacaaagagtacggcagaggctactgggggtgaggaaaagggttgggagttgttagttaatgggtgcagtttctgtttgggatgataaaaaaaattctggaaatggataggggtgatggttacacacattctaaatgtacttatgccaatgaactatacgcataaaagtggttaacacagaaaattttatgttatgtatattttaccacaataaaaaaaaatacaaggagaaaaaagcccactctccaaaatgcaacttgaagatacaggatggccaataactccacagggacaatggtgggaccctctgcaaactgcccccagacagactcaatgcttaaagcacagcgcagaggctcacagggcctgtcttgtcatgtatgaacaccagggaccttcagagaagggctctttgtgtgagccagcatgactaagccaggatgccctgtctccctggcggccagccagatgccacagggcaggcaggggctgagaagtctctgtggacacctccctggaaggcacctcctggtctcggcattcactgcacccttttcctgaaatgcacttcccgatattccgtaacctgcttcctacgtttatttaggttttcacagggaggtcctctctgaccatctacagttagaaaaataccgggaaggttgctggagccaggcaaggtagccgtgagcaagaacaggaaagccagggccccaacactatgacatgccagcaccttcctgctccctggctacagaaaagcagcttgcagggggcatcaggtcctggctccatcatttaccagcttgggggccttggctagttccttcaaccctctaaacctcggttttctcttctacaaaatgggggtgaagacagtgtttgtctcttgggcttttctgaggactacaatgagatgatgtatagtaagtgtttagcatatggctgggacatggtcaaaggtcggtaaatggtaatgatacatggattataatggaagtacaacattaatcccttaatgctggccaggaggtgtgggtcagcgatcctgaagacaggggaaggggccagtcgggccagaccacaaccacaactactcttctcagcatgtgaattaactgattgaatctttttgtccccatgttgcatatgaggaaactgaagcacagagaggttagtgacttgccccaggacatacagccaagaggtagtggagccccgattcaaattctagtcatctggctccaagcctgagctggccaccactgttccatagggtatctcaagggaagtgtggaaggaggctctgagaagagtctctggcgtgcagaggcagacctacagccggcttgcacagctctgacttccggacatgagcctctggaagtcctagggaaaggtctcagagcaggtccctcagggaagcccacagaatggttggactggcctggttcttctcaggcccaagaccttggtactcagttctgctcagcccagccactgtgattagcacccaagggtgcaattaactccttcagaaccaaggctagggcactaaagggaagaagtatctccatgttctggcttacgaggcattcctcagaccctcagagagcctggagacaactagagacccaaatccttccagggactagaaatagcgggccctgcacacttatgggagactctgtgtaccctgttgaagggcaagctgcttccaactccctctcaaagggaatgaatttccctcaatgaaaccttcttttttcttttcttttctttttttttttgaaacagcgtctcactctgtcgcccagactgctggagtgcagtggcgcgatctcgactcactggcaacctccacctcccaggctcaagcaattctcctgcctcagcctcccgagtagctgggattacaggcgcatgccactaccgcccggctaatttttttagtagagacggggtttcgctatgttggccaggctcctgacctcaaatgatctacccaccttggcctcccaaagtgctgggattataggcatgagccaccgtacctagccctcaatgcaactttctaaaaaatgcctactacaaatctcttaactaatgactctcttaggctgctgcaatacagaatttcttttttttcttttttttttagagacagggtctcgctctgtcacccaggctggagtgcaatggcacaatcacagctcactggagcctcaaactcctgggctcaggcaatcctcccacctcagcctcccaagtagttgggattacaagtgtgcaccaccatccctgggcaattttaaaattttttgcagagacagggtctcgctatgttgcctaggctgggctcaaactgctagactcaagcaatcctctggccttggcctcccacagtgccgggagctaccacgcccagccagcaatacagaatttctaactagtctccctccttttcactccagcctctacaaggtggcccaagtgagcatgttaaaataaaaacacaaatgagattatgctactctctacctcagaatcctccaagaactctgttcacacttcgtgtcgagtccagcgtctttaccatgacctgcaagtcctccaaggtcgtgcccctgactctccatcatttcctaccacgtttcttctcttgttctgttccaaccaccctgccttccttgcttgcctcaaacttgccaggacacttcaacctcagggtctttgcacctgctatttcctctttcccagatattacatgacttgctttctaaatttatttaagtttctacaaagaggtcctttctgaccatcctatccaagctcccgccccccgccaccccacacctctctcttccctccccttgcttacttttcttcctggcatttagcaccaccaaagagcatattttaggaaggaatttcatttggctcactgatgaatctgtgcttagaacaacacctggcacatgagtggtgttcaaaacctctgttgatggctttagaagtgagaatgatgggtggaaggtagcgactggaagtggaggggtgtgggggtggcaggagggtggtgtggggcttttgagaattggtgaaagaagaaaaagcttgaataaatgaacagaaataagttaaaatgataatcaaagatcttccctgctccccgcaaaatatccccaggcccagagagttttatagctgatgttagcaaactttcgagaagttcagaaaaaaagtttactctttgttggggggagagggacaaataaaacaaaaaacaggcacatcttcatgaacaagatgccatctgagtaggccctaaagtaagatttgaagccacgacagcaacaacttggaatcccccagggaaccttgtgtatgtctcctttgcactcatgttgctgcctccagaaatgcccttctccaccttgcctctggtctcagccctctgtcccccttactaaacctgctctatcactctggacatccaagcacacagtgagcactgcataaatgttagctgctgttgggcttacttgcttacatgtccgagtccccggctaatttgtatccccagtgcctgacaccatagcaggtatacaaaaaatgatagaggaatgaacaaggcacacaaaaagcctagcaaaagctacatatttactctaaaaaaagctttcgggcacagctgctgtaggcatgcaaaccaaggcatccaggctgcgcagccccgaacccaccctcaaactcttggcctcgtgaaattaggcaacaggggccctaggtgagccagagggcactgaactttgcctcaaaattagcgcttcctgatatgagcaaggaggtgacagcagccagaaatcgctaccctccctgcacccaatgaagctgatagaaagctctgggtcactcaaggctctaaaatgtaacatttgtctggctgtttacttcccctttatgcagctcaactacttagatccttcttcctactagtgggagatggatcccagtggtgagaaaaaagcaaaccaagtcctagagtctcaggggtctttaaagctgatccgagggaagacaaagatgaataaagatggaggaggaagagaacagaatttttcctcccatactcacacaaaaaagatctcgaatacccatgcttcatccccaactatcactactcatgcaaacaaagccagagaaacccctggattagctactgctctaagaactgactgtgtctttctccctcatccatcaatcccctatcagccttcaaactcaggtcaaaattccatggagcaggaaagcaggtaagacctggattctgagtgtgacaaaccaccatcctctgtgaaaaggccttgctgtgagccaacaagaccacaagcatgagtcagagccaacaaatggacatcttttgcagccagtagagagacagtgagctttgcccatgaacaaagatgactcagtggagccgcagaaaggaaatcaacatttatggagtattattcttggagttatctacagctgtataacaaattaacccaaaacttagtttaaaacaagaaaaatttattatttcatgctgcttctgtggatcaggaagctgagagtggcttggctgagtgtttcagggtcttccatggggtcacagtcaagatgttgaccagggctgcagtcatctgaaggtttggctgaggctgatagagtcatttctaagtcaactcatgtacgtgactgataagttagtacatggtttttggcaagaggtctgtctcacttcctcaccacatttctgaacctttccagagagcttgagtgtcctcacaagatggtggctggtttcccagagaaagtgatccaagagaaaggacagcagaaaccacattttctttgtttagagacagagtctctgccacccagctggagtgcagtggcacaatctcggctcactgaaacctccacctctcaggttcaagtgattctcctggctcagcctcccaagtatctgggactacaggcacaggtgccaacacacctggctaaatttttttttttttttgtatttttagtagagataggttttcaccatgctggccaggctggtctagaactcctgacctcaagtgatccacttggctcggcctcccaaagtgctgggattacaggcgtgagccaccacgcccagcccacgctgtcttttatggggccttggaattcacaatctgtcatttccaacaccctataagatacacaggtagcccgattcagtatgggaagggacttcacaggggtatgactatggggatgggagactgaagccagcctggaggtggccggcacagccacattgtggtcttcctaacccttgatgtagaccatctcctttcaacctcaagacagcccttgaaggcaggcattttcattttacagacataggttcctgcgtacccgcactgacctgagcctcttgtccagcctccttggggcagagagaacgaattggtggtgagccatgtagtgagaatatagttgcaggaatccaggaggaaggaggctcaggaaaagtggtgcaggattcagccactcacacggttaccaccttgctaccagggccaggccacccagccactggtggccttacagaaacagcaaggagcatctgctctctcggttctgccaccttgcccctcccgaggtgcctggcttcacagcaggattgccgtcctgcagccagttcattaggtggccccctgtgcaaggtgcctaagcgatctgtggctgcaggtgccacctcatggggttcgcaatttatagtcactcagaggcagaggacacaggtgaagaaggcgtcagtcccaccagctaccaaagctgccttgtctcgcaggaaaacatgactgaggcttatcaatttcccccatttcattctcaccaccactgacagggaagaagaactgattaagtccataaatctaatttctccacctagggctggatggttctcaaggacggttattcctcctctgcacaggcctggggtgggggtgctgagtgagggtcatggaattgagacagaagttggtatcaccacccccaggaccaaatccatttccctatggcacaaaggcagagaggtgcatttgagcactacaagcactagggtcagctttgctgatattttggaagaggcaatgacattatgactcccagatgggccacactgatacacactggaaagcaccttcccgctgtcacccagagcatataggagcctggcctgagtttctacacagaatatgtgtagaaacacatttttgggctgcctcatgatatagagaagaccttggccttggagaatcagagctgtcctgatccatttccaagctgtgagacctccttgcaccctgagtcctcatctctcaccctgccttgtggggctgattcaagggggaagtggtatgatgtgcacagaggccccagcacagcactcaccagggggaagagagtcaacactgagctgtttctccattcttccttgccctcttgctttgttttgaaaactgagggatccctggagtaaggtggcccagcagagaaatcccccaaagagcgttctgcacctacacactggagtgggtacgacaggccccacttggatgctacagactgtttcctgcaacccctgggtccagccttgggcccaagaaccaaggattggctctggggtggcccagcagaaagctgagcagggcagttaattttaataaaaggactccagtctggcaccatggctcacgcctgtaatcccaacactttgggaggcccaggcaggaggatggcttgaggccgagtatgagaccagcctaggcaacatagtgaaaccttatctctattttttcaaaacaaacaaaaaggactccatcctctggaaagcattgccacactgcagcctcaaacaggattactaaatcgctgtttgaaaagacaaagcaagattaaacaaatacttaactgccctcatcctcatcccaggtctgtcatcagtcaggctaatctagtcttgctgggttcccagatcggcccaaaaggctcctcaaggctttatcttctcctcaaagcagggcctcaggccagacatggctggctccccaggttcggcctgcggacctgcggcctcctctagcagagccacctctgcctttgccatgccctctcctaacccatcctaggtctccgaaagagtgaggaaaaactgccagaaaactggaaataaatcctctccttcctgatctctgcaactccttctccctctcagtggctgctcaaaggaaggacattgcctccctacctcgacctctcccccgagcccctggagcccctctgggaagctacagtttatgccgcttacagtcacttctgtattgtcctctgaccccctcgccaactgagaactgtgtttgagatgtaaaagcaccctttaaaaatgcacttgtgatccatggatgtgtggattgacaaaatgtggtcttatacacacagtggaagatgattgcaccatgagaaggaatgaagctcagatgcatgctcctacatgaacttgaaatcatgatgctcagtggaagaaaccagacacaaaatgccacatggtgtgtcactccgttcataagaaatgtccatgataggcaaatccagagatagaaagtagattagtggttgccaggggctgggggtttggggacaaatgagggataacatccatcgaggagctcatttttggtgtgatgaaaatgtttttttaaaaaaacctttatttatttttacacattgtaagagaatagaagaaaatgttctaaaattaactgtggtgttcattatacaactctgtgaacatactagaaaccattgaattgtacactttcaatgggtgaattgtatggtatgtgaactatatctcaatagagctgttatttaaaaatacacacacgcacacacacacacgcgcacacacacacacaccttgaaataatcatctgtaatcaacagagtctggccgctgcagtggagccaccccctgctcctgagccccttcctcctgccactcggcagcccctccagagccaacctcccactcccctcaacctgaagtactgactctgggggccagccctgggagggagaacaagcaaaagattcagcccctatcccaaactctgaggatggagctagaggccacagaagacaggctgttgcagcccaggagagactgctcttccatggctttaatacctccaaccctgagaccagaagccacaagacaccaacattcagttggtttgtgaatgactgtgaggaacctggagtctatggaaggacacagagccaggaggcctgggccagagcccaacaccaccagaaccccctgggcagaggcatccccacccacactcttaggatcagccccctcatctcagggacaaagctggggatcccagtgagaggcccctcaggctgggctcggaggctgcggctggcccagtgcagcaggcctggggatgctatgtggctgtgagaaaggcctggttaggggccacatggacacaaagcatcgtcaaacactccaggtgtcactgggccatggcagctgcttctcttgtggcactgctggcttggccaacagagccaggtgacacatttcaggaatacttgtcttatttgagcctcaccagtacagggctggctgtagacttaaaaggggctgaccaaggtgacaggtctgccagccagaggaatggaactcaagtggtgcaggggatcccagaacaccaggaagccagtccaaggctctcagagagctcaggcaggctcctgggaggtgactccggctgacctcggaaaggccccatgtcttcacccagcaggctgaagcggagcccagccaaggcctgtgatcctgtgcttcctgccaggcttgtcctccggcgcatcaggctcacccacaatgccatggaagtctccatcatctgctctgccccaggaaagcggacttagtcctctggggacgttacccaaatagctgcctccaactctggccataaagccaggaacttgggaagctggtaattggagaaactcttctcctcccccacaggaccataaattaccgtcctccatctgcacagatgcatcaaaggcccagacagccttctccgaaaccaagcacaggcagtggggtggggtccctccacctcctagaagcagctcccaggtggggccgagggcagggaaggccaggttcccatctaagaatcgaaggccttggactgaccgacctcctggctctgaccccacgtctgactcatagttgggaacaaacatcacatctacccccagggcaagactgcagccacacaacctctcctttcttcactctatttatcagtacaccctcgcagaaccacagacacgtgaaaatatttatatgatcagattaacttctgggcttcgtggcgcactgaagcaagcatgtttatccttccctcatacaacactttttctttggtcacttctttttcggggcactggggctcacagcacggcagtgcgtccacattagggtggctgctggggatccaagactctccactccaccatccttgcacagcaggctgattcagggcttggaacgtggtgagggggcccaggggaatgggctgctcccctggggagtcggttatctctgctccagaccctggcttttggcagtagccaagcttgctggacagtcgcccctgtggtgacagggagagctaagcaaatcagaaccgatggccctgtgctgggcacagatcccgcttggcagcccctgctgacgattgctctgcgctgccatctttagaaacaatcatttcttgggcgtgcacccacatgtgtacatctcgattttacaggctctgttaaagcgcaaagatctttcaggtactcaacaaagcaagatgtcgtgatgttgccaccagcctgccccctcctccccccgcctccgacctgtcacccagatgaagtgagacgaagtgtcttccaatacacacatcggagtgtgtcacttctctgagtaaaggccctcaacgctccccttgggtttcaaggcgacatctaagctccttaactagggcacgaggcccccaacctggtcctccctgcagctcagccccagccagactctcacagacaggagcccatggggctcctcctgcctcggggccattgtgaaggcggttccctctaccaggaagactctcccttgtttacacgcaaccctgcctcctgtgtcgtgtgaactcagcaccccacaggatctaaaccaagcgtcagcacctgaggctcccttcatgggctccacgccccagtggcagacccccccaaccccacttccacaaggcttggcactatcgtaaggatcatcaccgcccatgactgatgcctgtgatggcctgagagctccttgagagtgggggctggaattgattcacttctgcagccctgtagctcagagcccacactcagggctgaatgatggatccatacacatgtcgcctgctcagggagccaaagtggccccgtggcttgtcccctgaagccctaaagcaccaggaatacattgggaattgggacagggggacagacccctcctttgagggactagccccgctcccatgtgatggcagctcaatctccatctgtagccagcaagcacacccaggcaccatttatttacgcaatattaacacatgccctgcttgcatgccccagctcttggccctggttaaatgaggccacagaagaggaatgggctcgcgggaagccacttcccatgattggtgactgcacagcaaccatattttattcacggtgagttcctgggattcttgccagcttaccgacttcaatccttttccatgaaaagtgtgtcttgggcatgcgttctgttcctcacccaatgccagaatctgcttctagctaggaagaggcagtgggaagatggggaggggggcgaggaatgagagagaacccaaaaggacatggagaaggaagaaagagggaggaaggtgtgaggaaggagcagagaggaacagggaaggagacagccacaggcccgggggcatctggaatccctccccctgcaccactagcctaaacaagggtcccaacaccagccagcctgggctgagcagtgaggacctggaaccagaagacaaagctgtactcttgtcaagaggagggatccaggcagggcagaagcagaaaaaagacacaggaaggtggcttgtggaagtcaggagccacccagcaggatggcaggctggccatagaatcctccaggcccagcaggtctccccggcccctctgcagcaaaaacgaggcccagggaagctagaggaactaaaggatgctggactggtgccactgtgcttagtgcaacacagctgtccccaggactccccagagtggggccaccctgccatctctctttatttttattattatttatttatttatttatttttaatttatttttttggtatggagtctcgctcttgtcgcccaggtttgagtgcagtggcacgatcttggcttgctgcaacctcttcctcctgggttcaagtgattctcctgcctcagcctcctgagtagctgggattacaggcgcccaccaccacgcccagctaatttttgtacttttagtagagacggggttttgccatgttggccaggctggtctcgaactcctgacctcaggtgatccacctgccttggcctcccaaagtgctgggattacaggcatgagccaccgcgcccggcctgccatctcccttttattagtgattgcaaagtgctaagggggaaagactttcagcagcccacttttctgcacagtcctcaagaggccagcacctcctttcctctccttggcagaccctccctcgctcctctaccctcgaccccacaggcacaagtgagctgtggctgggagtcaggaagggagattgtctttcttaaggcacgcacatgctcagcagtgatggcatggatggggaggggttccagcagacttatttatagccaagcagcctgtccgcacgctctccagtgcagcctgcctcacttgcctgcctgcctgccttccttgcctgcctgtctgccttccactggggtttttcaatctgtgcctatatttatcgcccaaagccgctgggataatggcaaggccagaaatagccttgaagacattcacgtgaagatgacgggcaggtccccagctcctgggctgacctcgcccctacatctgccacttggcagtgggtatgaggaacagctggacagagctcggaaagcggctgcagccagatgggaacaacataatcctcctttctctgctggccttggccctctgtagtgatgcaggggacatgtcgaaaatgatacatcacagccgccaggccacagggagaccaaaggtgacagagattcctgacgtcagtgtgctaatcagagcagacagtccagagaaagagagaagaatcaaaggcagcagcacagcctcacagaaagcaggtcacccccagcacccaggttgcagggagatgctctcctgcctggcttcttgcacctgtacaacggaatcatgggcccatttcccatttctgtcctctgggatgagcgctggcccacaggctctgggagatgctctcaagggaacaaggatttgggtcctaaagaggcctggaatgggttggggctcatgggaggaggaagaaggtgccagatgtaagtcaggaccaggacggggagctagacatctaggcaggatggagggtgtcagggaccaccagccagagccctatcataggagggcagcagtacgagataagaaacatgtgcaggccaggcacagtggctcaaacctgtaatcccagcactttgggaaactgtgggaggatcacatgagttcaggagttcaagaccaggctgggcaacatagtaagactctgtctctacaaaaagagaacaattttttttaattagccaggcatggtggcctgcatctatagtcccagctactccagaggcataggcaggaggattgcttgagcccaggagttcaaggctgcagtcagctaatatgcaaatggagaagaggaagcgcctcctaattagaagcaaacaaacagatgccacagagacagccacaaggttggcgagtgagtcccccgaatcccacgggctcccaagtgtccactcctgagagctgagctcaggggccggcttccttcccagcccaatctccatcctgccagcctttgtctctgtacttcaagaacctgaaacttctcagcactccccaaagataccatgcactttgagtactgaaggctcattctggtccgtctgcctttccccctttactcctgataaactcctccatatccttcaaagcccatttgaaatgctccctcttgtatgaaatcttctccatcagatgtcagctgctgccttctctctgctctagctgcactctgtgcctcccttctgtgcatgtgctatgcattctaacatgtgtctatacccccatcccaggggctgagttccccttcctcactggatctctgattcagtgggcacagcaagcacctgccagataagggaggcaactgattccctccttcacgctcacccagaactgtcgattttgctgaaaaaaaaaatatatatctttttttttaaagaatgaaacctcataccaggactccctttggagatgagggcaaaggcaagtctggctctctgaatctgcctccctatgttcctcggagaacacccagcacagcaagattgggaagctactgttctgccagggcttgactggcgggacaagtgggatactcctctacagagagggaggaggcccacctttgtgcctgtgggctgacgaagccctgggggctctgggccctacctgcagcactggcagacttcccacaagctcctggtctgaacatcatctccttccacatggccgatcatagagcaggagcccagtgcagaggaaaactaggcatgtagctaagggctgggttaaccttctctgtgctactgtttttttaatgacccaaacagctcctggctcctggatgcctggctccaggtcccactgtgtgcctgggttcagatgcctatccatgctggcactgttccaagtcccacctacagcctctcagatcccacagctggcgcactatccttaggaagcccctccagctgaggagagagatgcacagatgtgccaggcactgacagcctgggaggcctattcccaggggcaatcagaagactagaaagcactgaaagaggcagtgccctgtaaggacagctctacatccacagaaaacaccactaacagagcacccaggtgtgcaggcatccatgcccgggggaagtaagaattgcaggtgacacgcgcacagcctactccgcagacacctactcctttcttccacatgaccatatgcagtaaggactaataaggtctgcatttcacagaagaagaaactgaggtgcagtgagttgaggggacttgcccaaggtgtcccaggcagttaggttctggaacctgcattaaccacactatacaattctccatgcagataaaacaatgtgcaacgtaaaatgctgcagcctctctggaaaacagtctggcaattcctcaaatatgctgaacacagagttaccatatgacccagcaattccacttgtaggcatgtgcacaagagaaatgaaacatgttcaataaaaacttgtacacaagctgggcatggtggctcatgcctgtaatcccagcactttgggaggccaaggcgggtggatcacctgaggtcaggagatcgagaccagcctgaccaacatggtgaaaccccgtctctactaaaaatacaaaaattaattggacgtggtagtggacgtctataatcccagctactcaggaggctaaggcagcagaatcacttgagcctggtaggcggaagttgtagtgagctgagattgcaccactgcactccaggctgggcaacagagcaagactccgtctccaaaaaaaaaaaaaaatcatgcagcactgacatatggtacagcacggatgaaccatgaaaacatgatgctgagtgaaagaagccagacacagacgcaaaagaccatatcatcttatgactccattcatatgaaatgtccggaaaaggcattagccattcttcttctctatgagaaaagactgagacccagtcagactcacctgaggcaggaacagtatctaacgccaccccttccactgtgtttctataactccatataacgtctataactccctggttccagaagcctttcctgacttcacatacgaaggaactgatcattccacgtgccccattccccacacataccccacactgacattgatcagagagctctgccagccaggtgcatggccacctttcccaggcagctgcaagtgccaggagccactcctatttgttttagggaaggaacattctttattgagcacctaataagtgcctgacacagtgcacaggcactctgtactggttttcttatttgttttctttcctttggtcaaagttttttcaaacctaggccattttggggagatgctttaatgcttcaaaaacacacacttatgacctcaaatatccccttgcagtgggacatagcatgggctgaccctgggccaacctgtgatgcaggacaaggtccctcctgccgagatgccacctccccactcctctctcactgtcatcaacttgccctgcttcttgtttctattaataaacatatccacagcgaagtatcaaagagtgaatgcaacatgtttcccaagagtatttatcatttgaatgaaaactagaaagacggcaatgcttgactaaaaggaataagggaccaatagtaaaatttcaggcactggagggataatgaagaaatggttctccttcccaagcccctcaaagcacaaaccttatttatttttacgtccagcacatagtgcagctcaggcacacagacggtacttagtaaatgttcgtcatgtgttaagtggcctacttaaggccactcctcccatctgggaaccagccccctagaaagctgtagtgcaagctccatggggacaaaccatcaagttcccttttcttgggggtggtggagtgagttctaaaacccaccaccagtccggcatggtggctcatgcctgtaattccagcactttgagaggccaagatgggaggatcacttgaggaaaggagtttgagaccagcccaggcaacatagcgagatcccatctctacataaaattaaaaaattagctgggtgtggtgtgcgtctgtgacatgcaagttcgagactgcagtgagctaagattgtaccaccgtactccagcctgggtgacagagtgatcttgtctctaaaaaacaaattcttaaaaataatagtgcccaccactaatttgtaggcacaacctagacacagcactcaacctcagttgtcacagaactctgcctacacctgagaattgccacagaaatgcaaggaagtccccagcaaggtgtgttagagtgctgcatcccagagcaggagggagaaggctggggagaggaaggaaagtgctgaacaacatgtgctgtgggggaagatgctgccctgagctacttaagggcagagagcttgcctccagcttccttactgtctccgcatcctcgtccagcctcagaagaaaacactaagaagtggccttctgcaaggacatgcccaccagagcaaagggcagttgagaatggtctcctggggcagcccatacaccaatcaatggaagtaatttccaagttgtcattcctcaacaatacatttactgtgatggggacgatgaagttaaaaaactgaaagaaaaagcaaactggatttccctcccctttggcctatagattcagctcctcccaagacagcaaaagcaacatcttttcctcccatcccccacaggcagccctcatactgaggagtgtaaagacgacaactgattcttcccatgctgagctgggaacttcacaggtctcattctgaatcccactagccacaggaaaccttaaagcttgtcattagagcagccttgcacactaaaaaagaaaaataccagctttcttcacagagaagcacatggaagtcactcgatgcaatgagaggacaccccacagtgatcaacctaagtgtatgggtcctggaggtttaagggaaacctgttcttggtgacacagttacctgtagggctgtcagatctcagcccccaccaaccttccttgcccgttgtattccaagggactgaatcatgaatttgtttatttagagacaggtctcactcagtcgcccaggctggagtgcaatggtgtaatcatagctcactgcagccttgacctcctggcctaaagcaatcctcccacctcagcctcctgagtagctgggactacaggtacataccaccacaccaggctaactgaatcatgggtttaaacaaaccaccttggtagacacaaggcctctggtttgtgttccctggggcatctggtggcaggagaagttgttttagtgactgtccttacagtgatgatccctgatcttggccatttccctgcatatgcctctaacatgaacctatgaccctgatgatacaggctccctgggtttgctcgtctgtctcccttgaactgttagctccttgacagcaagactctcttatttgttcgggcctgacactccatggaggctcagcatgagccaagtgaataatgcacaggagcactgactttgatctgcccaaggcctgacatcgtcaagactgcagcccagctaaggtgaaaatgctggtccagagagagctgctgaaggcccagagtgccaagaatcctcagctcacaaagtctcaggctcctgctggccagcggaggctgggcttggcctctgtgggtgctgtcaggaccctgtggcttggctctgggaccctggggccagcccttcttcccttggccctcaacctcactgggaccattcattgtttcagctgtaaaaacactggacctgcattccagaagcccaaattttggctctgcaactagccagcttgccatgggactttggacaagtcacttcttttcttaggcctcagttttccagtgggttaggtgtaaaggttggcctagatgacttcttgcatctctccaagtccacaagaaccttcttttaagcaagaggcacccaatgcctcagaattcctctaggctctacctttatttattttgttattttatttatttatttatttatttatttattttgagatggagtttcactcttgttgcgcaggctggagtgcagtggcgtgatcttggctaaccgcaacctccgcctccgggttgaacctccgggttcaagcaattctcctgcctcagcctcccaagtagctgggactacaggcatgcaccaccacatctgggtaatctttgtatttttagtagagacagggtatctccatgttaatcaggctgaagcctggtctcgaactcccgacctcaggtgatctgcccgtgttggcctcccaaagtgctgggattacaggcgtgggccaccatgcctggcctggctctacctttagaacacatctggggcccaacaggctcgcagcccccacacacccgctgcctctccctgtcaggcctctgagcccgagccaagccatcgcatcccctgtgacttgcacctatacgcccagacggcctgaagtaactgaagaatcacaaaagaagtgaatatgccctgccccgccttaactgatgacattccaccacaaaagaagtataaatggccggtccttgccttaactgatgacattccaccacaaaagaagtgaaaatggccggtccttgccttaagtgatgacattaccttgtgaaagtccttttcctggctcatcctggctcaaaaagctcccccactgagcaccttgcgacccccactcctgcccgccagagaacaaaccccctttgactgtaattttcctttacctacccaaatcttataaaacagccccacccctatctcccttcgctgactctcttttctgattcagcccgcctgcacccaggtgattaaaagctttattgctcacacaaagcctgtttggtggtctcttcacacggacacacatgaaactccctattgcaattgtttccccacaatcacccagcttcctcccttcctcccatccagcctgctctcatcaccatagccagaaaccatccttttaaagcacaattcggatcctgaccctctactgctcaaacatttccgaagcttcaggtcactcagagtcagggccaaagtcctgatacagcctgcaaagccctgatctaacggggccctcaatattctctgacctcctcccctgcttctcttcccctcattcactcactccagtttcctgaacatcctggacaagctcctgcctcagggcctttctccctgagctaccatcctggctcactcctcacctccttcaggtcttcgcctaaatgtccccaacttgggaggccttcctttcccctgcttctgcaactctgatcaccatctgatgtgcttacaggttttactgactattttctatcgagtgtctacccccactagaatacaagccccaggagggccagaagtttttaacattttatcacgtctttatgcccagctcctagaatagtaggtactcactaaatacgtgtggaatgaatcgctgctgatccactgaggggtcaatcgtgctgctgaaatgaagagtcaagctattcaaccccctggcttgaatggcgccatctcaggaacccctcagagaattccaagctctgtacactgtctccaggaacaaaagcgattgtcccaggcagggttcacatctcaggaagtgtgtgaagaaacaaagaaaggaagtgacacaggggacacagatccagaaagctcctgctgacgacacctggttaccgggaggcatgagggctcagcgcatacgggaatgcctccaggcacctggagtgctgagccgtcatgcctccagctgcctccctgcaggtgggatgaggtcatcaatgtgagtgcactggatacccaccatggagaagtactggaaatgaaccgaagacaggggctctgtactagagccaagggaaggcagaaacgagaggaagaaggaaaagaaaggtggtgagaaagagtttcccatgctgagaacctgcaggcagagatgtagagaaacccccagccccagaccaccactgaccaagacagcagggcacccggcctcacatgccctcaggtaggccaggccagcttccttcctggccctgcctgtcctgaagagcacaagtgaaacagacccatgcccatccccctgcaagcatggtatgcctgcgcaaacctcaacaagtgaccaaaagcatcgcccagaaacaatcgtcttgccacaggccccctgcttcttctcttcaccccagatagcctgctctcaacacggcagccagaagacatccttctgaagcacaattcgacacaagccagaggaatgcaggcttctgccaccttgttgaaagtaaaatacattctgggccaggtgtggtggtgtgcacctgtagtcccagctactcaggaggctgaggtgggaggactgcttaagcccaggaattcaaggctgcagtgagccatgatcacaccactgcactccagcctgggtggcagagcaagactccatctctaaaataagtaaataattcctttaaaaaaaaaaacaggaagaaaagaaagtacattctcaggaagacatgctgcatcagagcaaacaaggcaaatgcaggggtcagtccccagagctccggggaacaggaagaagaggagactgagaagagccagcaatttctggctaaagccctgcgtactgagcagcgtcaggtgtgtgtcaaagaaccatatcaataaacaaaatgtagatgggagcagtcaggaggggcacaggtgacagaactggccagggcatgacatgggtcatcagattgtgcccagatctctaccaagctctgtggggacagcaaaggagctgaggaggagctctctgtggacttcagggcagcatctttgctccagggcatgagggcactcagccctctacttcctctccataacctccccatgctctgggctctctgggcagccttctaacatgcgagacttatcacagacctaaacctcacagggacggacaggcctgcattcccatgtgggactagggctgcctgagaggagggactaggaagcaaggccctcgctgcaggtagggctctgctgctgctacggatggagataagtcccttcttcacctgggatgggacttcatccaaggggctggaggtggggatgggggtacagcatggggaggtggggacgtgccctggaaagtctgtgtcattgctgctgtggtctgaggccctgcccatgtcatgagctctctttctcctcaggagacagtgaccttttgaggcctgtcacagagacaatggcaggaagtgcccctccctgcctgagccacggggagtccggaaggaagccactgcctgggcccaggaccctccccgctgagctcttgcccaagggacactgaagctcatggcaatgccagaagctctgctcaccaatgccgaatggcaaacatcttcaactgtgagggctaagggcaaatattctccttggctgggaccctcctctttaaggcagacccctactgtgaaagacagccaggcagtaggagacacaaccccagctaccccacccaccacctgccacccccaccttctggaaggaagggctctggattcctccacagcaaggagcttttctaaaaataaaccctggtccttgagccctttccttcctcagtcccttgtggaggagagaggagaaggaaagatctcgttcttagcgaaccccagggagtgtggcctccctccaccccatgactctcgctaccagggcccggtggtcactatgccacaaactcccaagcagggtgcagaggcatggagggggcaaccctaatcatcctcacatggggcctgccattttctaggggagggttttgggaaaagcaggtggtaccagctctctagtccaggatctggggggaaaggatggcacccaaaggcaagtctcccacattacaaggttcccaggtcaacagcagacacagacacttactgaaatatttcagggaaaatgatgccaagaattctgaggtccaagcagtatgccgtgacagcacagagggaggaaggagaggctaatgcggacccaggccttgcaaagaaatttagaggaaaggagctgtttgaaatgggcttggaaggtgaaacaggaacctgacaggtagaggtgggaagagggaatttcaggatgctggaactgcataagcaaagcgcagagaatgtaccagcatataaactagacgcgggcagggatgcctgtctgttttgttcacagtggcgtctctggcaactggaatggtccctggtgcaaactaagtaacaataaatactttatggacaaatgagtggagcagaacaattcctgaagacattttaggtctaagtgaagaccttcggatgaggtgagctgcaaggccatggtctctgcaaagccactgcactctggaatgcagttgttaagaaggaatagaacctccttcctgtaagaaaggagacaggagaccaaggctgtgttgaagcagcgtccctcagagcaatgtcagtgctcaggccatgcagggcagaagagctctcaccgggccctgcctcgacttggcagccaagacctttggcaacaggacaaccacgaggccccaaccccgcagaacccgagtgacccctggagaagctgcaagtcagggctgagtgttactatgtgccctcccctacatccactcccagtagctgggacaccttggaaagtgaattaaaacaaaacagaaaaacaaaaaatacaacatagcactctctcttcttagcacttggaggccttttcacagcaactgaaaagaatgagcaattagagaagataacagtccacggtgccagcctggaactacggagccacagaggcaacttaagaggccccatcacaacgtgccctatcttcccagcaaggatgagggcacccggagaagggaagggacttacccgagatcagacagcaagtaacagttgagcctgggctgaaccaagggccctgtgagtcacaggccaaatttgaaaaaccatgccatgtgcttccaggtctagactcggggtccaatcccaatcccaccactgactagctgtgcaacctggagctgatatctgccatctctgagcctcggcttcctgtgtaaaaagggaccctaacaggcactgctcatggttactgtgggacttagccccatgcagcaggggctgggtacattaaacctacccccaccagcatcctcacctcagctttgctagcttcccttgatggaacatccatcctccgtgcctccaaagctgaaactagccaatgagtgaacaggagaagggttcatcaacatttaggaaaaaaagaaggaaaaatcactttacctcctgttccacccaacaaaggccttggcatggaaaatggggccaaggccagggattgtgcctgagacaaagaaatacgaaatggaaagaagcttgggaggccaggggctcctgctgccagctgggggtgggaggggagagactgctactccctgggccattcaatctctagacctggcactccctgagactcaagacagaggctcaggcccaccctccactcagccttggcttctcactgtacatccagagggatggtgcattaaaaaccacactcatgcttgtttctgggccactgaccatgacttgcgggcagctgagcaaggcagcagcccagcctctgctctctgccaaagccagcgagtagccagagcctgagcttcccagccaaggcacagaagaagcataactcctgcctgtcctcttccatgtactaagggtagagcaggccaggctaagcctcaagagcaaacagaaaagagccactctggggtgctctataaacaggagaatagcagccgttggggcctcaaaggctgacccaagcagtttttatcctatttggaatcgaaagctaccagaggcagaacatcggtctttcgtatttagtgaaaagaagtcaatatttgcaaaagcgtaatcaataaatacaatctaccccacattaatcagataaagtcaggtttatagtgtctttttaagagacggggtctcactgtgttactcaggctggagtgaagtagtgcgaccatggcttactgcagcctcgaactcctgggctcaagtgatcgtcctacatcagcctccccagtagctgggactataggcatgtggcacctcacccagttaattttttttttcagagatatgcagtctcactatgttgccgaggctgtcttgaaatcctggcctccagtgatcctcctgccttagcctcccaaagtgctgggattacaggtgtgagccactgcgcccaacaatagtccggtttttaggggaaaagggaaacagcaataaagtctccgtaccctcaaactccaaaggccagggtggcctgcagggcctcagctctgggaagtagggtgctactgcacaggtggacggccttacctgtgggtctgagaaggctccactgatgtccctgtcaaaggaggagaaatgggtccctaggctcacagaaggttgttgaggaccaggacacacgtgccagcatcctgcagggagaagcacaatgggagaggaggtgagacacctggactctgatcactccacaccaatccaactgggagacccacaatgccgatggaccaagaggattgaacaggggacatctgactaaaggtgtctccattttacaaagggacccagcccaggacgattcaggaagcaagtgtctaactcagaattggtgacagatacaccccaacattgcccggcaccccttctacttaggaaaactgctcagggagtgggaactgagaccaccagcacacaccataagccatcctattttcaaaggcccctggagctctgtctcaaaccttgatttttcactcatgaaccccactgggattggaggacttcagaccgcagagaggaggctggaaaatgaggtaatgcaggaagaagagtgggagacacagtccgagaggatggcgtcctgatgccgggacaggggcatggtcatattgtggggtgatgcaaatggcttccagccttccagcaagcccctccagctgggcagagtgtgatctgactacccagaggccagagacaagcattcaaaacaaaatgaaaaaggtggagaaatggatttccaaagagtcgcaggtccaacagcctcagagatgacaaagtcttcacaggtaccactgaagccactacccaacccagggctcctacagggaccacagacaagccgggtagcccacctcgcagctcaacacacattcttgtttgcctgacacacatacaagcctcctgaccctgggcccagagagcaggtagcagcctacagggctctccaatgaccatgacagagaggctgcttatctgctggctatggaagctgggagtgtttcaggaactgatgcccaattccagggcaaccctgctttaggagctgaggacaggcatggtgggggtctcctcagacaccagtccatgcccgctaggggcaagcacagccctaacaaagggaaatggaatggtggctggggatggcaaagttatcaactgccaagtgaacggccagacagaggagggagagtggaattggggaggtgtgaagatagctagcaatacacagcagtgggaggtgtggctgcagggagcgggcggctcttccaaccccgccaccgccaccgcgtcctgcatgcccacccccgtgcaggctcctctgtgggactgaggctccatcgctgtcctgccccagccccttgtctccacggctgcatgtacacacccacatacacactcaacccccggaacagatgaaacagcccaggcacccacagcagagtggatgcaggtcccagccctcccagtgaccatgagcaagctggccttccagccttgcctctacatgccaccgtaggccacagttgaggccagcaactctgaagtctccccatgttcgaggtgaggaaagctgttgagagggttgagggtttgccatggtaacgcacccatcaatggcgagccagatttggtagaccagccccgctccagcccaccacaatgcttctcggcgggtgagaagggcagtggtgactcacaccccacagaattagatccacaggggctatgagaaaaaagcactctcagaacgcaaagagaggcactgcagggaattatgtttctgactaaaagtattaaaagtgaaaaaagtgaatgcagggtcaggctaaggagccaacccagtaggcagctacttggggaacagacctctaggggcagggggctcaaaacatccctggaaagaaattaaaatgtgctgctggctaactcagttttcctccagtgacccctcacataaatggtaaacagtgaatctgtccactgccctaaggggacatggaaagtcacaataaaacacaattccttgctggggtttgttgcatgtaatgtacgttccatacacacgtagtcacagtcctggaggggagcagggcatccaagaccaaataatacatcgtgttgctgtttcccaggaacaaatgtcatttcattcctttaagttttaaatccaaatcttcaatatacttttttttttttttttttgagatggagtcttgctctgtcacccaggctggagtgcagtggtgctatctcggctcactgcaagctccgcctcccgggttcacaccattctcctgcctcagcctcctgagtagctgggactacggcgactgccaccacgcctggctaatttttttgtatttttagtagagacggggtttcaccatgttagccaggatggtctttatctcctgacctcgtgatccgcccacctcagcctcccaaagtgcagggattacaggcgtgagccactgcacccagcctaaatcttcaatatactgcttgaatgatttggaaaactgcaggggaaagaaaaacaaaacaaaaagataccttaggggacaagaacaacagaagtcagaattgctttcctaaaaaattttcagatccctgactctgtttcagtccaagaaagtgaattagcaagtgaatctgtttctctatatgattcctattaatagaatatcagtctctcctcatccccactaaataaatgtcaaacaaacacttaaagaataccagtttgatggggtgccagctactagcctgcccagacgtccacacgtctcaggctggcccttgtggaaagtgtaagttccaaatgagtgggtagtgctgccgaagttaaacactgctgtctccagcctccgttgacatggcgactgtgaggcaggtggctaaggaatgggtagagagagacccatacgtatggtaggtggaaccacggcaaactgtccagagtgctgacaacagaccatgcatggcctttgactccatctggaggcatggttcctaatttttttcaatttagatataattcacacaccataaaacccgcccttttagccaagtgccatggctcatgcttgtaatcccagcacttagagagaccaaggcagaggatcatttgagctcaggagttcaagacaagcctgggcaacatagtgagaccccccatctttacaaaaattcataaattagctgggtgtagtggcacatgcctgtaatcccagctactcaggaggctgagttgggagggtaacctgagtctgagagatcaaggccgcagtgaactgtgatcacaccactgcactccagcctgagtgacacagcaagaccatctataaacccaacaaacccccccaccctttcaaagtatataggtctacggttattagtctacttacaatgttgtacaaccatcaccactatctgataccagaacattttcatcaccccaaaaagaaaacttgtacacataagcagtcacttcccatcctcccctcctccctgcccctggcaaccactaatctttctgcctctatgggtttgcctattctagatacttcacataaatggaatcatataatatgtatccttttgtgtctgacatccttcacttagcataatgtttctgaggttcaccaatgttatagcatttgtgtcggtatttcatttcttgttatgatggagtaatattccattatatacactacatcttgtttatccattcatccatcgatggacatttgggttggttccaccttttggctattgtgaataaatgctactgtgaacatcgctgtacaaatttttgtgtgaacatttattttcaattcttttgggtatacacctagttattcctaattttttaataagataacatcacttaatttaagacaagtaatgcatctgtattttgaaaaccttcaaaactcaaaaggataaaatggttagagggtgagagtaagtttctctcttgtccctgttccccagcacccagttccctgcccaaaggcaaattccagtttctggcgaatcctcccagagaccgcctatacatatacaccctgctttattttaaagacagcttgcatgggaggaacctggcaactagatcaggccggaatcaggctggaatcagcccagtaacgccaggaaatgagcacagtccaagtgccatttctcccctttgtcccagtgtgccccttggaaagccatgtagcctagaagaggccacggaactgggtggcaagaggagtcctggaggtaggtaggttctgaaatgtggtcctccatttcccagctatgaggcctcactcaagcaagctgcttaacctctctgggacttggtttccctatctaaaaaagaaagtggatactggtacctaattcatagaatggctgaagagtcgatgagctaaagaaagcaagtgcttagcaccatgcctggcacacagtaagtgctcagtgttttgctgccgctgtgattactaccgctgcttcacctcactgagctgatcttcagcttcctcctccggaaaatgaaggaaggcacctcccaggcacagttacggtgtagacccgagatccctgcatgagggccaggcgtgctacagcctctgagcagtggggactcagggaaagtcaggtggctgagatgtgtctccagctccctgcatgctgctccaggcccttctgaggctgggtctccatcctctcacccgcccacctccctgtattctcccaagaacagctctgaaccctccaccattacccaccctcccacaggccaagaggaggagctggcatcatggaccccatgccttgggcaggctggctggctggatttcttattttatgaccctactccccctcccttccatcttcttcaacaaacactgtactctggagctgagcttctctttcagaagcccagattattggaggcagcagggaaaccctcagagacgttcaaagtggagagacctccagtgaaggtggaagcatttgcagggccattaaaagactgttaggagcgatttttctctctgctggcaagtggcaaaagcagagcccaaagaacaaaacccagacctgggaaagcagagcaggggaagagaaactgaacaagccttgctgaaccatgcagaagttgatggagggaaaaaacccaatacgcgcccgcacacacacacgcacacacacacatgcacacacacacacatacacacacgcataacaaagaggagaaattcttagcctgcagcagttggtagcattatgtaaaatcccaagcccacaaaaatatcatttggatgataaaaagttaaatttagctaagtacagagtgactaatactatgagggagaggcagcacccccagttgcctggagctgatacagctggcttttagaaacttttgacaagtaaccagggccttgtgcagcacagaataacagattatgtaataggaggcaccaccatcagcaatacaaaacacagcacaagcgtgcagccttctccaagggagggaacagttgggttctggtttgagtggctccagtaggaccttgcttgggccatgggaacctggatattccagaggcatccaggagcacagccaggctttggaagggtttatgtgaatgggtctgcaaagatcttttcccagggtggttgccggggactgttactttggtggccttcaatgagccatgccctcgtggagtcccctcccttttaatctagcctggccttgtggcctgttttagccaacagtatgggatggaagtaacactgtgccaggtttgtatctctaagcttagggaggcctggctaagaattgaaagcaggatgcaaacaggtatttctgcaccaatgttcacagcagcaatcttcacaatagccaaaaggtgggcacaacccaggcatccacaaacagatgaacagataaacaaaatgtagtctatctacatgatggaatgttagccttaaaaaagacagacattctggccaggagtggtggttcacatgtgtagtcccagtgcttcaggaggccaaggtaagaggatcacttgaggccaggagtccaagaccagcctgggcaacatagagaaaccccatctctacaaaaaatacaaaaattagccaggagcagtggcacattcctgcgtctcagctactcaggaggccgaagcaggagaattgcttgagcccaggaggttgaggctgcagtaagccatgattatgtcactgcactctagcctggtgacagggcaagaccttgtttcaaaaaaaaaaaaaaaaaaaagcaggagaggagtgaggagaatgaagtggtggtggcagcctggatgcttctgcatttgaactctagggaagctgaagccaggtaagaagccaaccacttgtaccttgcccaacgggtgatgaggaggggaacggatgttccagccagcagccctagcagatacagccaagcaccagtaccatctcaccagccacaggagtgcagccagccaccttgtcaatgggtcccccaccccaagtagtcaagttgttccagctgacaccagtggcacagggatgagctaaccttaccactgggccctgcccaaattgccacactgtgagcaaataaataaaatggcattttgcatcactatgtttggacgtactctgttaagcagcaataggtaactgatggtggccaagctctctagcgggtttgcaggaagttctacttccatcataagactcatgaagaccttttgtatcctcacatatgagagttgctgagagacgttagtgcttaaatgagtcttaggaagagagtagtcttccactcccaatatcccaatggagtgaatgctgaaatgaagccggtgctgagtttcaaacagcggtcgtgaggctggggaatttctccagtgatcctacggagtaagctggccatcagatgatcaactcaagctgtcacttaattacacgactctctatctgtgcagagcaggggtttgcacactgtggacagagatatggatgggattccctgagtgcagtgaagtgatcattggcatgggattgagaccagagttctggctgctgactctgggtaagtcagctcggctcactgggcctctgtttccccatctgtagagtgaggaggctgggcttcatgacctctgaaagggttctcagttcagctccaacattctacaatcctatgatttggacagaagggaatactgacctgtaatccaaagccctgcatcaagtccaatgacttgcatctaggtttgcaaggcagacagaagtgctcactgggctcctcagacgtgtgcccctggagccctgctctgctctctgtgcccttcatggatttgttcattcattgttcaatatctcactatgacagactctggcatggtccaatttcctctccctaaatcatatgtttagccccctggactctaggtgaggctacgggactagttatatgagtaggggaggtccaccacttcaaagcctggcccccagaatgccccatgcaatctcctatgctccctctttctctgcttaccagccagctgactgcacagattcactggagaactccaggggagccccaagggatgggagagccacagtgtgaaaggatcctgggtccccaattcaccacatggaggccactcacagagcatgcaattcaactaagacaagagtggggataagcctttattgtgataagccactgagactagagaattgtctagcagttagcattacttaactaatacattcaccaaattgatactaattgtcagatatgtaggagatacacaggagaattaggctgaggtctaatcttagccttcttagaactaccagtctaggtgacagttcagggagattggatacagaccagttctgtactctgcgatcatgatgggaacctgctcaagctctatccatactgcctgcttccaaaaaccttacaacataggctcaccacattttcccaccaaacatgagatgagcaaagaaagaaagcaaccaaacaggagggagaaaatctctatcaaggctctaaattgagaacaatctaaaagcaaatgagtaaaatcttagctgtgtgcttcctggtaggcaaagcaaagagggaaatatgctgggtcacaaagctcttcccaatagtggaaaacattagttcatgatgagaaacagacattgtgcttgggaagagttctgaggggaatgtccacggggccagtgtgtgagggaatttgtgcctgggaggaggaagcaagaggaaaccaagctagcctggaaagctgtcagcctccagggtgtacggacagctttgcagccccgcctgcggcctgactggctcttaacggagagctcctcagagtaattcttcatcctcgttaatgtcaacacggcagcaccatgataatgatggaaaatatttacataccataccactgatgggttgtttagaccatctggctactggacatggtaagtattgtcgaacacatggcccttccgcaaatactgtgccttagtgctgatggaggccaggctgcagggacgtgaaacagtgtcactcggctgtgtccgtgtggcctgtgtccactgtcagctttagtcacctgcaggtcaggggcagagatctccagctcccactcccagatgtatctgggctcagcgttgatgacaatagcctaactattccctttaccaagggcctcttcaggactcaagtgatccaacaagacttaacgcagcaagacagctctgattctgtggccacctgggggatttctccaatgatctcctgggactgctgagaatgctcagaggaaaattcagcacagttcatttgtgtttgaagcagcttctgcctaagctttgtcatgctcgggaggtagggacaaggattaggtagcacaactaaaggctgtgctctatctagaagcatagaggatggtgattttttttttttttttttttgagacagagtcttgctctgtcacccaggctggagtgcagtggaaccatcttggctcactgcaagctccgcctcccagcttcacaacattctcctgcctcagcctcccaaatagctgggactacaggcacccgccaccacgcctggctaattttttgtattttttagtagagacagggtttcaccgtgttggccaggatggtcttgatctcctgacctcgtgatccgcccgcctcggcctcccaaagtgctgggattacaggcgtgagccaccgcgcctggctgaggatgtgatcttaatcacacctaaatgaaaatttcttcgttccatccatgtggctccatgagtactaatatcaggctgaatacagaggctttttttctgggtcaatgctaaatatttcttctttttcttttctttctttttttttttttgagtttggggtgttgagtggcttgttttattattattttcttaattttagtaagcaagaaaaagttctgttgggagcccgttcaaaagtagcaattttcttaatgggaagcatacgcttgccacccacgtgaggaggctgtgtcagctcagcaaccatactgccctgtgagtatggtgaagtcgtgttacctacttgacaaccagtgagtcaaagggaaactcatcacaggtgcctgtatggcctgccggggttttgctgcatagccgacaagggctttctgagggcacacctgcagcaaaggcctggctttggttttgtcaaatatgaacccgcagatttaaggtcaccttataactaacaccctctaagatttaaaatgccccaaccagagcattcaggacctgagttcacggactgggttcaagagccagttttgactccaactggctgtgagcttcgacggcccctcacctcctggaatctgtgttttggctgtgaaaggaggggtaagacaacaggtgtctaagcagcattctggtctaatagtcacaggttggctgggaggcactggcccagggcagcagcctccttgtcaagagtgccataggagttccttggtcttctataggactagtgcctttctctctgcaagtagagtgatgaccacagacctctcatatggagagtggatcatggaagagtcagagccctcagccagatgtggcataaagctaattcactgtcagtcacaccctggccagtgagagtgagctcacatccacatcctctaaaggcactgagatgtagtggcacatgtttcctgagagtaattacagtctgggatgatgacctttgctggtacaacacctagcaccttagggcaggatggctgtgcagaggccacacaatacctctgcaaagctcctccctgctggtcagacaccacagccccagcagggacaacctctctgagcacctactctgagccaccatgtcattctaaacaaacatctgctctgctcacctgctctttttgcaaaagttatctgagcccctggggaaaatggaaaagcataacgaagaccacacccagatcactgggtgcttcacttgaaccagcctccaaaacatccggcagcaggccagagacacacttcttgtttaaacacagagaaatgagacagccccaggtctcccaagttagagaatagaatcttctcagaacacacagctgctgcaggcccagcccaggctccttctctggggagctgactctggctccagccctcagaggcctctctgctgactcccaaaccccagtgagcaggtcagcgccaggcctggccaagctctcaccggttcaaggagaaatgagaacatggctaatgggccaagctgttcaaagagctccagtttggtggggtatggtggcacacacctgcgatcccaacactttacgaggccgagatagaaggatctcttgaactcaggagtttgaggctgcagtaggacatgatcatgccctccagcctgggcaacagaacaagaccgtgtgtcaaaacaaacaaacaaaaatcaaaaagctccacttagtttctttattcttagatctttcctacttcttagtgttccttttgttcatgagatgatagctacagtgaattatacctttttttgtgtttgtggttaaatacgcataacataacaattaccataataacttttttatttttattttattttatttgttttttgagacagggtctcactctgtcatccaggctggagtgcaggggcatgattacagctcattgcaaccttgaattcctggctcaaacaaacctcctgcctcagcctcctgagtaggtgggactacaggcacgcaccactacatctgactttaacataatttttttttagtagaggaaaggtctatgttgtccagggtggtctctaactcctggcctcaagcaatcctcccgcctctgcctcttgagtccctgagattacaggcttggactaccatgcccagcccatgtcaaccttttgtttgtttgtttttgaaacagggtttcgctctgtcacccaggctggagtacagtggcatgatcttggctcactgcaacgtctgcctcccaggctcaagtgatcctcccacctcagcctcacaagtattatagttgggactacaggcacacaccgccatgcccatctaacacgtcaaccatttttaagtgcacaatcatcactgccatctacctccagaacttcttcatcttcccaaactgaactctgtacctatcaaatactaactctccattcctcctgcccccagctccctggggaatctctttagaaatgatgtcaattggcctggtgcggtggctcatgcctgtaatcccagcactttaggaggctaaggcaggcagatcgtctgaggtcgggagttcgagaccagcctggccaacatggtgaaaccccgtccctactaaaatacaaaaattagccgggcgtggtgacacacgcctgtagtcccagctactcaggaggctgaggcaggagaatcgcttgaacctgggaggcggaggttgcagtgagccaagatcgtgtcattgcactccaacctgggtgacagaacaaggctccgtctccaaaaaaaagaagaaagaaagaaatgacgtcaacttacagatctgggaaatccaagtcgcaagcctgttgataggcctcctggtcacatctgagctcccccaaaaacataacctccctgaaggttagcttctggtgtttctcagatactcggtggtaaacaagctgacagagaaggggcaaggtagctgctgcccccaccctttaccaggaacatatcttccagaccacaacctgactacaggaatccaaaaacccaagagcccctcagtcgtgtgcaagctggcagctaatgggaatgaacagtcttaactggctatgccaggaactaccctacagcctgccctttgcggtagaaaaggctctcacacagaaggagttttctccagatttttattttacttaaaagctcttccttgcctggggttttgaggttgaaaaccactgcctcgcactcacacattgtaagtgggagtgtaaattggtactacctttatggagagcaatttagcaattgctaacaaaaataaaagaaaaacactccttgacccagcaattctacttctggaaatttattctacagacatgagagtatatttgcatgaaaacctacttattgagatgcctgctacagcactgtttgcttcccatcttctgctcttacaatctaaaaccccatcaacagggacctggtttaacacatgatggtccacccatgagcagaatactaagcccaccattacaagaactgaacaactctacatgagccaacagagaaccatctgcaggatttatgtattgtgaagtcaaaaaagcagatgcacaacaataggcagccatttgtgtttagctttgtttttaagtaatataggccaggcaaggttgatcacacctataatcccaacactctaggaggccgaggtgagaggactgcttgaagccaggagtttgagaccagcctagccaacatagcaagactccatgtctacaaaaataaaaaaattagccaggtgcagttgcacgtgcctctagtcccagctactcaagaggctgaggcaggaggactgcttgagcccaggagtttgaggctgcagtgagctatgatcacaccactgctctctagcctgggtaacagagcaaaccctctctctctcaaaaaaaacaaaaaaaaattaaattaaattaaatttttaggccgggagcattggctcatgcctataatccccacactttgggaggctgagacaggtggatcaattgaggccaggagttggagatcagtctagccaacatgacaaaaccccggctctactaaaaaatacaaaaattagccaggtgtagggggacattcctgtaatcgcagctacttgggaggctgaggcacaagaatcgcctgaacccaggaggcagaggttgtagtgagtggagatcgcaccaccgcactctaccctgggcaacagagcaagattctgcctcaaaaaaaaaaaaaaattaaaatttaaaatttaaaaagtggccaggcacagtggctcacacctgtaatcccaccactttgggaggccgacgcgggcagatcatgaggttaggagatcgagaccaccctggctaacacggtgaaaccctatctctactaaaaatacaaaaaaattagcctggcgtggtggcagatgcctgtaaccccagctactcgggaggctgaggcaggagaatcgcttggacccaggaggcggaggttgcagtgagcccgagattgtgccactgcagtccagcctgggcgacagagtgagactccgtctcaaaaaataaaataaaaatacaaaatattagccaggcatggtggtgtgcacctgtaattccagctacttgggagactgaggcaggagaatcacttgaacccatgagacggaagctgcagtgagccaagatcacaccactgcactccaacctgggcaacagagcgagactccatctcaaaaaaaaaaattaaaaagtaatatacattaatatatacagagaatctctctgaaagaggacacacacacaaaactagcaaccatcactgtctctgggaaggaaaactaagatattgaagacaggggtggcaagaagtcttttttattattattattatactttaagttctagggtatatgcacaacgtgcaggtttgttacatatgtatacatgtgccatgttggtgtgctacacccattaactcgtcatttacattaggtatatctcctaatgctatccctcccccatcccccaacccggcaagaagtcttatgtttgcctgtagctgcttttcacttcggtaccaagtataatgcattacttacttacccaaataatatttaaaatatatatgatctttatattttattactgaactgtaatctatgagtttgtaagttccataaggaatgtatctaatttatctttagaatcttgctaatgtctggtgcactatcatgcatagccttttcaatgtttcgttaaaaaaattttttttattttgagacagagtctcgctctgtagtccagatggagtgcagcggtgacatcacagctcactgcagccttgatctcttgggctcccttgatcctcctgcctcagcctcccaagtagctgggactacaggcatgtgtcaccatgcccagctaatttttgtattttttttgtagagatgaggtcttgccatgttgcccaggttggtctcaaactcctgggctcaagcaatctgcccacctcaacctcccaaatgttaaatgttttttagtaagtgaaagaatgaatgagtaaatgattctaaagcactcaaaaaacaatgttctttgaatcctagaaaattgtgagtcttgaattgttagagaaggaagaagttaggtagaagcaaaaacaaataaataattgatatctggatacaaaaagcagactcagtcatatcaaaggatgatgcacaccactgatggttcatttaagttgatgctacagatttaacaagagtttttaaaatttcaattctaattattttatgttttaaaatgccaatatttaatatttcttttggaatagcagaacgcaaagaaaatgcatggtacaggccaggcgctgtggctcacgcctgtaatcccagcactttgggaggccgaggggggcggatcacgaggtcaggagtttgagaccagcctgaccaacaaggtgaaaccccgtctctattaaaaatacaaaaattagctgggcgtggtggcaggcacctgtaatcccagctctcaggaggctgaggcaggagaatcgcttgaaccccagaggccgaggttgcagtgagccgagattactccactgtactccagcctgggcgacagagcgagactctgtctcaaaaaaaaaaaaaaaaattagggtttttttttttttttttttttttgagatggagtctcgcactgtcacccaggctggagcgcagtggcgtgatctcggctcactgcaagctccgcctctcaggttcacgccattctcctgtctcagcctccggagtagctgggactacaggcacccgccaccacgcccagctaattttttgtatttttagtagagacagggtttcactgtgttagccaggatggtctcaatcttctgaccttgtgatccgcctgcctcggcctcccaaagtgctgggattacaggcttgagccaccatgcccagcctaggctctaccttttaatcctgtgaccctcatatccctaaagaatcagaaagaagatctaaaaaccaagcagacccttcagtgagttgaatataactgctaagggttctgcagggattgatgcatatccttgggtaagcttgggaattcttgccctattaacctctcactcttgccctactattctccacaatccagtctggcaagcaagctgactacaactcccaccatttagaagagggccaacttgcagatcagaccaccaagcttcaggcgaaaagctgtcacaaagctggagggctttagtcctaggagaactgcacactgacccctctggtggtcatgcaaaccactatggttaaaataaggcagaaaattaaaagtagcaaaaccacactgagtgagtaaagaaaaagaactagggaggagggaggatgacttaggaagtatggccagcatgatgggttcagcctgtgggacagctggcagacacacatccatccaccccttccgtggcctccgagaacagcctgattcatgacattggaacttcagcttcatcatggtagccccagtcagctgaatgactcagcaatccctcaaagactgaattatctctagggttctctgttgattgaaagagaggcaagaattgcctttgagaaagatcaggataatgactgggaaaatgtgatgaagcttgcatgaatgacagcagtgatgaagcagtgtctgttctctggtttccagcaggagcaaaagatttacttccaacaaccaggctctgttcactggggtctcgtccaaacactgccctcagcatggtggtctaggggatgccagggcaagggaccacaaagctacagggaatttctgagagccctgcccttggagaatgcacgaatggttcatccctcctcaagtcacatccatcatccaggatgagttgagcttgaaataatggacttccaggctctgtgacaacgacttaatggtgcacaaatgtgttcaaaacattctggaagagtcctcagaataaccccactgagagatgctgaacaccctgcatcacgccacttacaccgctgccctccatttcctgggagtccaggtcgcaggggacccaggaggtgctggcagctgcctgaactgtccgggtgttactcttgtttctaaccagaaaataaggtcactggcgtgttgatgcccaagcaaacaggtgttagaggtgctcctacccatcaaattcaacaatggtttccactgacgcatagaaaaacaatggtgtttgcctacttattttgcaacaggctgccatactgtcttattctaattaattttgagtttgtctactttgaaaacctaagacaacggctgtatccactcaaaacattcattttgcaacctcctatctgagagttatgccctgcctctttttctttctttttttttttttttttgagacggagtctcgctctgtcgcccaggctggagtgcagtggcgtgatctcggctcacggcaacctctgcctcccgggttcacgccattctcctgcctcagcctcccaagtagctgggactacaggcgcccgccaccacgcctggctaattttttgtatttttagtagagacggggtttcaccgcgttagccaggatggtatcaatctcctgacctcgtgatccgcccgccttggcctcccaaagtgctgggattacaggcatgagccaccgcgcccagcctgcctctttttcctagcctgttgcattggcttgaatctagaataaagaacagtactaaagagagagaaggcatgcttgtcttgcaacagacattaaaaggaatgtgtcttagagcaacagtgcttcctagatgttatttggccctggaatgcttttttgatgcaatacccaggagcattctgtgttcctcaaacatactttggaaaatgctactagagcatttgactattaaggataaagtatctgagtgcggttgctcatgcctataatcctaccactttgggaggccgagggggatcacttaagctcaggcattcaagaccagcctagtaaacatggcgaaaccccatctctacaaaaaaaaaaaaaaaaaaaaaaaaaaaaaaaaaaaaaaaagcgggctcacacctgtagtcccagctacttaggaggctgaggtgggagaatcacttgagcacaggaggtggaggttgcagtgagctaaatcacgccactgcactccagcctgggtgacagagcaagaccccgtctcaagttaaaaaaaaaaaaaaaaaaaggtgggggggcaggcgcagtggctcatgcctgtaatctcagcactttgggaggctgaggggggcaaatcacaaggtcagaagatcgagaccatcttggctaacatgttgaaaccccgcctctactaaaaatacaaaaaattagctggccatagtggcacacgtctgtaatcccagctactcgggagactgaggcaggagaatcatttgaacccagagacagaggttgcagtgagcaaagatcgcgccactgcactccagcctgggcaatacagtgagactcgatatcaaaaaaaaaaaaaaaagataaagtagctaccgatgggagatattctttatcatgttgaaatatttgcctatccctcagtctctacgtttttaagattaatgaggctggggccagtgggctcacgcctgtaatctcagcacttgggaggccaagagggcgtatcacctgaggtcaggagttcaagattagtctggccaacatggcgaaatcccgtctttactaaaaatacaaaaattagccaggtgtggtggtgggcacctgtaattacagctactcaggaggctgaggcagaagaattgcttgaacccgggaggcagagattgcagtgaaccaagatcactgccattgcactccagcctgggcaacaaaagcgaaactcaatctcaaaaaaaggagtaatgaggctaggcatggtggcgcacacttgtagtcccaactactcggcaggctgaggcaggggaatcccttaagcccaggagttcaaggccagcctgggcaacatgggagtcctgtctctaaaaaaattaaatggataggccgggcgtggtggctcacgcctgtaatcccagcactttgggaggccgaggcgggcggatcacgaggtcaggagatcgagaccatcctggctaacacggtgaaaccccatctctactaaaaatacaaaaaaaattagctgggcatggtggcgggtgcctgtagtctcagctactcaggaggctgaggcagaagaatggcgtgaacccgggaggcggagcttgcagtgagccgagattgcgccactgcactccagcctgggcaacagagagactccgtctcaagaaaaaaaaaaaattaaatggatagtgaactttatcaaatgcttttctggcatcaactgaaagcacagtagttgttttatttgtatatttttctcttttttcttttagtagatctcctaatatttatgtttctgaggctggcccacaacccagcataatgagtcctgtgctgggtacttgtactgggggaacacagagacacagaaaaatgcatagagttcttgcctacagaggaaacagaggggagaggaacacggggaaaacaacacacacacatgaacatgcacactcctgcataccatctgaatggcaggctagtacttgtgaattttgttttgcgtttttttttttttgagatgaggtcttgctctgttgcccaagctggagtgcagtggtacgatcatagctcactgcagccacaaactcctgggctcaagtgatcctcccgccttggcctcccaagtgctgggactacaggtacacaccaccatacccagctaatttttaaaattttctgcagagatggggtctcgataagtcgcccaggccagtagtacttgtgaattaatgtgtcacacacagggcacagtgaggaccccagggaaccacatatgaatcatgctaatcccagagggcttccaggagatggcacagagcatttggggacaggctggaaatgagggcctatggatttcagtcctgccttgtgtgggacggaagggcacactttcctggcccacaattatctcagcagtaaaacagtagagataattatagatgcaaaagacctttggaaacacccagctctgcctccttcatttgcaaacagaagctaaggttgggggcagggtcatttgcccaaggccaccgagccatccttgtgtccttcttggctccaaggggaaggggaagagaaacaaaagaaagctttgattggcccggcaatcacgcctgtaatcccagcactttgggaggccgaggcgggcggatcacgaggtcaggagatcaagaccatcctggctaacatggtgaaaccccatctctactaaaaatacaaaaaattagccgggcgtggtggcgggcgcctgtagtcccagttacttaggaggctgaggcaggagaatggcgtgaacccaggaggcggagcttgcaatgaggcgagatcgcaccactgcactccagcctgggtgacagagcgagactccatctcaaaaaaaaagagttttgagatgctgggcagaaaggaaggtgagaacagccttccctgtaataaatgtaattgcttctacctgaaaaactggctgagtcaggaggtggccagggtgctaagcttagggtgtagaggccagaaataggagaggcttggacaggaaaaggggatgatcctggtgctgtcccccaccccaccctcacatgcctagggcaccagagacatccccaccttctattctacatcaatacacctgagcagacatgtgaggatggctttcacattcattcattcattcaacaaatatggagattatatgggttgaagaatgtcctcccaaaactcatatccttgtcagaaactcagaatgtgactttacttggaaatagggtcactgcagatgtcattagttaaggtgaggttgcactggagtagagtgagccctaaatccaatgactggtgtccttataagagaaaagtcacagaggcagatagacacagagggagacaaccatgtgacaacttaggcagaggttggaattatgtgtcttcaagtcaaggaatgccaagaatggcctgcaaccaccagcagctaggagggaggccgggaacagatactcgttgcggtctctagaagcaaccaaactgccgaaacccaaaatttggatgtgtggcttccagtactgttagagaatacattttcattgttttaagccatccagttgtggtgggttgttatggcagccctagggaattaacacagagatatggtagtgcacaagcccctgcatgcttgccctaggagcagaggctccaggaggcagagggagagtctggttccatctggaatccctccaggacatcacccttactcttgccccagtcacagaacctcaccctgccagccagccacaccttccactgcccttccagagcagctcctagcctgtgtctgtgctaggtcctgatggaagaagcagcccccagccaactgtgactgcttactggaagggatcatcacatgtgccagacacaaggatgaatccaagtgcctgtcaagctctgggaggtgccaggaactgtgctaggccctttcacatacattctcctttaaacctcaggaccaaccagaggcaggaaggaaagagaagctctgagaaagcatgtgacctgctcaggatcccacaacatgtccgtggcagaaccctgctccacattcaggctgtctgcatgaggcctgttgggttctcagcacacccagtgcccgattcccccaggactgaagcacctgcctctcgacagaactgtctcccactcgctctgcagctgtggatgccagggaccgcaggcagttggcatctgctctttgaaaaggtatttatctttccactcactgagagcaagcgagagccatataaggacatgcccaacgtcaggtgcacaagcgttgcagagacagatgtcattcatacgcagtgaccagacatggccgttaactgccaggaacacccacctccactcccccaagagcatggcgggtacactgctgagcaaggagctctcagctgggccacaggtgtggggtcgcctctcccagtgtctgggaaagccagggctccataaacacagggccaggtgtggtccagccccgagagccactggaggttctcagcagtattcatgaacagccctacaagcctgaaatttttgtttgttgtcattcttttgttcttttctttccctttttttttttttaccattttgacaatttataagtgtaaaatttagtggcatcaaggacatccacaatgttgtacaaccaccaccactatccacttccagagcattttcattatcccaaccagaagctttgtactcactaaacactcattccccatctcccctccccaacccctgataaacactattctactttctgtatctgtgtatttgcctattctaggtacctcatataagtagaatcatacaatattgtccttttgtgtctgacttctttcatttaaaatgttttcaaggttcatccatggttcattcaatacttggcaaatattatttggccataaagaggaatggaatgctgacacatattgtttgatggaaccaaacagtatggcatatgaacagaccacgttctgtttatccactcatcaactgctggacacttgagttgtttccaccttttggccgctgagaacagcactactatgaacattaagctacaagtatctgttcaagtccctgctttcaagtctcttgggtatagacctagaactaggtgtggaactactatgtcatatgggaattttgtgtttaaccacttgaggaaccaccaaattgtcttccacagcagctgcaaccatttgacattcccaccagtaacacacgagggtttcaatttctccacatcctcaccaatacttgccaaacctgaaattttagaggcagggaagaggcaagtcccataagagccccagatatggctccatggcaaatccctgccatctgcctacttcattcctgccattgtgtacagagcagcagaaagaagaatgctggctgtagagtcaggaaaatccaattctagttccagctctggtgtctgctggctgtgtgaccctgaacaaatacattgatcactcagagcctcaattatgtccactgtgggaatgaagccaatgcaccaaagtcacttcccaccacaggcagggctgtgaatctgatgccaatggaagagagagaatttgagtattttcttaaactctgtgggatgatagtaggtggtgggaagaagagactgtttcgatctcccttgataaatcttccatgataatgtttggaaaggactagaatacttttcccttcaacctcctcctctttccctgccttcaaatggagaatccaaaatacaggaaaaagtagaaacatgaggaatgtggaaaaaatatccagatgaactaccgaaggcaatcttagcatcacaattattaatgaacacacacacacacacacacacagacacacacacgctcctccctcactgtacacgaaaaagtttgctcaaatctctatgtccccagatccatgttggccagactaatcttgaactcctgacctcaggtgatacgcccaccttggcctcccaagtgctgagattacaggcgtgagccaccgcatccggccccagcctcattactctgaaaaacatagagactgagggataggcaaagatttcaacaatataaggaatatctccaaccaggagctactttatccattttttttttagatcgagtctcgctctgttgcccaggctggagtgcagaggcgtgatcttggctcactgcaacctccgcctctggttcaagctattctcctgcctcagtctcccaagtagctgggactacagacgcgtgccaccacgcccacctaattttttgtatttttagtagagacagggttttaccatgttagccaagatggtcgcgatcttctgaccttgcgatctgcccaccttggcctcccaaagtgctggggtctgccaagcccggtgaccacccctgagccatatgaccaggtaagagcacacccaggacattggtgatgtgatggaaaccaccactccacacctcctgcaagagtctgcggcggtgtcacccacagggtcctggacaaatgggcttcgcatgagtcagtgccaggaagccctccaggcacaaccgttcttgcacacacaaatgcctccttcaaaccaggctgcagggaggctcctctcaagccttgaaaacatgaagtgttccttcttgggtgcgcccaggacaggttttcccacttacaagggaaaaaaaaaaggttttacaaaatgcttagattccaaggttaagtaggcttttgagcctacttaactccaaaagcctatttaactccaaaataggcccgttgtgtggtgaactgtcaaaagcagcactttaacataaagctcagggccaggtggcctaaatttgaatctgttagccatgggaccttgaggaaataaggcctctgcgggactcagttttctcatctgtacaacagagctgactacagagggttgttgtgggatgaagtgaggctctgatattcagtaagttccccaacaagcacaggtgctgtagctggtgggcctagcaggagaaagctcagaaattcagctgcacgatagatcatgttttgttggtgggctagcctgggaacctaaccatgtggacagacattctcatggaaagcagcctttcgcagtgcccactctgtgtcagctggaaacgccccacaccagccagcactttacacatgctgaattaaatgtggccacacccagtctaggagaccacaaaggcagaagtcaagcaaagacgtccagggtgaaggtgggatccttcccggtggcaggaacaaacctgcagcctataggtaggttcaggttccatttttttaaaaaagcaaaaataaaacatgtttatagctaggaataatgtactttcattttaaatatttttaaaccatttgacgttttaaaaattttactgtgataaccatagtaacatatgacccccccccttaacaaaacttaagtgtaaaatatgttattgttgactataagtacaatgttgtatagcagatctctagagcttattcatctcacttgactaaaacattatgcctgtagattactaactccccattgcttcctcccctcagacctggcaaccaccattccactctctgagtctatgaatttgactactctaggtaccttgtataagtgagatcatgcagtatttgcgtttctgtgactgttctatttcatgtaacataatgtcctaaacgttcatccatgttattccacgtggcaggatttccctttttgtttggttttttagagacggcgtctcgctacgctgcccaggctggagtgcagtagctattaacaggcgagatcatagcacaccatagccccaaactcctgagctcaagtgatcctcccaagtagctgcaactgcaagcccgtgccaccctacccattttgggatttccttctttttcatggctgaataatattttgttgaatgtatataccacattttctttacccattcatcagttgatggacattttttaattatttggttttttaatttatctttgttaatttcccatgaacatacattacttaaaatttttttggccaggcgcagtggctcacccctgtaatcccagcacttttgggaggctgaggcaggtggatcacgaggtcaggagatcaagaagatcctggctaacttggtgaaaccctgtctctactaaaaatacaaaaaattagccaggtgtggtggcagttacctgtagtcccagctacttgggaggttaaggcaggagaacggcgtgaacccaggaggcagagcttgcagtgagccgagatcgcaccactgcactccagcctgggcaacagagcgagactctgtctcaaaaaaaaaaaattaaactcatttatcaaaaccagaaaaaataacaaaaaatagaaatttaacttggtgttaaagaaaagggcctccttcttgttctttctgactccccctcagtctcaatccctgtggccttcaataaatcaacccctcggcctcagcttatcttccatgtaatctagaacacagctcacaagattaagagtatgattatttaccatattacagctaattcacaaatggccttaaaattctcaaagcatgttgaatgcaactcctccttagtcacccagccctaagttaataattaagcacttggccaggcatggtggctcacacctgtaatcccagcattttgggaggctgaggtgggtggatcacgaggtcaggagattgacaccatcctggctaatgcagtgaaaccccgtctctactaaaaatacaaaaaattagccaggcatggtggcaggcgcctgtagtcccagctattcaggaggctgaggcagaagaatcgcttgaactcaggaggcagggattgcagtgagccgagattgtgccactgcactctggccagatagagcgagactccgtctcaaaaaaaataataataataattaagcccccttaattggtgaatatggaaatgtacagaacagcgtcataggcaccacagcacacaaaattgaccctggcctgataatggatttcctaagtcacttgctcatggagcacttccacatcgaaagttaattagcctaatgagggcaagtgtgacttcgtgaatgccagactgactttccgctctgagccagccacccaggcggctgcccatgtcatcctcctggattcatttcctggagcaccaaagaggcggaccaaggggacagaactacaggaggctatgtgtctcgtgccttccctaccactatctgttaggagtcagcacacattctgaaggccaccaagagccaggacacatacctgccaccttttcctggagctggccccagaacctcttcaggaaagggggccctctggcagatagaatcacaggtgagcccctctggctccttccagatcatggaaggccgaggtgggcagaagaaggctgtgccctaccaaccctcatactcatgactgatgaatacctgctctgtgcctgaccaggacaacagcagctcatgagtgtacttgacagctcataaagccaccctcccagccagtctctctgaatccacacagcagccttgagggaccactgctactgttaccaggtgggtattggaaccaaggcacagaaaggtgctctcgtggctgggtgcagtagctcacacctatcatcccagcactttgggaggccgagacaggcggatcacttgaggccaggagtttaagaccagcctggccaacaaagtgaaaccccatctctactaaaaatacaaaaattagcgggacgtggtggtgcgtgtctgtagtgccagctactcaggaggctgaggcaggagaatcacttgaacccgggagatggaggctgcagtgagccaagatcacaccactgtactccagcctgggtgacagagcgagattctgtctcaaaaaaaaaaaaaaagaagaagaagaagaaagcaaaacaaaagaaagatgcaactgtcagtggtcacttaccttggaaatgggacaactgatgtctctgggtccctaaaccctcctagttcagttgtcttttgttgttcctcatccagaggcaaaccaaagtcaaaatttcactagcccagaaacatctaaacgtctatcaatggatgaatgaagaaagaaaatgtggtgtatgcctacaatgaaccattagtcagtcttaaaaagaaaagacggccggtgcaatggttcacgcctgtaatcccaacactttgggaggctgaggtgggtggatcgcttgagctcaggagttcaagaccagcctgggcaacatggcaaaaccccatctctgcaaaaaaatacaaaaattatccagacatggtggtgcgtgcctgtagtcccagctactcgggaggctgaggcaagaggatcacttgagcccaggagttcgaggctgcagtaagctgtgttggtgtcactgcacaagcaacagagagagaccctgtttcaaaaataaaaatgtttaaaatggtaaatgttatattatgtatattttaccacaaaaaaaggaatgaagtactgatccatgatacaacatggttgaaccttgaaaacactatgttatgtgaaagaaaccagacacaaaaggccatacattatatgattccatttaatataaatatgaaatgttcagaacaggtaaatcaatagaaacagaaagtagatgagttgttgccagggggctgggagagggaagaatggggagtgactgccaatgggtgtagggtctccttctggagtgatgaaagtgttctggaattcgatagagccagtgagtgcacactgctgtgaatatactatataacactgaattatatactttaaaaatcctttcaattttataaaattaaattttaattttacaggctgggcacagtgattcacacctgtaatcccagcactttgagaggcccaggcaggaggatcacttgaagccaggagttcaagaccagcctgggcaacatagcaagaccctgtctctacaaaaaattaggcaattagccaggcactgtgatgcacgcctgtagtcccagctacttgggaggctgaggcaggaggatcccttgagcccaggaggttgaggttgcagtgagctacgattgtgctactgcaccccaacctgggagagagtgagatcctgtctcaaaaataaataaataaataattaaaatggttaatttcatatcatgtgtaaattcacctcagtttttaaaaacagacaatcgttggccaggcacggtggctcacacctgtaatcccagcactttgggaggccgaggcaggcggatcacaaggtcaggagatggagaccatcctggctaacacagtgaaaccctgtctctactaaaaacacaaaaaaattagctgggtgtggtggcgggcgcctgtagtcccagctactcaggaggctgaggcagaagaatggcatgaacccgggaggcggagcttgcaatgaggcgagatcgtgccactgcactccagcctgggcgacaatgagagattacctctcaaaaaaaaaaaaaaacaacagacaactgcacatctctgccttctttcctgctctgtccaaagcctcacctggtgcctctctttttccactgggcttccagagacccttcctgtcctctcccacacaccacatctgctggaatctactgcattttctctctgcatctgaggccttaacatggccagaagcttagaatctttctgggttattctaagcacctaggcaagactatagtgagagtaggaataaactggcaatccaccacctggagagaagggaggcccagccctgagacctcattgtttgctttctggggaatccctgtccatcccagaggccaagtagtccacttctacttttccaggtatgacttattatcaccccttccccacagaccacctcccccaagttttctttcatccagagatttaattaaatccctctttcaaatttagaaccaagttaggcaacctgaggaaacctaaaaagggataactcagtgtcccctggcaccccacaggctggctgggacacccaggtcctgggagctaaatcaagaggacagcaacgcaggtctgactctagatggtctgagaagttcaagggatgtgtctctatctagatcaagaaccaggttcagctgctctgaacatgcccccttaggcccccggggaacgcaggccctataactcctgctaaggggacctgagtcagaggttcccacactgggaccacctgcatcacctcttaatcctcttagcccagtggccacaggcccttctgctccttcagcccagaacagcccagagacagcaaggaaagtgggcacccccagaggacacagccaccagttccagcctcctcctccccaacctggcttcctgttgccctattcatgaggtcagctctgggcccctgctccttctttaatgagtcagagaacaaggaaaagagcaaaaatgagcaggctcagggaaagatggagactaagctggctctggctggaggtgagcgaggcccctcctccaggacaagccgctaggaactgtgctctttttaaaaaaatcccctgccccaccccctaacagaaaggaggccataaacagggatctgcttgaccagctgtcacccagccagtctgaacgttgttctcccttaaagggagaaaaaggcactgactctcaagtaagactcctaaaccccccaggaccacaccccagaggcctagctagaccccactcctgctctctaacctccagcctacaggtgcatggctggacaacttcacaagtaggtccaaatttggcctcaaagtcacatagacagatgtgatcccagagcatgtaatcctgtcttggtgaatctgctctaagtccatgcatccctttggcctctttgaaaaggaaaagctacagaacaaacagaagaggaattctgttttcctcttggaaaaaagaaaagggaaaaaaaaaaaccccatacaaacccaaattgaaaggtactttgtactgcttagactcaactagatcaggaaatactgatggattttttaaaacaacagcacaggctgtgtaacagaacatgaccaaacacaagcatgaacatgagggatcaggtctagagtccagccagcagttaactccctgtgtggtgaggcctaagtcatgacatctctgagtcttagggtccccatctgtgagacacaaaaaatgaaagcactgagggccataccatgacttctctgagcctcagtttcctcacctgtaaaatgggcacagcaacatttgtgagagtcctgtgaagcacaatgggcagaagtatgccatgcactgcggtgtcttagacaaaaggtgggtaagcgggaaaggcccctcccctctgcacctccagccactgcctctgcaagaacaatccacagacgctggatcactaccatgccactgggcctggcaccagcaactcaaacacaaatagctaagatccccccagcctgagaagcagctgggatacgccagggatgcctctggtttggaggcttccctggagaaagaagagcagccgtctcctggagagggaagagcagccgtctcctggagcaggaatcttaagcaccagaaaagcccataacacagagtcgacgaggctgggtatggtataggagccactggcctgaaccctgcaagcaccagtcctgcagctcccaggccaccaagacaaacctgagtgagctgcacgtcccagattttatgagccggcctccagctcactagctgtgtccttgagtcttaatcccgctccactgccaacaccccacacccagccctgtgatctcagggtttcagggaaatggaaagtcattcccctttgtggaaaggtcaaacccttggactcggttttttccagtgctccttctggctctcctatttgtttgattctaaattcctttatcccccctgctggaaagtcagacagaacattcctcaggaaagagaacttttagtgggggtgtggtggggaggaataattgaagtaaaatgaaaaatgggtgaaatcaggtactataaaatcttggtattcaaagagtgcacgacaaattgcaccggtcagcagtcactaccgtgaactcacaatgctctggtgagtcacccaaggctgggaactgaagtcaaactaatactctctatcacagtacaggacaggagctcagctgcatactaatggcaagaatccgctaaatgcatcccttgctactcccagcagcaaatgcataagctatttcacactcaaatataaattagtgagctattttccttgctgggttaatacaaatcgtgctctggaccaattaagtaagccacttcaaaactttgcttcagcgtattggaaaatgtcccgcttaggggaagaatgaagtctcgagtgatgcatgcccaactgatggcgaaataggtgagagtgctttcagaattcttgaggattttgttattaatggtgttttagtgttgggttcttaaacacatcaaacaaatttcctttaaactagtagttcctgactgccatggggaaggctgcaggcctcccacctcccagatggttcaaccacaataaacgtttggcctgtcagatgcacaacactgatgaactaattgaaatatgctgcaacaagcaaacccaaaataaatgtaaaataattgtttccttacacgataacccgctgaagtgcctccacgtctggccacccctgctgattgaatgttccccctgctccgtgagcctcacttatgtgtggttttcaaaggatttaaatgcttttttccagtgtgattacccacatgggaaaaattctaattgcaaaaaatgttgagtttttctccctcttatgaaaaaaaaaaaaaagcaagtgaaaagtcaactgttataaagtaccaaggaaagcacttaaatgggcccttcagtgtgagaggaagaatgtcctcctgttctccagagcaccgtcgccaagccagtgttaagcacgcatccacacctgtggggaagccctgcctctcagacaacctcacgccactgatgaaagctgggaatagccacctatttctaccctgacacacccatccctatccccctcccccctccctcgatccctccctccaaggggctgtctagagagacagcagagggtggagccagcagcacccataacaagctctcccactggctcaccacctcatgcaggacactggtgcccagtgagccctccctagggggctgggaagcccaagggcctgattctaatcccaggaggacaacagaagcaaagtgcacagccctgctccacagcacagcctgtgagtcagacttggaagggaagccccccagctgccaaaagagaaaattcaggccctccccaggagccacctctcaaaaggggaaataaacagctctgcagaggagaaacagtaataatccgtatgacgtacgtacgaactcttaagagggcacacaacaggcaaaagacttgggaaagcttcctctgagagagcccaggcataagaaggccacaatttgaggcatgggggccccaggaaccccccatcttggcctgaaacacctccgtaagaggattattcctttgggagaaggattggtctcagctcctaagaaaggccaagtctattgcagggctgccgccagaacccactgcatgaaagtacagggtccctcctacctgtagacttgagcagagagagatgggcaccattctgctggcagcagcccttctagaagaagctacagcagggctgagggaggacagcttgtctttctgtagcacctaagacaagcaaacacaagaatctgcccacagcctcatcccgcagctccagtcttcatccattaagtaccatcagcattgtgaggtgccctgagctaggctggatacaccgtgggggctgacatgatgccaaaggtggcagatcctcactatccatggattccatatttgtgaattaccctagtcactaaaatttatctgtaaccccaaaatcaatgctcatggtgctttcaaattcattttcaaatttgtgcaaattggcaaaaaatttgagttgcctgatggcacattccctgctgaggttgaacgaggggacatcctctatcttcccatctcagctctcctaatggaaacacgtgtcctttttgtggtctgtgcagtgccacatttttggcacttgtgtgctttgtgttggtgattttgctgtttggaatggcccccaatcacagtgctgaggtgcagtctagttcttgggtgcaagatgattatgatgtgcagagaaaatctcttgtgttagagaagcttcattcagacatgagtcacagtgttgatggccaggagtttaatgttaatgaatcaatgatacatattaaatagggtgtcttttttgttgttgttttgagacagagtctcactctgtcgccaggccagagtgcaggggcacgatctcggctcactgcaacctccacctcctgggttcaagcaattctcctgccttagcctcctgagtagctgggattacagatggacaccaccaaacccagctaatttttgtatttttagtagagatggggtttcaccatgttggccaggatggtctcgatctcttgacctcattatctgcccacctcggcctcccaaagtgctaggattacaggcatgagccactgtgcccagccaatttttgtatttttagtagacacagggtttcaccatgttggccagtctggtctcgaactcctgacctcaggtaatccacccgcctcggcctcccaaagtgctgggattataggcatgagccaccatgcccgatctcttttaacagaaacatatataaaataagattacatatggattggttaaagaaaatattgtccccgcaggctcaaaggagcctaaccctgtgttttccctaggagcagtggttcagtgttcactaactcagtgtttgaagagggactttatagaacataactatgttagccagcgtggtgcacaagtctgtagtcccagctactcaggaggctgaggcaggaggatcattgggcccaggagtttgaagctgcagtgagcaatgattgcaccactgcactccagcctgggagacagagagagaccctgtcacaaaaaataaaaaaagaagaacctaactatggccaacaatatgaatcaaataactatgcatacatgtatgcatagtcaggatatactttcctcagacagagctattccaccctacattcatgtgctcctaaggctgcaggttggcatgtccacacccaatagggagtttgagctgtcagcttctgctccaaggctggaatcagccttgaggtctcttgggtcctgctgctgctctgataacactctgccttttccctggacccatgactcccgctgacgtccctgatcatgacctctgatctttctgactagccaggtcttaataagacccctttccacaatagagataagggacttcagaggcaatggcactcaaggaaaagctttatgaagaatggggaacttcaacaaggagagtgtgaaactgatttttccatgctctctctccaaggttgtcttgggtttttgatttgtctgttaccggaaacctgcctgttggttaatctcctttgtgtcctctagcaagggcagttgttaatataagtaatttggccagccacaatggctcacacctcaagaggactgcttgaacctgggagttccagaccagtctgggcaacatagcaagacgtcgtctctactaaaaatatcgttctatcataaagatacaggcacacgtatgttcattgcagcactattcacaatagcaaagacatggaatcaacctaaatgccccatcaatggtagactggaaaagaaaatgtggtatatatacacatagtatagaatactatacagtcataaaaaagaatgagatcatgtcctttgcaggaacatggatgaaactggaggccattattcttagcaaactaatgaaagaacagaaaaccaaacaccacaagttcttacttataagtgggagctaaaggtgagaacacacggacacatagaggggggtaacacacactgggacttattggagggtggagggtgggaggagggagaggatcaggaaaaataactaatgggtactaggtttagtacctgagtgatgaaatgatctgtataacaagccctcatgacacaagtctaccgacacaacaaacctgtgcttgtacccctgaacttaaaagttaacagctgggcgtggtggctcatgtctgtaataccagcactttgggaggccaaggtgggcggatcactggaggtcaggagttcgagaccagcctggccaacatggcaaaacccatctctactaaaaatacaaaaattagcccggtgtggtggtgggcgcctgtaatcccagctacccaggaggctgaggcaggagaatcgcttgaatctgggaggcagaggttgcagtgagccaagatcacatcattgcactgcagcctgggcaacaagagcgaaattccatctaaaaataataataatttttaaaaaatacaataaaagtttaaaaaaaaaaaagagtaagcaaatgccagcctgcccctcctaacagcactcgtcgtgtctttgaccataaatgtttagcagaggtttgtcctggtgttgctaggttgggcgtgaggaggtcaatgctccatactcatttcacaggaaacaaggacccatgtacagggctgtcacttttaaaaaagagcattaaaccggtaatcagggacttgggttccaggctagaagagaggtcttgtgcaaatcacttctattctgccagcctctgcctctcatcctcaacagggtgcaggccctcccagctccagtcttctgggaccctccatcaaagatacagaggatttgaaaaaggcatcaccaggttccccactttaatatctggaccaattctctcctttcccaccagaagacctgttctgcagggccattgtgatgaccagagattttagactctaagtcctacacacctttacagttgctgtggactatcaaaactacccattcttcaagcccccttcaagtcccacttctttcaggaagtcaaccctgactgccttacccagaaagggcatctcctcctctgaactctaccttcaacaactcttatcacacataccctttgttccccatggactcatctccctaaccacactgtgagttagtgtgttaggtacaatgttacctttttatttttatttattttttcttttctcactctgctgcccaggctggagtgcagtggcacaatcataactcactgcagcctgaaactcctaggctaaagggatcctcccatctcagctacaggcgcacaccaccacgcccagctagcaatgttacttactatatttaattcacttatccatacagttttccagaagccttttgtgatgactttataaagaatatatatagagagatttatacataaacacacacacagaaaaagagacagttcaggaaagcagcaataaatatgctgatgttgagggtaatatagttgctagacagaatatcacattgtgtgctgagcagcctggaagccaaggagaagaggagaaacataatcagttggaaagacagtgtggtatagaaagagccacacatagtgtggcaaagaagcagaactgagtgcaaatccagggaaacttgggcaagttagttgacctctctgtgtgtcttaacttctttctctgggaaaaaggggaagaatacaacctaccctgcacagtgtgtcagggaggcccaagcacactgcatggtgcatagtatacaaacaaaacgtgttttccttccccactttccttttcattatcaaaggagaaagcaacctagtttcctgcgggaaggcaaagtttgcctggccctaaattctaaaagaaaattttaatatgggtcactgtaagaagcctttagaaaggggaaaatgcctcagattatggttttagagtaaaccagatgaggatttgccatggctctatttgataacattccagggtaccagtaaaagcttaataaacatcaaccaaatgacctacagagaagctgtgcaaagaccacttagccgcatctgtgtttggaggcagggagtcctgttaagcagctttcagggtgactatctgcaaagggattgatctcatctaagcgaagttgagaactggcgtacaatggctcattttggattgactctgcggtcataagcagtggctcctcctgcccatggccaaagacactggagcaataccactacgcttacattaaagagcacacggccctggcattttttccaaaaacagcaaggcagtgatctcaaagtaccagacgtttcctctgctaatctctacagataactgcacatcctctatgactggtcttctcgaagaccaagttggaaagactttaactagatgggctggttaggagagcatctatctgcttggtgttaaaacaggcctctagacacggaggaaggcaacgggtccccataacagagaatgtataagcaatcaactctggacaagaagggctctcagtggtgatctaggccaaccctctcactattttcctaagtaccttactgtgcagcaaagcattggggatgcagagaaacgtgatacagcactaaccgcccaggagctcacagtctagtggggggcacgtgtaaacagataagggccattctgtgtggcaagcaaatcagactagggtggttcgaaaatcagaagagggaccaattccacctgcgaaggccaagactgggtctcaaccagtgaagagttgaaggcacctggggagagggagggcatgggagcaccatgcctttgaaagcctctaggtagcctgagaggactgcagcttagggtatgaatgaaatggtaggagaggaggcagaaaaggtagacaggacccagatcccagggggccttagatacgcagaggaattctttcagattccataaggtgcaaccaaaaccaagagaaaccaagtgacttagttaagctcctgtagcaagttatgggaaaagccaggcctggaaccccagtctctcgactcccgcagtccacttctctcccctgctgcctcccacgcctgagcagctggggaagaccaggagagagaatggcccattcaacactcactacccagagaatctggagtctttgcctggccatcttcagggcagaggatgtactgtcctgttcacttggcaagccactccttacaagaaaaacagcccttcctaactcattgtgtttctctctgcagtgggagagggctggaagtccattccaaccacagaatacagtcccttcatggaaggaaagtaatttaacagcaacagtccaggaatcagacaagctatggtcccagaggcaagcgttggaggggccttctgctccacggagacactgactccacgcagggtactgaccagggcaggagaccagagatgaatcaactccagcccgggagctcaccgtccagcaggggagataaggcagatggaaaagtaactataaaataaggcagacggtgataagagttacacaggagatacagatagcaggcagtgggagttcagagcagagaggagtctgggggatggatgttaggggagattcagatgaaggggagcacttactgccttccctccagaagtggggggtctatcctagcagctctggtcactcccaggtggaggccggggagagagctggttgtggacaaagacagatgttccagtgaggtctcctttgaagaatcccgactctgggtgggggaggcaggtaggccggggtgtttggagaggcacccagcccacacttcagtgggagggagaggagtgcaggatgtctctgcaggagcaagtcggtggaaaggggacaagcctggaggacttgccttgaaatgacatttgcaccgcgcgcactatgttcacctggagtggccgtttgggatttcttgcggggaggcagtgcacactggggcgggggacactgaactttccctctccccaaggccccccgatcagccctgccacggataagaaaggattcggggtgggaagaagacagagccggcaccccattaccacacgaagggggcactgaggatggagacgggccacaccccaaccctgggcccccgacaagcagaggccacggcccgggcctggggacgttcagctggaggcgggaagcagagaaggcgggccgggggctcacctccgcttcctcccgatagccccttcctcgccctggcaccggcactgcccacgcctgccccccgaccgctatgacacttgtccctggcgggggtcccccacgcggtcgcgaccgacggaaattcggaaatcagcgtttcgggcacggatccagggccggcgactcactgaggccaggctcgggcggtctcccgagcggggctcccgtacgccacaccctcctccctgcccgggtctccgctccctcctccagcccccggcgggctggaggctcggcgggcgggcgggccggggcctctctgggagccgccgcccagatccccaggtccccggccagcgcccggcactgcgggactcaccgcgggcctgcggagcggccgcccggacgcactcaccccgctcggcgcggccgcgggctctgtcctcttcggggccccggctgggccgccgccacctcacgccgcctcacggggagcgcccgccccgcggccccggcccggccggctgcgccccgcgcgcccccgccgcctgctggccccgggcgagcggcagagccccggcgggcattgctcccgagcgtcgcaggcgggcggcggcggcgcacgtgctggcgggcggctctcgctgaggcggccgcgagctgagaaggaagcgccgggcgggcggccggggccggctggacagctctacgccgcggcgccgcggtgccccgcgcaccccagcggccgctgctgcccgcgcgcgccgggccgggctcgcattccctcagtggcggcggcgcctcctcaggccgcgcgggggagcggcggcggcggcggcgggggcgcgtccctgcggagtctcggcccggccccgccgcctccgccggaagaaacctctccgactcgggcagcccgcctggttcctcagacctgccgcggcgaccccgctcctccccggctcgcccgtgtcctcagggcccgggactggactcgggggcggcggcgcggatccccgccccgggctcctcgcccaccgtccgcagcagccgagcgcactcgggggcgggaaccggccgacttgcggccactgtgactcttaaaacagcctcattttaaaaaatgaagtttcttaggagcgaaatggtaaaccagggagggcagagcgcagcgggcagctcaccgaagcccagccccgggcgcggtgctcgccacacggtgggtccgcgctctcccctcaggacgcccgggccgcggcccagggaacggcagagccgggagcgcagccgtcccggtccccacctcagggagtagctggaagaggatcacgaacagtttaatccggatgatctggcacgacagggctctccaatgggaagagcccccggtgggggagcgcctggtgacattccttaaaaacatgaggtgtttgttaggttgagccagggtggacttgtttggcaaaatctgaagtcatggaactaaagagagcacacctaaaacttagtgatgtgtgacccatccctacttgtcaccttataaggctgaggagacggcggtgctcccctggaggagagaggacaagctaaaattaaggcggcctagatgactccagatgaagccggggaggccgagcccctgacagctgctcacctcctggggtcacggcagaacccaactgaacgggccaggaaggccatcgttcccgactcgcctccaggtgcccctgaccatgaccacgcagaggaggaccaaggcgtaccaccatcacctagaacgcttcagctccttccctccaccaagaggtgccctaggatccatccagaaagatctgcggagcccacagagtcccaacgggaactgtgctcctggatggacgccccttaacccataactcaaggacttctctatgcctgggacttaaaatcaccaacaacccgctcctgcagccagctagcagaaataaacacacaaaggccacacgccagttcacagccacaagtatttattgagtgcctgtagtgcaagaaagagagatggtccctgctcccgcggagcttacagcttcacgactccagcatctggctagattcagaaacaactgcagcaagcacttgtctacccaccagcagcactgtaaaaagcacatttctcacattatcggtcactgttacagtgaaattgttagatgtaaaaattatccttgaaatctgtagtcatagagatgacatggtacataatgtccagcaaatgcacatttatggcttgattcctcacatatctgaggggtctatggaaataaagtacaaatcaggcagaaaagacttagtaacacagttcctaagaatactggggtagtagtttattatcaaactaccatagagctcttggcagggcaggaaattatttccagcaaaatttgtgcaatatagtggatttaatcaaacctgcaactgtcaaccatacatggtccctcatgacaggtaaatataatctacctgtctgaatggtaaaaggctacaggtgtgcatttattttttaaagcttcttaaagactcatagcacaagtggcacattgaaatctagtgaaaacttgagataatctaaaaattaaagtgacaaaagtgtctaattttactacatatgtaggtgcagagttcagatttcaagtagcgtccagcaaagcacgtggcttttctgggcgagaaggggatagcttttggttggctatcacagactccacctacatctcctaacacccactggcaggcacttcctgtgcatggttctgcccacaagctgtcacctttagatgaaacatttgaaggggcaattatttggaggatactggcaataatttttagaaaaacaacctatatttataccaaataacccccaagtcaccaattaagaccaaagtgctttctgaacttacacgtgacaggttatcaaatttgttaaatttttggtggctaaaaaaccaaacacaccagagggatgcttaatttaaactccaaaaaagctcatttttttgcaaagcgtgaagagaacatcttagaccacctaacaaatgtcagtccaaggcagtttttaggtcaactgcttcggacataatctacttttttatttcagaaagtatgctacctcaaggctgggcgcagtggctcacgcctgtaatcccaacactatgggaggccaaggcaggcagatcatttggggtcagaagttcaagaccaggatggccaacatggtgagaaccccgtctctaccgaaaatacaaaaattaaccaggcgtggtatgcacctgtaatcccacctacacgggaggctgaggcaggagaatagcttgaacccaggagacaggttgcagtgagccagtatcacaccactgcactccagcctgggcaacagaactagagactccatctcaaaaaaaaaaaaaaaaaaaaaaaaggatgctacctcaaaaacctacttaactcaatgaatctgaaatataatatttcttgagcacttactaagcaccaggcactttacaaaatctcccttaatgaaaggagttttcttatttcatcttatagctgagaaaggcaggcctgtgccaggatgtgacccaggtctctctggctccaagtctctcctttcttgtcccctgagcccagctctgcacaaccctagcacggccactttagctacatctgttgcttcagttggaaaagtccttcagttgcaaagaccatttccatacctcaggagtagctcctgcaaacagaggcttagcaagggaaaggaagggggcagatccaggcatcaggggagagttcactttctatttgcattttaaaaggcacttcccagaggtggcagatttgcttagggttttttttttttttttctttttaaactattaatacctgcagcaaagccccaagccaacaacaaaaatagtttatacccggggataatagctgctatttagaattgccatctttcctgcttttaggtggagtgttttttcagttgagtgttcataagataagcattaccgaagagaaagacagcagaaagaactttccttggtatccctcttcacagctatgaagaaaaaagaatacattttttagaaataagtgactgatagctccaatctattacacacttcaaatatcaaagcatatgctgagagagaggcgcagaagatgttttgatggaggttaacgccttttttggaataagccaatataggctactaagaagataattccttggcaagataaaactatcatctcttctgaaatggcattttttaattcttaagaatgtagtagattttacaataaaagtagggaacaaggaaatatcctaacaattttcaagttagtttttaatgtcatatccaggaacacattaaaggtggtcttactaggtcttgacacaagctgtactggagcttgattaaaatgaacattttctttaccaagactagattttttttttctaaaggctagaaaaccaagaataaagaataccaagaataggccgggtgtggtggctcatgcctgtaatcccagcactttgaggggccaaggcaggcggatcacatgagttcaggagtttgagaccagcctggccaatatggtgaaacaccatctctactaaaaaaaaaaaaaagatatatacatacacacacacacatagacatatacacacacacaaaattagccgggcgtggtggcagatgcctgtaatcccagctacccagcaggctgaggcaggagaatcgcttgaacccgggaggcagaggttgcagtgagctgagatcatgccattgcactccagcctgggcaacaagggcaaaactccatctaaaaaaataaataaataaaataaaataaaaataaaaaacaagaataaaggcacttgattctaattataagtaattttgattagcctgaagtcttcaaaagttgcagagtagggagcaaaggttcaactgcactgtcagacaggccaccctccttgctgagaagggagcagggctgtggacccctggcctggggaccagccaggtgaagggtgctcaaaggtcatttgagagcctgcttggaataactgggatggcttggttcattctaactacttattattaagagccacataaagaggaaaagctcaaaagcaaaccaaaatttaaaacctgagcatgtttagtacgaatccattttgaaagtttggatgagtctgtttatcaacatgtaccgagctggaatatgtggggcactgcgttctgattggctaccaaaaactaagtagttacacagctccaacttaaccagcagtcccaacacaaacctgccaatgctcctggatcagaggagagactcctgcccacgtgctacttctgagagccagcggctaccacagaggcagtgggctggagccctctgcaaggccgaggggaaggcaccaggctccatccggacacactccctgtccattaacaaatacagtagattgtgatgatctaaagtctagtgttcttacagcacctacagtggaaatattttccttttggccagggtgaaggagtggaaaggggtgaacatatccagatgacaactatgacggacagctgaagccatgcacactaagaaaaccaggctgccctcttaatccctcacggggtggtggcttgtatttcaaagggtttatctgtccatttattgtccagggtgggacacaagttaattcagaacaatgggcagagagctactctgagagccctccagagagggctctccaattgtttaacttttttagaaaagataaaattagagaattacaatctctcttttttctcttacagacaataaagtttaaagaaaatgagttatattcatgtagttttcaaagctttccaagagtccattattactattctgatattcactctaagacacgtttcaaatacgaattgcattatcattttttaaaaacctcaacacaactgaaatccaaggtacactgtaattgtttatgtattcagcatgtactagtctatcattatggaagctattaagctttattttttaaaaactgaattgtatttacaatgtagaacaagtctataaaattgatgtgcagttaattgtaaaaggataacactatttgtttagaaacaagctgcttcctctgtttatatttccttattcttgatataaattggagacagatactatttaaaaataatgctttttaaatagtaaaatatacaagagattcctgagcataacaaaaatatcttgaaaatatgtggccatttgaagtataaaatagcaagtgtaagaatagcatgattgtaaaactactgtttgaaggcttataaacagtacaaaatagtttgccttttctgactgcataattatacattagtgcaaacaaaaatgtctcaaaatttaatggctacaaatctcaaagatttgcagaggtgcgcaaaacatggaatttctttagcgtcatgcgaactgaacccagttctcgattaatcctttccaaacgatcttccaaggcttcctaggtgaaaacaatgggaaaagtttaattagaattctataccaagttctataatcaccaccaaactgacctttcttttagcaaaagagcaagtataaacactaaaattacaattattttgctttctacacgaaacatcttatgatttcttttaaactggacaatatgaattagcttttcaactattccaaataactgctgtactttaaaatattctcaatatgtttgacacattgagtatatggaaattctagtaatagcaatacaaccaactggaagaggataattctttggctctgctgaagtgagaacagtacaagaggagcctaggaggtgcttcacacatttcaccagaagaaatggacacatttgatcagtgctgcatcccacacatacatagatcaaataactttcttctcaccaaaatttctaagttaaaaaggaaaaaaaaaaaacactgaaggatacttttcttaaaaaaaaaaatagatttcacaatgaattaacaattgctattttaaaataaacaatattactgttaaataatacctggactatatatcattatacatacttctgtgtttttgttgagacagggtcttgctctgtcacccaaagctgaactgcaatggcatgatcatagcttactgcagcctcaaactcctggactcaagcaatccttccaccttagcctctcgagtatctgaaactacaggcaggcaccaccacacctggctgattttaaacatttttttttttgcagagacaagatctcactatgtcacccaggctggtctcgaactcctggcctcaagtgatccacccacctcggcctcccaaagtgctgggattataggcataagccactatacccagcctcattttagttaatttattcagtattaattccaatggtgtcctgaaataaaacttaaaatttttttctttaattataaaaggattatagaacacttagaatatagaaaatttagaagacaaataagcaaaaaagaaaaaaaaactgttcctctttcctgttttttctgcatacatatatatgcataccacttttattttatttttttttttttggttgggggagacggagtctcgctctgttgcccagactggagtgcagtggcacaatctcagctcactgcaacctctgcctcccaggttcaagcgattctcctccctcagcctcaaaagtagctgggattacaggtgcccaccaccatgcccggctcattttcatatttttagtagagacagggtttcgccatattggccaagctggtcttgaactcctgactgcaggtgatctgatctgcccacctcagcctcccaaagtgctgggattacaggcgtgaaccactgcacccagccgtgtatcatttttaaaagaaaaataaggccaagcatgatggcttacacctgtaatcccagcactttgggagaccaaggtgggagaatcacttgtggccaggagttcgagaccaccctgggcaacactgcaaggccctgcctctacaaaaaaattttaaaaattagccaggtgtggtggtgcatgcctgtagtcctagcttactcaaggggctgaggcctcagaggtcaagactacagtgagctatgattgtgccaatgcactccagcctgagtgacagaatgagaccctgtctcaaaaaaattaaaagagaaacctaagaagagaatcaaactctatctcaatttttttttttttgagacacagtctcactctgttgccctgactggagtgcagtggtgcaatctcagctcactgcaacctccaactcttgggttcaagtgaacctcctgcctcagcctccaagtagctgagattgcaggcacaccaccacaaccggctaatttttttgtatttttagtagagacagggtttcaccacatcggccaggccggcctcaaactcctgacctcaagtgatctgcccaccttggcctcccaaagtgctgagattacaggcatgagccactgttctcggcctcaaaatatctttgaattaggccgggcccatgtgcctgtaatcccagctactcaggaggctgaggcaggagaatcagttgaaccagggagttggaggctgcagtgagccgagattgcgtcactgcgctccagcctggtgacacagcgagactccgtctccaaactagataaataaaagattagccaagacaaccccacaccttttaaaaaatgatcacattggcaggtatttttttttattattctttttcagagacggagtcttgctctgtcacccaggccgagtgcagtggcacgatctcagctcaatgcaacctccaccacccaggttcaagcgattctcatgcctcagcctcccgagtagctaggactgcaggcgtgcactaccacgcctggctaattttttgtatttttagtagagatggggttttgccatgttggccaggctggtcttgaactcctgacctcgtgatccgcccacctcggcctcccaaagtgctgggattacaggcataagccattgcgcctggccatggcaggtttttttttgttttttttgttgttgttgttttcccaaacatacaggtttcaggatggggaagagcttatcttcatacacggcaggtaggagtagaaattgtctcaaacatcctgggttacaacttgacatatatccaaatccttagaaatttgcatttctttggacctagcatttttatttctgggaatgactcctaaggcaatacttacacgtgcaaagagatatgtttaagaactttattgcagccttatttatgatatccaaaattagaagcaacccaaatttctactaaaacattcttggttaaatacgttactgctgatggaatattgtacgttaatttaaaaggatgttatagaaagatatttcataacatgaaaagttcaattgaaagtttatttttttttttttttaagactgagtcttgctctattacccaggctggagtgcagtggcaccatcttggctcactgcaacctccaccttccaggttcgagcaattctcctgcctcagcctcccgagtagctggaattacaggcgcccacccccacaccatgcccggctaatttttgtactttagtagagacggggtttcaccatgtgggccaggctggtctcgaactcctgacctcaggtgacccgcctgcatcagcctcccaaagtgctgggattaccggcatgagccaccacgcccagcctataaattattgactaatatttatcagaacaaaaagacaaagtcagaaaaaaagaagttgggggctgggcacagtggctggaactcctgacctcaggtgatacaccagcctcagcctcccaaagtgctgggattataggcgtgagcccctgcgcccggcctacggctcactttttgaacctctacagctattcagtttccaaagtgtaaccattttatctgcttgctaatggaaaggagttcagaaataaattacagatttgaggagggagaaatcaaacaaaaagagaggcaatctgtgagcactaacttagtgtaaaatctgttgaaaagcatattgccatttgctctcaagttagtttcttgaaaatacaagggcatgaacaccttcttctctaagtctaaaggtaaaatcaatttttattcctgaaagctagcttgcagttataaaattgctataatcaaacacttcccgtaaaagctaaaagttttgactgctgcttcagtgtgtctaattttcactgtgccatgattttttaaacccctcttagataactggaacactgactggcatcaagcctctaaagcagattcaagctaagacatttcacctgatttaatcttgtctgtaaagtgattcgtcctccaggagaaggcatcctgcttagtgctgcctcaatctgttaacacacgaaaaaaatatgtttaaattactggcagggaggtttatcacacagaatggaaagaaaaggttttggcttagtatttccttgtccatttcatctcaacttaatttccctctgtcaattagtaacgaccacatggctcaaatccgttgctagcacagctctggtatgttatcccattgtaatttcctgagacaggtttgactcaataattcccttctccttagacataagcattaagttcagaaaacaatttttaaaaatatttgtttgtttttacctggtccttttcttttgtaagttcatcaaaaaatcgttctgtttcagctagggtccgaatttttgctgtatattcaaaatcattcccctgtggagtgactgaaaccggcttacactgttcgtagctaactgatttattcttctcccaggctgttctcacagatactttcttcactccatttggcaccggttcagggcaagagctatgattaacatggttatcggtggctttctcagaataagttttttctgtcagagaggagagaaattgcttatatttcttatcaatttttcgtgtaggttgcatatatattaaatatgttgcccaatttcactttctggatatagctgctatgtggcccaaaaaagtaatgaaaagagatacaataatcaatcttatttactcagtgcttttttctccaaagaattctgaaagctttgccctctgtttgacaatctttgcaacttcccttaatgaacttaagcaaacttcatgtaaacataaatgaactttaagtaaacttaaagcaaaaaaaaaaaaaaaagcttaaaaactaaataatacatcacatttagtggacatacaccaacactaaacagttaatgttttgagggcctacccaagtgatttcacatacattgtcttatagctttattccaaatttagaatataaatgagaaaaaaaaagttacccaaagcctaagctgcatatagagaataaaagtaaagagaataactgagcagtgtggccctggtaattaaacatcaacattccctgtacctcagtttcccaacttttcaatgaggataacaacattgacataacaacacgtagcatcatgagtgcttagtttcagacgcccttgagtgggaaaatatttaagtgcaagatattataatatttagaacactgagagataccagaatctcaaaaaatgaatgattaaaaccataactaatattttttaggaaaagataccttccgagtcatctagaggaagaaactggagttgctttcttggattggtacgttgtaatgtagacacaggaacagtatctaaatcatccaaaagtatatcaaatctattgaatgaagcaagttacttgtgagaaaaaaaatgttaactgattttccctatctccactacaaagatgagctggcatccagctaactcacatatttatgtattttcttaaaagaaagctggttatgtaattgtctaaaactgaaatttatttctattttctaacaaaattgtatttacaaactaaagacttaaaacacttacccatacattatctcatttgatatttataaaaaccttatgaaataagcagggtagttattattatccccgttttatagaagaggaaactgaggttcaatgtgcttaactcatctccgcaagagcctgacagagttgggtctggaaccaagaagcaacatccctccccgctaatagcacacacagctgcccacacttcggaggggacagattctcagcagcacaggtaaacatgcatttggtgccagggccataccagtaaagcccactttcctgtacaaatggcccaaaagttttcccgtatcataaaccttttcaggaaaacaaagaactatcattctacatacaaaagctgacaggggtgctgaggtgataatttaaaatctagtagtagcaagtttacatagttaaaaactgtgttcattgtactgcagtactttagttgtagtatgacattcacttatgatttaaatgaaattcacagagttcccactggtaactgaaaaattagtgatagctagagacataagtcaacatttagaaaaaaatcactaatatagtaaactttattctacaattttagagaacttaccgaattggactgctctcatttttgctaagcagatgactaaatcctggggacaagttttctttaggggatcgctttggactataagccacagtcactggtgttagcataatctctctttttgctatagaagaaaatgaagaggaaatattcttttccttctatatgtatcagcataacagtttcttattcagtattttttttctaattttgaaaggaatataatttcaacgtaaaactttgagagagaaataagagtgtacaaaaaaataaaatcactcataatcctaacacctagaggtaaccactgtaacactgtagtatatcagacagtactttcagcactctgactcaaaactggtttttcaggattttagaagtcgactggaaataagatggaaacagcagtacactactgaacattcctataacacaataataagaatctcctcagctggtgtgaaaacggaaattcaggacaggaattcaatgcttcaactttaaaaccaacctgttattggctaaagaaaaatggtgactaatgctaagtacttgagatcaaatacataagaagtatatttgagactagcttggattaatttgattgaattaatgtttggatagctggcatttttaagtattagttgcaaacaatttagtggacacaataaattattagtattagttgtaaacaatttactggacacaataaaaaatctcactttaataaacagatttcttcatttacatttgtagtatctatgtgatcagacaattttatttatgaacaagatcttatttaggggtcctctgctcagagtactctactaggtgctgaggatacaagagaaaccagaaacaggcaagcagcgggcacaaatagatttgactcagagatcacgcttttgaacccaagagatgtacacatctaactcttacttggagtacttgatttacgatttgaaggtggtaaagatgatgatctctgtgaggccgaattaagtctcttttgtctctgttgggcacacttttctggagaacgacttgcattaactgaagtttcagtttgccgaggatttactacagcagaccaaaaaaaagcaaaacaaaaaacaaatcaaaacaagcctacgcttcagttatccacctttattaacaggtggttacacatggttacacaccaagccccacagcttaggttctgctcaaagcatttattctcaccagctaggttatagtgactatttgcaaatgcaccacattataatgataaaaaatgcttgatgaagaaaaatatgggagtttataatgaattcattctggctccctgtttacaatcggcattcaaggtgattttcaagagggttatttttagaaagcaggttactaatttatttactaagagacactgcttgggagatgtaaccgcaaagacgctggcaggatgactaaggggtctgagaaagcaagcatagtggaaaaggagagaaatgtattggtgacctggacctgtgaaaaaacacagtattaaagacactacttgccttatctacagatgctcagtaaccaagaaagaagaggaaatgttatatctcacttcatgaataccaaatgcctatcacagccttctgatgtgtgcaagtaagatggactgacaggaatttttcaaatatccttaggaatgccatgtaaggccaggagcagtggttcacgcctgtaatcacaacactttgtgtttacactttgtgttgtgttgtggaggacaaggcgggtggaccacttgaagccaggagttcgagaccaacctggccaacatggtgaaactccgtctctgttaaaaatattaaaattagccgggggtgctggagggcacctgtaattctaggtacttgagaggctgaggcaggatgatagcttgaaccctggagatggagtttgcagtgagctgagattacgcactgcactccagcctgggcaaaagagtgagactctgtctcactgtctcaaaaaaaaaaaaaaaaaaaaaagaatgccatgtaagcctttttcataatcggaatgtaagattcaactggctttgtacaaaaggtacatgttatgccagaactgtgataaattattaactaggacattcaattctctatgaaacggggctgaagtagcagtaaaatagcaagtttacagagctaaaacttttaatttcattacctaaatattttaattttaacgaaggtaatataaatggggaaaagatatctatatccatctatctcaaacaaggaaatactcactatttgaggtgtcctctttctctgtctgtgtcccccaatttttaaatatttttccctcatcaagttcttttaaagctctcatgatcggcgtgtctgaagtctctctttgcttttttatcaacaagcttgttgatgaacttccaggtgaagaatccttttccagaggtgaacggtgccttaaacaataattttaagacatacagtgctatggactaaatgtctgtatcttgccccccgcccccacaccaaacatacatgttgaagccctaatcttcaatgtgatggtgtgtggaggtggggtctttacgaggtaattagggttggatgaggtcatgagggtgaagcctccaagatgggattaatgcccttatgaaaaagggaaagaggcaggagcgctctctctgtgcacacacaccaaggaaaggccatgtgaggacataaccaggaagagggccctcaccaaacactcagcaccctgatcttgcacttccagcctccagaggtagagaaagaaatgtgtgttgtttatgccacccagtctacggtaatttgttataacagtccaagctaaaacacacactttactggggttgttaggggaataacagagttgacaattatactccacaatgagcatgctttgcaatgcaaataaattaaacctgcatacagtgctttcccatccttctagtcctacacttagaggaacagcatctgcacagcaccctggagtaagcggctgaggctgctcacgcaggctcggggctcgggctggccagagccatctgaagtgggagaggatctacatcttttgtttgtttttagacaaggtctcactctgtcacccaggctggagtgcagtggcacaatcatagctcactgtagccttgagctccccaggctcaagtaatcctcccacctcagcctcccaagtagctaaaactacaggcgcatgtcaccatgcccggctaatatatttattttttgtagaggtgggattttgtcatgctgcccaagctggtctcgaactcctaggctcaagcgatcctccacgttggcctcccaaagtgttgggattacaggcgtgagccaccacacctggcctgaggatcgacatcctatcctaatcacaaacccatactgtgccactgagcacaggtggggaagcttggcagagctcatggaagtaaaatattctaaaagtagtagcctttcaaagtaaaataaaagtcaggttctcaaaattaagacattaaagaaccaaagagagggcttcccaaacttttaaaagcaattgaaatctctaagaaaacataacatccctaaatagaatctttagcaaagttatctcaccctaggctacaggtttcctccagctggttatccacgttactgtcctgggtgtccagaggctggccagtaaagatggaatactctgcacctggaatcagccatttccgcctgctgacgtctgaagttgctagtgtgctattagaatgaaaacggtcaggcattataaaggtctgcacttcatttcagactgcatgtgcatataaaacaatctgctctcaaacagtatttacacatttgtacactaatttaaaaatcacatgtaacaatctatattttggatacaatttattttacagttttatgattcaacttaactgttgttctaggtttctgttacttctgaatctcagtcaagattcaggtacttgcggctctgaacattcccctcactgtctctcaggcatttcacaccctttacactctgtgcccctactgtagctgagggtaaagtgctgaaggaagcagggctgcccttcttgttcccttcagaccagcactgtccaacagaatcttctgcaaaaccagaaatgctatctgcactgtccaatgcagcagtcacaagtcaggtgtcactactgaacacctgaaatgtggctgctgagactgaagaaccaattataaaacgttaattttaataatgaaagttttcagtatcaaaatggagtcactaatgtcaaactcccaaaaaatggagctgggaggcacaaaggagcagcctctcacacagatgctgattatgggaactattctgaattcctcagaacgacagtattccagataataagctgcttgtacaaggaaacatccctaacaagggatgtctccaccactgagctaatgctaatgcctgcaacatgctcctgtaaccagtggtctttgttttaaaatagcttagtggactgtggactgccctttgtcttttaaagtttcctgtgtcccaacccctttggacatgcttatggttcaccacagcatgcgtactccagcttgcaaacccccaacatttccaaataaatttctttggagagtcagtctctgtcactgattttaggttgacatgattgatttaaatagtaatagtggctgttggcaggactgtactgaacagcgcaattctagacattgctcccccagctcatctgaggttcccaccatcatgttaacccccagtcattccccagactttagagcctgccttgttttctccacacctatgcctgttctcacactaggcaacttcctgaccactctctccagtgaggtgaccctctactcctcagccagccacctcagagggtacttgctggcttttgtcaaaaccagagaacacactccccttaagaaaccaatactccaaagactgtgcccctattctgcctcccgccctcaagcttcagcaacgtgacctacgatccttggcctctccattttccatttatcaacccctcctagtctgactaggtcctcttgatctaccctgaagtccacactcacgatactttctctctcacctttcaccacacctgactggcagcaaaatctgaggactggctgactacaaaggccgcgcttcaggtctcaactcctaccactgagctttgctggaaaaaagccaccagctgggcagactcatcaccacctcaagcggacaccccaaaccgcctgaccgcctggcaacatgactttcttttttttttttttttttgagacggagtctcgctctgtcacccaggctggagtacggtggcgtgatctcggctcactgcaagctccgcctcccaggttcaagcgattctcctgcctcagcctcccaagtagctgggactacaggcgcctgccaccacgcccggctaatttttttgtatttttagtagagacggggtttcaccgtgttagccaggatggtctcgatctcctgacctcatgatccgcccacctcagcctcccaaagtgctgggattacaggtgtgcgccaacgcacccggccggcaacatgactttctgtaaccagcaagcttcagttctccaaacatgactatctcacaccctttccaccctcctcaaacctcccatcccaccttcgttgacaggtgaaacttttgagtcaaattcaaagaaacaccagaaaccatgaaacaactcttgttttctctctgtcccctttcacaaccaaacattttagaggctgcctcttctatctacattcacttcaactccagtcactctttccctcagtttttttttttttgagacagagtctcactctgtcgcccaggctggagtgcagtggcgcgatctcggctcacggcaagctctgcctcttgggttcacaccattctactgcttcagactcccgagtagctgggactacaggcgcccaccaccacgcccggctaattttttgtgtttttagtagggatggggtttcaccatgttattagccaggatggtcttgatctgctgacctcgtgatccacccaccttggcctcccaaagtgctgggattacaggcgtgagccactgcgcccggcccagtttttaaattaagaactatttcagggccaggctcagtggctcatgcctataatcctagcactttgagaggccaaggcgggcagataacgaggtcaggagctcgagaccaccctggctaacatggtgaaaccccgtctctactaaaaatgcaaaataaaaattagccaggtgtggtgacgggcacctgtagtcccagctactcaggaggcttaggcaggagaatggcataagcccaggaggcggagtttgcagtgagccgagattgcaccactgcacttcagcctgggcaacagagcgagactccgtcttaaaaaaaaaaaaaaatcttcaaacattcttggaaaattacaaagaatactataacaagcatctactcacccattctcagttttaataaatgctaagatcttgccaatttttttttttcttgagatggagttttcctctgtcacccaggctggagtgcagtggcgtgatctcagctcactgcaacctctgcctaccaggttcaagcaattctcctgcctcagcctccacagttgctgggattacaggggcccaccactgtgcccagctaatttttgtatttttagaagtgacggggtttcaccatgttggccaaactcctaaccttaagtgatctgcccaccttggcctcccaaagtgctgggattacaggtgtgagccacgtgcccagcccgatcttgcaaaatttgtttttaattataagaccaatttttatatatttaattacacagaaggcataatgtattaatacacatttttaaatgtctttttttttttttgagacagggttttaccctgtcccccaggctaaagtgcagtggcatgatcatggctcagtacagcctcgacccctcaggctcaagtgattctcccacctcagcctcccgagcagctgggactacaggcgcgtaccaccaaccaccacacccagcttttttttttttaagacagagtctcgctctgtcacccaggctggagtacagtggctcgatgtcggctcactgcaacctccgcctctcaggttcaaaccattctcctgcctcagccctgtgagtagctgggatgacagctgcgtgccaccacatctggctaatttttttgtatttttagtagagacggggtttcaccatgttggtaaggctggtctcaaactcttgacctcatgatccacctgcctcagcctaccaaagtgctgggattataggcgtgagccactgtgtctagccgctaactttttatattttttgtagagacagggttttgccatgttgcccaggctggtctcaaactcctgggctcaagcaatttccccaccttggcctcccaaaatgctgaaattatagacgtgagccaccacacctggcctttaatgctttctctgttcaatattatgtttgaaatttatctgtgttagtacatataagctctattcatttttatcatttacccatagtatgaatatatttgtcctttctcccggcagtggaaatatggtttttaatatgcagcctttcgacaatgctaaaattaacacgtgtgaaaattcctctaaggcaaacatcttaacatgcaactgtgggatttggtgcacatcttcaacctctctgactgttgccaaatcactctccagacaagctgtatcaactgtcaatcattactttgagagttcctgtctctccatatctttgccaaacgttaaagtgtttcaattttaaatataacctgtccgatggtgtgaattgtatcttattgttttaatgtgcattttcatgacaattaacatgttctcatttttattagccatcagggatctgtgcgctgcttgttatattcttttaccattttttgttgagaaagttatctttttcttattgatttgtaagagttctttcatcttctggatacttttcctttattcgttcctgttcactttaaaaatacaaaatatcagccggggccaggtacagtggctcacgcctgtaatcccagcactttgggaagctgaggcgggcggatcacttgaggtcaggagttcgagaccagcctggccaacaaggtaaaaccccgtctctactaaaaatacaacaaattagcaggcatggtggcacgtgcctgtagtaccagctactcgggaggctgaggtgggagaatcgttgaacttgggaggcgaaggttgcagtgagccaagattgtgccattgcactccagcctgggtgacagagcgagactttgtctctaaaataaaatatcagccaggaactgtggctcacgcctataatcccagcactttgggaggctgaggtgggcggatcacttgaggtcaggagtttgagaccagcttggctgacatggcaaaaccccatctctactaaaaatacaaaaattaaccaggcatggtagtgggcacctgtaatcccagctacttgggaagctgaggcaggagaatcgcttgaacatgggaagcagaggttacagtgagccgagattgtgccactgcactccagcctgggtgacacagcgagactccatctcaaaacaaacaaacaaacaaacaaaaaacatatattatatatatatctcaagcacacatagacatacaggtaatattcatgccaaccatccagctttataaatcttggttatatattctttaaattaagagtagaacactataaagacaactaaagcccctgtgcacctctccaatctcattcgttccctcccaaaagcaaccatttatactaaatttgtgttcagcattcccatgcacgttttcatac

SEQ ID NO: 187 - DNA, 6262 bp, Homo sapiens
agaaattataagataagattatttggtgtagacaactagaatgagttgatcaacctaacaatgtgttgatctgtaagggttgaaagcttgataattttagtatgccagtaatacacagtacagcatacttaacaataagtacatcaaacattcattgattgccatactgtatgctaggcattgtaagtgtttatatatatgatttcatttaatacttgcaatactctgtaataagacggcctgtgttcaagttctggctttaccacctactattcaccttgtacttttggtgtcttcaactataccaatgaggatagtaatagtgtctatcccataggatttaatgagagaatcatatttaaagctctttgtataatggctgggtcagaaatgtgaacacagaaatatgtgagctattactatcttctaagctctattataaaatatatatggataaaatgagaccaagttttaaataagcatctgaacttccaaacataaatggggttggacttcaaagtggtcattttgggagatcatacattaatttcagtggtatctgcatttttcagtgattaaacatttttctacatcgtgataaatttacagctaagggaaatgctcttgtagaagaaaacaactatatttcatagttacatctttttaattttttaaactaaaaatgtactgctttgcttgatcaactgtatcatttatcaaacttgactctgaccaagtttttttttctttttctttttaatttctaagctattttcaaaggtataccagaattagagagcaggttgttatttaaaatgtgaactttgtgtaaatgtgttctgtatttgctgattgcaaatggtccttaaagtctacttggtggtaggcttttgttggcaattaatttgtttttaagtatttctgagattttagattgaaatactaaaagctgtcatagtcttttatttcctagtttaaatttcttatatttacttataactaaccttttatatttttgtttagtttttatttgacacatattaaactgcttctactgtacagggaaataagttttatttttataagaatgtttaatagccattaggtgtttagttctttttatcagaggatattatactattctcagttgtctttgcagttttcgtactagcaaaggagttggttactctgctcattttgttggcaactgtttaatagtcacatcattgaagtccaaaggaaaaggttttcagcattgtgtgaaatatgattttcaaccacgcaaggtaggtaaaagtaaatatttttataactcacctgttatgacagaattcttaactctccttttatgagctctgtagtattctctttcacgggttttcctatgcttttaattgttttctcttatccttgtctgcatttcctttttacttttatgtctaatttttgtcttctgtaagatcagtgttttgatatcttgtggtgtatttctcttacactctctcattatctcagtctgatctgttttatggcattctttcaatagatacttattatctactgagtattggataccattgtaggcactagggattaataaatatttgcctttttttaaaaaagttaaatgttaaacccccagattaagcaatgcacagacacattttttttgtgggagattaacctaatcctagtagttctgaatattgtttcctgagattgaaggttttgttaatttgtgatgctttaataatgctggcttcaaggagaggaatgttgctgtactgttagttttggctcatgaaatgtatctttacttaatatctcaaataatagcagagacaaggccaaaacacattttaaaaactgctctaaagagaaaatgcagagaactgtgcaactgtatgattagaattataagagataattcattcataatcaggtggcattttctagagggattttcctgcctgagtaccagactccatctttgtgtcagaataacaaaccatctgaaaatccagatgaaagaaaaccaggacagagtgcataggggtacccgtcacacatgtttaaggctttgttccccttccaggttcagggttctttcttgggtatatgacagtgagattatcaacgttttttagggcacactgcctcctcctaacagaaatattgccttaccctttgtgattaatggtacaatcataacagatatgatgaacccaaatgtggtgagggggagatctttatttctttttcgtatcttttttgtttgttgttgcttatgatctgatgtgtgtcttcccatatacggaaaaatatattattttgggtggtatttccaaaatttgtttagattttacatgattctaataaaaatatttgctttatatttaatgtcagttattgtcatttctgttaaagaatatcaatttaacagtaattcattaacatatacttagaaaatgatttaaaaagcaatgattctgaataaatatattcattcattataatggtgtattctttcttttttaatacaaattgattattttaataccaatcacattgcctttgctctggaaattctgttttattagaattaaggtgagaccaagatagtttgctaaaagtgccaaattattttgaatttcagtggaatagattagaagtacagttgttggtattataatttttcatgttaggattgtgtgtttttaacaaatattctaggtaacttttctcttcagacaattttaggaaatggtggtttaaagaatgtacaggcaaacaattagagtgaagttataaccaaatgaaattgtcattaaccaataaaaagcactttaacccatttgttctcactttttctattttgtgtcttcttcactgttcacttttggaaaacacattctcctttgtaaagctctcaatatgcagtgaatctaaggggtctagttaggagcagggccagagagtgatgtggattttaaaaagtcttttgtgaagattctcacaaaccttgaaaagtcataaatatttgcttttactgtgtttcattattcaaaataaattcattctcttgtttattcctctctttaattttccatagattccctagctaagttgttgttatccttcctaataagagatttactggcctttcaaaaagaaatctttacattaaagcttttgctttcccagctgtaccacttaaccagctgttagaacttgtgaaaatggatataaaccattagcatgttacctaatggtaatatgtgctctagacatattagctactattgatatcatgctgtacttttaattttcaatttattttcatatcttcaatttataatacatatcttgtggattcttaatatggatctttttattccttattactggttgtgtctttcttttataaatttctttttgagtctcaaactaaatgcagacttcagtatatatacataatatcactatgcacacatagtttccaagtttatttttattttctttagtcaaagtatatcagatcaaaagttaggcttttttttttaaccattgaaaaactcatttgtgtctgttatctgtagagtacagtttggtgtaccaaggaaagagaaaagttacttttcttgtaaataagtactatggtctttactgagatcagctcattaatcagtgcatttgtttattcattcatttaattttatcatatattattgttacaaccaaaagcaaaccttgataaactccaaatctgattaatttttctgtattaattatcttaagttaatggtacccttacccatctaagtgaaaattggaagccatcttagactcccatcttagactccccttttatatgttaacacttcctatcagttctgttagttaattcccatcctcattttaaaattatgagtgcctttgtcttagttccgcagcttatggtgtcttacctaaatctttgcagtggcttttcaattttatctttatccacacttgcctgcctatctcacctccacattgctgccagttattttctttaactatggagcagatcgtttcactttcctgctcagaattatttagttataccacattatgcaaaaaacaaaggcctaaaggtctgtttacaatctggtctttgcctgtttttgtttttgtgtttttcctgctaaacctacacactgaggaaagttttgtcaagcatctgtgctgtattgtattaagattctgcctggaatgtttttttaaccactgtctactgaacagttccttttcatccttcaagcttagtcttacagttcattttattcttttagtgaatatttctatgatagtctttcttctctatttgtctttccttcccagttacttatagtatttacttttattactcccaaatctgtattttagatactctctattctcataactgtttctctagtgaaacttccttgagtgtgtatatgttgtccgtctttatatacccatgatccaaggttgggatagggtacttggcataaagtaggctcagtacattttttgaatgaatgaatgcctttgaaaggtaaataataatcaattttagcataaacaaacctcatcatgggacatagtagataaaaacaaaatagcagtttagtcaatggtatgttatgtatgggtgccaaatacattaggaacttttcctcatagttttcatacattatctatttataatattcacaaggaatccacaaagtaggcattattattcccctttttcagagatgaaaataggttcagagatactaagtaatttgccaaaagccatagagctagtaacttgggaatccaattcatgtctttatgaagtaaaattcttcctgcccagtacattatctggagtagtaagaactcagtaagtattgtttgaatgagtactttttttaatagtaagtacaccaataagtataataatacatctagtatttatcttaaaactgtctttgggcaggaaatcttttcctatatgtaggcatttattcgtgtctcttctctttagaaatgcaaagtttacacattttattccacaatataaagtttgtgtcttctgtgttatttagatagcattctgattgaatattttcaaattcagtgaaggtaatatatgcaaactttaattcttatacttgtaaaattctataagattttccttaaatttatttgacactctttttacggttttttcttgataattttgtaatatttagaaacaattgttaaatgaatactttaaagattttctcttctgattttaatcagggctaacatatatgttggtttcaaatcaagtgaaagacttagtttccaataaattaatgattacctggaatgaaaaaacttaaaaaaggatgtgcattttagacagttaaatgtcttgacctgaccttgcttttatagaagcacactgttgttttgtattactgacttttttgagttaatacactgttttttttttctttttctgttttcttttcttttttttttttttttttgagacaaagtcttgccctgtcgcccaggctggagtgcagtggtgtgatcttggctcactgcaacctctgcctcccaggttcaagtgattcttgtgcctcagcctccctggtagctgggattacaggcacatgccaccaggcctggctaatttttgtatttttagtagacacggggtttcaccatgttggccagcctggtctcgaacttctgacgtcagttgatctgcccaccttggcctcccaaagtgctgggattacaggtatgagccaccgtgcccagcctatttttattttctaagttgaaatgaacaaaattgaattttgctcaaagtattttagataccttgaaataactaatattttagtgattaaggattattgtaactttttatttctgaaaatatatatgaaataattgaatagtgcatttaaataatctgtagaacaaagtttgtattttatattttggtgggagggagaaaccagttaattttccccccttaacttcagaaagcatacttgttcaaatgtttacaaatcatttgtatttttctatactttagaaaaaattatttctatattctcgattttaggctattaactctcaggagactaaaggttgctacagaaatcaaaccatccatattaaaatagatacttaaaatgctttttgataccagtaactataaaatgggcacttaatatgaact

SEQ ID NO: 188 - DNA, 79331 bp, Homo sapiens
aaaaagtaattttgttcttacctgtttgcagtccaagtttggttgaagatagaggtgtcactgaaggaattgcagaggattagggaatggactctaggagatttgtgagtgtattcagcaaatttctgggccaaaaagcctcccaaagaagcgccaaaaagatgaacctaattataaacaaatataaggcagattctgaaatactgatcaatcttgaacctgagtattaaaaagttgcttcaattatcactaaccacagaatatgttatcactagccaatagactaaaatatttacagcagctagaaatttagaaaatattgtatttaaatgcaatttatacagtccatcaagataatacaacttggcatccaagttatataattaaaaaaaatatcattcacagattgcattagaaaacaaaaccagtccaggcacggtggctcacacctgtaatcccagcactttgggaggccgaggcaggcagatcacgaggtcaggagttcgagaccagcctagccagcatggtgaaaccgtctctactaaaaatacaaaaaaactagccaggcatggtggtgcgtgcctgtagtcccagctactcgggaggctgaggcagcagaatcgcttgaacctggcaggcggaggttgcagtgagccaagatcgcaccactgcactccagcctgggcaacagagcgagactccgtcttaaaaaaaaaaaaaaaaagaaaagaaaaaaagaaaccaacaaaaccaagctagggaaatatggaaaaggcctgtatactaaaaatacaaaaattagccaggcatggtggtacgtgcctagagtcctagctacttgggaggttgaggtgggaggatcgcttgagcccaaaaggttgaggctgcagtgagccatgattgcaccaccgcactccagcctgggcaacaaagtgaaagcctgtctcaaaaaaaaaaaaaaagaaaaaactcaaaaccacttagtggtttatgtctaagaaaactgtgattcagtaattccacccctaaacacatacctaagagaactgaaaacatatgtcaacacaaaaacttgtacatgaatgttcatggcagcattattcatgatatccaaagggtaaaaacaacccaaatgtgcatcagctgatgaatcgttaaacaagatatggcatatttataaaaatatgatttaactgtaaagagaaacgaagtattgattccggcttcaacatgaatgaaccttaaactcacaatgctaaataaaaaaagccagtcaaaaagaccacatatgatacgattccacttatgtaaaatatctagaataggcaaatccatagagataaaaataaattaggttgcagggctagtaggggggaagatgaggaccgactgctaatgaatatgaggtttttggcattaaaaaaattataaaacattgactgcagtgatggttgcacatacctgggagtatactgaaaaacatggaactgtatacttaaaagggtaaattatatggtatatgaattatgttgcaataaagctattattaaaaaataaaagagggctcggcacggtggctcacgcctgtaatcccagcacttagggaggctgaggcgggcggatcacttgaggtcaggagtttgagagcagcctggccaacctggcgaaaccccatctttactaaaaatacaaaaactagccgggcatggtggcacacgcctgtaatcccagctattttggagactgaggcaggagaatcacttgaatccgggaggtggaggttgcggtgagccgagatcgcgccactgcactccagcctgggtgacagagtgagacttcatctcaaaaaataaaaaaaaaattgtatgtatgtaattagtttcagggtactcactttatccaattgtaaatggtctaaaagttttctgaatccatcacagaactcgagatggtcccaataaactggatactgcaactgaaataataacgataattttatttttaaaaatcataaaagtaaaaatgcaactcacgtatttgaaaaacttaggactcaaacactgacatttctcgtttgctcaagcgctgctccttattcaaaatatgtaaaaataagctctcactttttactaaacttcatatttcacatttttctaacagaccaaattaaaagagtataaaaagtaagcacactctaatgatattacgtgagtaacaatttcaattcccatcaatttcctttctaaatagctgaaaaagtctggggttcaaggatgaatacagcagaacccattccagtaaagaaataccgttttctcttaaatctaatttcattcagaattatggctcaggagagatggaaacaaaatttgttctaaggagagcttcctctctttttggtagcatttctttaagagggtattcagtaaaattgttcctcttcttttaaatgacttagttactctatttcatttattgtactttggggtgtctgtttgtttcttgagacagagtctcctctgttgcccaggctggagtgcagcggcgcgatctcgactcatgccacctccgcctcccgggtttgaacgattctcctacctcagcctcctgagtagctgagattacagatgtccaccaccacacccagctgatttttgtatttttagtacagacacagttttgccatgttggccaggctagtctcgaactcctgacctcaagtgatctaactgccttggcctcccaaagtgttggaattttaggcgtgagtcactccacccagcttgtttgtttttgtgatagggtctcactctctctcacccaggctggagtgcattggcacgattgtagctcactgcagccacaacctcttgggtgcaagcgattctcccacctcagccccccggtagctggaatcacaggcatgcaccaccatgcctggctaatttttatatgtatacttttttgtagaaatggggttttgccacgttgcccaggctggtcttgaactcctgggctcaagcgatttgcctgcctcaagcaatataactgccttaacttcccaaagtgctgggattacgggtgtgagccaccatgccaggctactgtacttctgtttgtgacaaaagaagtatggtacttgactatacgtagcctatctattaatgctggcaatgatgaggaaaaagaagtacaagtcacaaactcatttctaagggactcaggtttgtcccctaagaattccttttttttgtttgtttgaactggggtctcgctctgtcgcccaggctggagtgcagtggcgcgatctcggctcactgcaacctccacctcccaggttcaagcgattctcctgcctcagtctcctgagtagctgggactacaggcatgtgccaccacacccgactaattttttgttgttgttgtatttttagtagagacggggtttcaccatgttagccaggatggtctcgatctcctgatcttgtgatccgcctgcctcggcctcccaaagtgctgggattacaggcgtgagccaccgcgcctggccaagaattccttttttatatacatataaaaccaactggctgggcgtggtggctcacgcttgcaatcccagcgctttgggaggccgaggcgggtgaatcacttgaggtcaggagttcgagaccagcctggacaacatggtgaaaccccatctctactaaaaaatacaaaaattagccaggcatggtgacaggcacctgtaatcccagctactggggaagctgaggcatgagaattgcttgagcctgagaggtggaggttgcatgagccgagatcatactactgcactctagcctgagtgacagagtgagactccatctccaaaaaacaaaaacaaaaacaaaaaaactcccccaaaaacctcgtctaacaggcttactgtttaagcacttaggttcattttgttattgatgaatcactggaatggatactgccatatgaattatggaatcattttagatttgatgtatgactttcattattaaaattctatttgtggataagacttccaccattccaagaaagaatggggaactgattctacctagcagaaagtttgagaatttgagtcagatgatagcctaaaagaaaggggatgatactttcatggagtctttaatttataaatatccatgcccacacaggtgacaaaattatatgcaacttaatacatacaaacaaatgagttcaagcagaactggggaagcctgaatgagattggtagattgtagtaatatcaatatcctggttgtgattttgtactacagttttgcaaaggttcggcagaaactggggaaatgtgtaaaaggtatatttctctttactattttttacactgcatgtgaatctacaattacaacaacaaaaaaatttaaattaaaaagatctgtgcattttaactgctagatactaacaaatattaaataagttccaaaacctcatggagctgaacattctgatcacatcttgatgacaaaataattttgaagacactgttgaccttttcttgattaactctcctcctaatgaaacagggaaagcgcacaacaagaaccttgagagtgaagaagaaacatccagccagaagccaaggctctcatgacctgccactgtggagcgagaaacacactgctggacagcactcccgagtgggacgggcgcctatgggttgctcggtttccccctccctggctgatcaacaggggccaccaaaaatggtagtgtcatgtctcaggctgcagagggctgggatgagggcagttcccaccctgttctagaatgctgtttgtgaagaggaatgactgaaaatctgaacaaaggaggattatgttgcagaggctcaaacatgtcacgtgaggaatggttaaagaagctggagaaattaagccagagaagaaaagacccaggagaaaagcagcaggtagtgatgataactgttttctcaagtaagagacgggctctcaggaggaagaggaactgatttcctttgtgtggcctcagttggtggtaacctcagtagaattttcagttaccttccaaaaggagagacgtgacctgccttttcatccctttaaacagtaaataaaacgtacactaacagcagtactcccactgggagtaccacttacaagtgaatactgcaggcgactgccagctaaagagactctctccttcctggaaaattaggagaccaatgtcctgaccaatgtggaagcatgcaaaaaaaaaaaaaaaaaaaaaaatcagtcaccaggaagagtgcctttcccacacacctttctcccagagaagactcaagaatgatcagtgggaaactggatttagaccaaactcagctataaagtaacaatcaggaacaaaaaaacttcctaaccaaatgctaacatatgagctaattaatgaatctcacctcaaatatcaaagatttacatgaaaagccagcttttcaagtcacttgtatgttagcaaatccctttgttgtctaatattccatgctcagcaaccctggaagcagtgctgtgataaaatgaggagcagaaacagagccaggagacggagctcagttcctccctccaccactactggctgtgtgagccggacctcagtttcttcatctgtaaagaaggacaacgcttcctaccgctctgagttgagagaagggcgtcaggagagaatgcacgtaaatgctgggcatggagaggctgccaaaagaggtttgttccctctgaatctctgtgtgaccgtggactcacaccagcctccttcaaaaggcttcatctcacatattaaaataagcaaacagtatctttcctcaattaaaaaaactgcctggctgggcgcagtggctcgtggctgtaatctcagcactttgcgaggctgaggtggatgaatcatgaggtcaggagttcgagaccagcctggccaacacggcgaaaccccgtctctactaaaaatacaaaaaattagctgggcgtagtggcgggcgcctgtaatcccagctactcgggaggctgaggcaggagaatcgcttgaacccgggagacggaggttgcagtgagcagagatcacgccactgcactccagcccgggcgacagagtgagaatccatctcaacaaacaaacaaacaaacaaacaaacaaacaaactgtgcccattactatagctgatgagagacagaagcataaaaaaaaaaaaacacacaaaacgtgggtctgaattttaatcagtaatacttacagcgataacccggtaaccccatccagtcagagccaaaatctgccggaaaaagacatctgcagttccactgacagggggcaggaatatgagaggacacctgatacttcgggggcccgcgtcatagagcgaccatatcttactgtcatcatcatccacaataatctggagggaaggttaaaagaaaaaagtggaaaaccttataaatttgctttttatgttattttacactgtcatttcactgacaattttactactactgccttgtttgttacaaggtaacctggagctcacaccagattagcatgcatgacaaactcctctgatctccttttctttcctcagggctaacgtattccacagaactacttagaactactttataatcttccaaagggctgctgcttctctgtttcttccccctcctccttttttttttttttttttgagacagagtctcgctctgtagcccaggctggagtgcagtggcacgatcttggctcactacaacctctgcctcccaggttcaagcgattctcctgcctcagcctcccaagtagctgggattataggcacacaccctcatgcccagctaattttttgtatttttagtagagacggggtttcaccatattggtcaggctggtctcgaactcctgagctcatgatccacccgccttggcctcccaaagtgctgggattacaggcgtgagccactgcgcccggcctggatcctgtctctttaaaatacataaataaataaataaaaatacaacaacactccagcctgagcaacagagggagagatcctgtctcttaaaaaaaaaaaaggcaagctgaggtaagacaagtgctcagcagagtctggcagatgttaagtgtcctagaaatattagctattattattattcacggcatcctagtttaatttttgctttcacttttggtggtatttagaaaagtacattaactgcttaaacatttgacaatgcaaatcagtatttattctactttcatattaaaaaactcaaggcctccaggctcttttttctgagagctcctcactagcagggctatggactccacagtgtcactctgtgggtggcagcacactaaccagggtcactggcatcactaggagcagataaatggagcaaggcaaagtccagagaggcctaacagttccctttggacttccacaggtcacagatggtgataatgtatctcacgctcatgtttttgtcctgtgtatcttgccactcacattttttcttttcttttcttttttttttttttttttttgagacaaggtctggctctgtcacccaggctggagtgcagtggcacgatcacagcttactgcaagcttgtcttcctgggcttaagcaatcctcccatctcagcctcctgagtgtccgggactacaggcgtgcaccaacacgcccagttaattttttctagtttttgtagagaaagggtctcatcatattgcccaggctgatctcaaattcctaggctcaagcaatcttcctgcctcggccttccaaagtgctgggattacaggtgcacagcaccatgcctggctaattttttcatttttttatagagacagagtttcgctatgttgcccaggctggtctcaaactcctggcctcaaatgatcctcctaggtctctaaagtgctaggattacaggcatgagccatcacaaacagctgcaaaagatcttaagatcactggattctaacactcctgcaagggaatcagcaaaggttttactctactcagtgacttgaactgcctttgtctagtgtgatccccaaacatctgggattaatttgggaagcagagtcaatactcaactgcaatataagtgttttgggttttcaaacatcccaggaaaataaagcttctagaagatgactgtggcagaatgagtatgtcattgcaaacagaagctctataatgtgaccccattcttaaatctgaggaacaggaatataatctgactgtactcactatacagttgctgtaaactttccactaaactatacagaagagtacatacatacctgcttgcttgtatatgtaaaagcaattataaaaaatgagtacaggctgggtgcggtggctcacgcctgtaatcccagcactttgggaggccaaggtgggcggatcacttgtggtcaggagttcgagaccagcctggccaacatggtgaaactctgcctctactaaaaatacaaaaattagctgagtgtggtagcgcatgcctgtaatcctagctacttggcaggttgaggcaggagaatctcttgaacctgggaagcagaggttgcagtgagccgagatcatgcagtgcactgcactccagcctggacggcagagcgagactccatctcaaaaataaatataaataaataaataaataaaaatgagtacagttacacttgctttcactctaaaatgagtctcaaaagttgactgtacatgacagggaaggagtgaacttaatcctctgcaacccacagtcatgatactcggcagtaacctttactctcaaacactactaagacatgacatctaaatcacacacaaaaacaatacaagattttgcaaataagaggtatagtaaaaccatacatacctttttaaggggaactgtacctctaaaccagttataatcaggagagactttaatctctcccatgattagctgaaatggaggttaatcctgaaataaaagcatgtgatatttcacgtcaagaattcatgtttacatcagaactaaatgtagagtctcatctagctataccaacaatattttaaagaagaaagccaaggaaactggctattttgtcagtatatagtccaactacagaaaacaatttggtgaaatactacaatcacagaatcagaagcactcttttttttttttttttgagacagtctcagtcttgttgcccaggctggagtgcagtggcgtgatctcagctcactgcatcctctacctcctgcagttcaagtgattctcctgcctcagcctcccgagtatctgggattacaggtgcccgccaccacgcccaactaatttttgtatttttagtagggatgggggttcaccatgttggccaggctggtctcgaactcctgacctcaggtgatccacccacctcagcctcctaaagtgttgggattacaggcgtgagccaccatgcccggccaccagaagagctcttacagaaattattccaacacccttagttcttccagaaaaggaatctggtctagaaaatttaaatgacttacccaagatcacatggcaatgctaggaccagatgtgagacagccttttctgacaccatacttcctgtcttagttctcaactgcagtaccatcagttatcttttgacattaccttaagaatccctttaataaagatgctcctgtctgattatagggatagtccacgctagagaaaggagttgatgtttttttacttttttaatttttgagacagtcttgctctgttgtccaggctgcagttcaatggcacaatcacagctcaccacagccttaacctctgaggctcaagtgattatcccaacctcagcctcctaagtagctgagacaatgggcacacaccaccacgtcaggtgaattttttggttttgtagagatgggggcctccctgtgttgcctgcactggtctcgaattcctaggctcaagcaatcctcccatcttgcctcccaaagtgctgggattacgggtatgagctaccacacccagcctagagaaagaagtttaagttaagcctgcttcctgataaattcgcaatacaccataaatctaactgtaatagcacataaccagaaattcacatgtagttccctttttttttttttttgagacagagtctcactctgtcacccaggctggagtgcagtggcgtgatctcagctcactgcaacctccaccctccaagttcaagcgattctcctgcctcagcctcctgagtagctgggattacaggcacctgccactgcgcccggctaattttttgtatttttagtagagacggggtttcaccatcttggccaggctggccttgagctcctgacctcatgatccacccgcctcagcctcccaaagtgctgggattacaggcatgagccaccgtgccccgcctacatgtagttcttaatacaaaatacaggcaaatttgccactcatatggacgtgattaaaagttacacaatgtcctcagaaagatctataatgtaaacttgaaggcactataactaacaacaaaatgaaacatttgcccttaggaaaaaatgtgtagtcttttgttgtgagcttagtgacttctggttttcatagctctgtgatcttagataagtcttgatccttttggagtttgtttcctcatctatgactgtgttaccactgtgtccccaaagcttagatcagtgcttggcacacagcaggcattatctgttgattgaacgaataactacattctaaggagaatgaagggggccatccttctaaccctggcatctgtgagctttggcctagctgaacatcctcaactaaaaggctgcccctctttgctcaggcatctgtgctatgtcataacaggaaactgaaattatagttccctgttgcagattcttattgccaagtgaggaaattccaccaggaaggattcaaatatttgctttgtaccacttcctctacctcaagagcaagccttgatcctagcacggctaacacgaggtgagattcgtgagacctaactcccgggctgactctgaactgtcgttttagagggagttctctggactggcaaggaacaggggattctaaactcaatggaactcttccttggtggccctcgagatctgctccctcaggaacacagagccctcagtagactcaactgtgaccttggagacgtactaagctgaaccccgaggagacagcagatgtagacattctaacactaaacttgatttacaaccttgacattgtgataatggtctctcttctcaaagctaagatggtaattttagagaagtgtgttaaaatcataagttgctttaaagtaccaagaaaatcatcagccagtcttatactgaaaattagtgtgcacagatatatatagtgaaataaagaaaattctttgcatatccattttatcttaaatattaatatgttaaggccaggcacagtggctcacgcctgtaatcccagcattttgggaggctgaggcaggtggatcacgaggtcaggagttcaagaccagcctagccaaggtagtgaaaccctgtctctactaaaaatacaaaaattagcctggcgtggtggcgcacgcccgtagtcccagctactcaggagggtgaggcaggagaatcacttgaacccgggaggcagaggttgcggtgagccaagattgtgccactgcactccagcctgggcgacagagtgagactcaatctcaaaaaaacaaacaaaaaaattaatatgttaaaaaattttgccaggcgcggcggctcacacctgtaatcccagcagtttgggaggctgaggcaggtggatcacctgaggtgaggagttcaagaccagcctgaccaacatggcgaaaccccatctctactaaaaatacaaaaaaaattagccaggcatggcagtggccgcctgtaatcccaaatactcgggaggcgaggcaggagaatcgcttgaacccaggaggcggaggttgcagtgagccaagactgcactccagcctgggtgacagagtgagagtctgtctcaaaaacaaaacaaaacaaaacaaaacaaaacaaaaaacaaaaaaacaaaaaacaaaaaaaaactaagccattttaactataggctttctctaagctgattataacttttaattgaaagcaactagcacatatacttaattctggaatattttctacctggacagacttgaaatacttctatatcatctaaatacttcttaatggagacatttcctagtattgcattattagaaacaatctattctaaaggagggaaaataaaaacatgtttagcaaataacatctactcaatagatttataaaacaccttagctaactaaagccagaaagtgtgcttctagagtcaccaaatgggataaatcattcatagctttgaaatcagttgcaatgcacaaaccaaaccaccatacaaatacacacatacacaggcacacatattcacgcggtcatcctcttctttcccatagcagtaaatagaaagatgttccttaccaacagtcttcagaataattcacaaccacctcaggatgccaacgtgttaaaagtaatcttacaagatggagagattccactccgctgtgactaaatttttgtagagacaagtaattttaacacttgtgctagtttggcagtacatgaaaggtaaaatggataccaaatgttgcatctgaccaactgacgtctaagtgaaaaaaagatcactgctgcaaagggaaaacagctgtgagtggtatgaataggaaagtttgttctcctagctctctttcatccaccaaaggggtatacttttccaaatcataagaggaatattctgtatatggcaaaggttaactgagattgtgaccaaactggtcagtactgaataagaaagaatgtggaccatgagctcaaaactgattttatctctcatgattttgttcttcacaaaaacaaaagcacctgttcatgctggtgggaaaagagccacaatattagccttaatcttgcctaaggaaagccctcttcagggtgtgctgtggactccctgtcttctctggcccttgtgctgctggacaataaaaactgccagttgtggctgggtgcagtggctcacgcctataatcccagcactttgggaggctgaggcaggtggatcacctgaggtcaggagttcgagaccagcctggccaacatggtgcagccccgtctctactaaaaatacaaaattagctaggcgtggtggcacatgcctgtaatcccagctacgcaggaagctgaggcagaagaatcacttgaacccgggaggcagaggttgcggtgagccgagatcacgccattgcactccagcctgggcaacgagagcgaaactccatctcaaaaaaacaaacaaaacagcaacaacaacaaaaacaaattagctgggcgcggtgatgggctcctgtaatcccagctacttaggaggctgaggcaggagaattgcttgaacctgggtggcggaggttgcagtgagctgagatcacaccactgcactccagcctgggcgacagagtgagactctgtctcaaaaaacaaacaaacaaacaaacaaaaaaacctgccagttgtgactatgcccctatccctcatggcttcaacagaacctgccactttaaagtcaacaaaatcacctttatcaatgtttaagtcacataaccagcataattagtcagaggtttctgctactttatttcaatctatagttgatgtgcattgtggaaaatctgtgcttataaatactagccataacaaaatattagaagctgagagtctctgggagatgcaactggctttttaatgcacgtctccatccctcaccacagaagtacacagctatccttttcttagatctcttcaggggagatctatccctcttttcttcattgcattatctctaaaccttacaggaggaaaaggtgcctacctgacatctgtgacatctcttctcatgctcttgggaaaaaagcttttggaatttggacacagctattaagttactcctcagtggccagccgcgatggctcacgcctgtaatctcagccctttgggaggccgaggcgggcggatcacgaggtcaggagatcgaggccatcctggctaacacggtgaaaccccgtctctactaaaaatacaaaaaattagccgggcgtggtggcgggagcctgtagtgccagctactcgggaggctgaggcaggagaatggcgtaaacccagcagacagagcttgcagtgagctgggatggcgccactgcactccagcctgggcgacggagcgagactccgtctcaaaaaaaaaaaaaaaaaaaaagttactccttaatttgttgaatctttgtgccaaaaggagctgaaccagtgtaggtggagacaaaggaagcagcataaatgtctaacttataactccccaggaaaacgagaagaggaaaaatgagacactccggtcccgctctgttcctcatcccccgtttacaaaccttacacctggcccacactcagtaacaacaaagacatctatcactttcaggccgaggtcctgtctccaaaattactggcctctgctcacagttcttaaaagtttgctgagaaaaaaaaaaagaaagaaagaaagaaagaaatgttcctgggctgcagtcgtgtagccccaggatgggtttacaggaggatgccccggttaagccctgtgccgcccccacctcccgctggagactcacacacagctccccgccagtcccaccggtgacagccacacaaaggcagggtcacaagcacaccgaccaccccacagcccagattcggccccagacacacactcacaagggcacgtgatcacgtgcgtggtcacatggaccggcccactcagaacacactcacaaagtcacaccaaccaaggcagccacgcgccacacacacacacctacaaccccgcataccgcacacccagccgcttcccagggcttcgcccaccctcacctgccgtggccgcccccacgtcccttcccctccttcaggaggccgctcttcgctccagtacgagcgcgggccgtggaggcggctgggcccgggtcggggcgggcggcggagcactcgggacccacgggcacagcaggctgcgcggtgcgtgcgggaggccggcctctgagggggcggggcgcgtggccgagcgagcttgggccgccgcgctccccccgcccgaccgccgctcagctggcgcgagactcccgcttccgggttctcagagggcggggccacgtcgcgaggaaggggcggtgctgcgtggccccggcggtcgccacggcgacgggcgcggggggaggctccgtgggatgcttggctgcggctggcgtgaggagagggctgagttacgtctgggtcagccttagttctgccctacgtacctaggaggaggaggaggtggaggaggcgcctggccccttgggacctgcttcttctttcagttcgcgttttctctgtcgtgtacagctttggagggacacctttgggttccagactttgatgaacacaactttgtatactcttttcttaggaacattttttttcctttggcacaaccgtagacgctctccgtagtcctccactcaaagcctccgcttcctttttgacgttctggggatttctgggaacatacgcccacccatcttcctgttccttcatcacttttcccttaaaatcagagagaatattaatacatttgtaatcattgttcttaaggtgttgcagacgtcacgtcttaaggtgttccagacttcacgactccttttttattagtaaaatatttctgaaattatgataaggtgaataacatgtaaatctccttgttttgaattttttttttagggatcctgcaacaaggtcctgttgaaagtgcctctctctaatatgttttagggaaagcttgtaccctgttttagggcctgtagactttgcctttacctaggcaactgtttatgggattaaggtcagggaagattccaactaaattgcatcctacttagttatcacttctgtcccctggcccaggagccttgggttccactctagaacttggacaaatcccaaaagcattttccaaaagcacggtgacatacttacctttttctttctttctttttttctctaaatcatttctttcggggttgcaactcagtcgcaggaattcatcttttattgtaagcaccacatagatgtatagagcacgtttccgtggagtattttaagttgggggccttttctccaacatttggaatcgtttaatgggtggaataacttgcaaactactggttgtctctgaaactggttatggatattcattacattagttgtctattttcccaggtggtctcgaagcttcaatctagagcaaagggaatagagtgattccaccagtccattagcacatgattagcccataaataataggtactaaatgtatattgattgtaatcccagcactttgggaggccaaggtggacggatcgcttgattgagcccaggagttcgagactagcctgggcaacctgggagaccctgtctgtacaaaaaaatacaaaaattagccgggcgtggtggcgcatgcctgtaatccccgctactcaggaggctgagatgggagaatctgttaagcccagatgtcgaatccactgcaccacatcctaggtgacaaagcgagagaccttgtctgctcccaacaaaaaactatattgaatgaattaatgagtggaataaataaatctatccccatttccacatttgttcctaaagctgtattccttagaccccatccctagaccccatttagtaacagctttaatgagacctaatctatggatatacccgtatgttaaaagtcattgttctgttagtgtggtagtaaactttgacaattgacaataaaaaaaaatcactatgtagatatgttttgttacatatcaacttttattacaatgtagaccaatccaaaaataataaatgttttacttctttcaggaagggaaaccatggtcatgtttgtgtcctcagttgttccataacacatggcaagcacattgtccctttcctaatcccaacaaagaacatttaatatctgtgaattccagctgaattgtaatgcacaaattcaggcagcaaacttttgattcaggcaggtcccagtgcaggctgacctggtagacatggctgtaaggatttgcagctgttgtggctggggtctgccagatggttcccacagcaccaattcatctgtgagaatctcacagaaaaactggaatgttcacaaaatatgctgtgaacaccaagcaaagtaaacagatggccagctggctctcagaattacccaaacccgggctctgtccctcttaatttatcttttcacaggataatatttgtttgaaaacacacaaaataatcccagatccagaaatatccctatgcatgtgtatacataagtgaatgcacttttttttttttttgagacggagtcttgctctgttgccaggctggattgcagtggcacatctcagctcattgcaacctccgcctcccggattcaagctattctcctgcctcagcctcccgagtagctgggtctacaggtgcctgccaccacacccagctaatttttgtatttttagtagagacggggtttcaccatgttggccaggatggtctcgatctcttgacttcgtgatcctcccgcctcggcctcccaaagtgctgggattacaggcgtgagccactgcgcccagctgtgaatgcactttttaaaatgtttggagaggtatgtaccaagcagctaagtgattacctcggaggaggaactggggatggagggagtggtgaagaactttgactttggatttaatagttgagtttatattaaaatgtattcatatattatctgtgtgatcaaaataattaaaagcagccaggcatagtggctcatacctgtaatcccagcactgagggaagccaaggcgggtggatcacttgaggtcaggagttcgagaccagcctggccaacatggcaaaacccccatctctactaaaaatacaaaaattagccgggtgtggtggtgcacacctgtaatcccagctactggggaggctgaggcaggataatcacttgaacccacctgggaggcggcagttgcagtaagctcagatcatgccactgcactccagactgggtgacagagtgagactctgtctcaaataataataatattaataataattaaaagcaactatatttctgtaattcctctgctataaatccttcaatagctccccactgccttcaagctaaagttcaaggtatgcagagtagagcaggtctggctcttgactcagatctctgtggggccaaagtgctctagtcataccaactgcttgaagggccccaaacacctcctgatgtctcaggaagcctctaggcttttgtatatgccttccttccatttagaatgcctccctccagtgcacccattagagtgaaaacatttattttacccccaggaaccacggatgtgtaaaaaagtgaaagagaaacaaaacacttgctttttcagactaatactaattcttggaataccatccccttaaagctttacagggtacagtcgattgcagtgttatataccaaattatgctgagacccaagattgaaaatgaatgctctttcctcattgccagaccaagtctatgtaaaatgtatactgcactggattggaggaatcagacacaaagtgggtattcaggaactggcttagaaaaatgctgatgtggctattttagaggttactacctaaaggcattatcaaacagaagttatatatagttatttttaattaataatgtattagttgtcatctaggagttcagaaacctgagttttatctttgagcaaaacatatcctctgctaggtctggtttccttctctgtaaaatgaggccaaggctaaactaaattatctgtaagttctttccaattctaagattttagattttataaatttataagagatttgtcaaagaatctttacagctgggcgcggtggctcacgcctgtaatcccagcactttgggaggttgaggcaggtggatcacctgaagttgggagttcaagaccagcctgaccaacattgagaaacgctgtctctactaaaaatacaaaattagccagggtggtggcatgtgcctgtaatcccagctactcagggggctgaggcaggagaatcgcttgaacccgggaggcagacattgcagtgagccgagatcgcaccattgcactccagcctgggcaaaaagagcaaaactccatctcaaaaaaaaaaataaggatctttacatctttacagcagtctttcctcaaagctgcccttctctgataatattcctcctccttcttgcttccaatcaaactttaaaaaaaaaaaaaaaacaggccaggcacgatggctcatgcctgtaatcccagcactttgggaggccgaggtgggtggatcacgaggtcaggagattgagaccatcctggctaacacggtgacaccctgtctctcctaaaaataccaaaaattagccgggtgtagtggcgggcgcttgtggtcccagctactcgggaggctaaggcaggagaatcgtgtgaacccgggaggcggagattgcagtgagccgagatagtgccactgcactccagcctgggcgaaagagcaagactccgtctcaaaacaaacaaacaaacaaacaaaaaaaaacagcctacacacaaaaatgcttatttaacggaagcagtattttaatctctcagaaaagttaacgtttgtccattaactttttagaataaaagtttctaagcaaaggtaccacatattttgtatcatctgtcaacctagcatctcaatgtttcaacaatgtaaacaatgtaaataattaatgtaaataacaatggataatctaccttctggtagaagagcagcaataaaaattagtggaaagcaagagctgcacttctttactacaaaagatagcttctatctgtggtgtcttagaaaactttataaatcttagaggtaaaaaaagacagtgattacctggacatggtggtgcatacttgtagtcccagctatttgggaagttgaggcaggaggatacttgagcccaggaatttgaggctatgtgtgtgatcattgtgcctatgaatagctactgcactccagcctgggcaacatagtgagatcttgtctctaaaaaaataaaaataaaaaaaaataagactgatgaaatagtaactaaaataaaatatttttgaaattgtctagcatagtacctgcatataatgggcattcaattggcatgtgttcccatttctttttttctgagcaccaaagccaaacacattaaattccctaatcaaggataaaaatatttgcaaatagactcatggcaatagattagttaggcacactgattggaatctaggttaccagggcatacgttccagctccaccgctgagtagctatttaaaattctggaaaaatgaggatcaataacagtatctgcttcacttggttattgtaaagataaaatgagacagtccaggtcaagtccttacacacatggctagccctcaaaaaatgttagctaataatagtgatattgcgaacctactgtgtttcttcagacactgtgctaggtgagttcttttttttttttttttttgagatggagtctcactctgtcacccagggtggagtgcagtggcttgatcttggctcgctgcaacctctgcctcccggcttcaagcgattctcctgcctcagcctcccgagtagctgggattacaggcgtgcaccaccatgcccagctaatttttgtatttttagtagagatagagttttgccatgttggccagactagtctcgaactcctgacctcaagtgatcctccctcgtagacctcccgaagtgctgggattataggtgtgagccaccacgcctaaccaagtatattatttctattcctcatgacaatctttgcaaagtaggtacaattttaatttcatggatagggccatacatggagaggctcagtaaccagcctaggcttacagtcagtggcagggctaggctcatgtgaggtttgttgactctaagactctgcccctcaaagtcatatattttcaccttgaaattgtttgataaatatgaagaaaaatggtgaaaataggttgaactgacttaaatacaaagtataaagcaacaaacatcctttgggtagctattctcgagaactcaattttatgctcagaaatgtttcttttgtcccccaaaccaaatgaagaataaaatccttctttaaaacaaaatctcctgtagtctttgggttctaatcctagtattgtcactacctagctgttgctaggcccctgtttcatcatctctaaaaagaaattttgagttatatagatccttccctacttgaaaattcttttgctcctattggtctaaagacatttccaatagcgtaaaagttcctctaaaaactacaaatagagctaccatatgattcatcaatcccactaccaggtagtcatccaaagaaagagaaatcaatatatcgaagagacatctacacgctcatgtttattgcagcagtagcctcaatagccaggatatagaatcaacctagatgtctaacaactgaagaatggacaaagaaaatgaggtatatatacacaatggaatactattcaaccataaaaagaatgaaatcctgccattcaaggcaacatgaatggaactgtaggacattatatttctcagggtcctccagagaaacagaaccatcagaatgtatgtgtagagagaaagatttattataaggaattggctcatgtgattatggaggctaaatccccaaatatgcagttggcgagcttgacaaataagtgaaataaaccaggaacagaaagttaaacactgcgtgttctcattcgtatatggaaccttaaatgaagctgatctcatagaagtagaaagcagaatagaggttattagagacctgaaagggtagaggaaaggaagggatagggagagatttattaaaggatgcaaaattacagctagataagaggaacaagttctagtgtttcatagcactgtaggatgaccatagttaacaataatgtatattttcaaatagctacaagagagaatattgaatgtttccaacacaagaaatgataaatgtttgagatgatggatatctaattacgttgatctgatcccctcacattattatatgtgtcaaagcatcacaatgtactccataaatatatacaattattatgtgtcaataagaaatcaaaataaataaaggtatcttcttccacaagctgttgctaccattcagaggagaaaatgttgtaggcccaaagaagggattatagtagcatttgactgtggtgatgtatcagtcagcgttctccaggggaacagaaccatcgggtgtatacatatatagagagagatttattatatggaattggctcatgtgattatggagtttaaattccaaaatctgtagttggcaagctggagacccaggagagctgatggtatagttccagccaaaaagccagcaggctcgagacctatgatgaactgattttcagttcaaatctaaaggcagggtaaaaaccaatatcccagctcaaaggcagtcaggccggaagaaatccttcttactcggcctttttgttctattcaggccttcaactgactggatgaggctcatccacattaggggggccatctgctttactgaatccattgattcaaatgtgtggggctttttgttttgttttgtttttgagacagggtctcactctgtcattcaggctggaatgcagtggcacaatctcagtgcactgcagcctcgacctcctgggctcaaacaatcctcctaccttagcctcccaagtagctgggaccacaggcatgcgtcaccacgcttagctaacttttgtattttttgtagagacagggttttgccatgttgcccaagctggtcttgaactcctagactcaagtgagctgcctccctcggcctcccaaagtgctgggattatagacatgagccaccatgcctggcctgattcaaatgttaatctcatccagaaggagcttcacaaacacacccagaataatgtttgaccaaatgtctgggcacctgatggcccagtcatagacataagattaaccacagatgacaacaatagctaccatttattgagggtgtactatatgccaggcacttcccagatgtattcctattctgcaaggcaggtattacacatgtttttaaactgagaaatgagttttaaaactttcagcaacttgtcctgagtcactcaactagtaactagcaagaaaatttgtttttgagtctgatgcaaagcatatgtttttcagcaatgacaagaaccaaaatagaagcatcttgcataaggaggcaacgtatttgcaaatacatcctttcaactaaagcataaagtagactgtgttctaccttcctgggaggactctggactctgggccaacacgtagctcagattaacatgcatctcttatgctagttaaaactattaccgctgtagcagaaaaattatttgatgagtgtggtaaactgcagagtcccatatccagagattctgattcaatgtcggcagtagagtccaggaatctattccaggtgattctggttcagatgagaaacgctactcagtcacactggattgtggtttctacaggggcctgaaaaaagagtgggtcatatggtttcctgaggcctgtctgggatgtgcatcatttactttcttgaagaaataggctgccaacttgaagatggcatttccatacctggtgtttatcctccagttccaggatgagcttgaggctcccttgatggggaactgcacactgtaggatgggctttgcactcttacctcaagatttcagatgtatgaaaggtatttcatacagtcctaggtataccaactgtgccagtccaatttcacagccccttatgctgctttttctgcagagtggaatcactggactggggtgggccttgattcacagtctggctaaggactagacatggtctggcacaaaaggttctatctggcaagggcaatgataattggctagacagtcagacaggctccacccagaatgtggggtggcagacctgaggccattaactagtaggtagtaagagatcaaaactgctaagtagagagcacacatgtcatcagagaaactatggggaacgggggtcagggagtgacggtaaccaaaggaaacctccgagttgacttgctccgaatggctttctagtccttcctactcatattcctacaataaaatccccatttctttctttcttttctttttttcttttttcttttttttttttttttttgagacagagttttgctcctgttgcccaggctggagtgcaatggtgcgatcttggctcaccacaacctccacctcccgattcaagtgattctcctgcctcagcctgtcaagtagctgggattacaggcatgcgccaccacatctggctaattttgtatttttagtagagacggggtttctccatgttggtcaggctggtctcgaactcccgacctcaggtgatctgcctgccttggcctcctacagtgctgggattacagacgtgagccaccatgcctggcctaaaatccccatttctttaaagtgtttcaagtctattatttgcaaccaagagcctaacttcacacacacagattactgatttcatcaattgtgaaggtttaagggatctcctttgcgattccttcaactattcaagattccccttgtcgaggttgttaccctgtttgaggggatggaaggggcagaatattgcttaggtgttgcaagaggaatccaacctttcctgggtcacaactctgacgggaagctgtgccctcagtaaggtttccccagtcctggtggcagtgtctgagtgggcacttccttagatcccctgcagaaatcgtactcatgagctcctagacgacactgatttccgttctctcccaattccctaacatgagcagagtgcctggaggggattaagtgttcaatacatacaattggaaaaacaaggcactttcacagtctcttgttgattctcaaaattattttggtagtgttttgttttcatcatcagcctaatttcacacttgaggaaataaagttcagtgatactgacttgtcagagatcaaagagctcatcagtggtggagctaaaactctccataaggatataatacccaataactcaaattccctcacccacaaaaatcttttcagtcatctcccctttatcctaaccactgacgtaactcagatcttcacattccttttctcttttatcctcaacttttaaattcagggtacatgtgtaggatgtgcaggttttttacacaggtaaatgtgtgccgtggtggtttgctgcacagatcatcccattacctaggtactaagcccagcatcccttattcttcctgatgctctccctccccccatccccatccccactcccaagatgctcctgtgtgttgttcccccgccatgtgtccatgtgttctcattgttcagcacccacttataagtaagaacatgcagtgtttgattttctgtccctggattagtttgctgaagataatggcttccagctccatccatgtccctgaagatcacatttctaaccttccaacggatcttcctgcccaggttttacccccaacctatcttccacaccaccaccaaagttaaatttccaaaatctaactctgatcacgccactctactcacaggctactgcatatgagacaaaggccctaactctcatggttttcaaagtcctccatgatcaggcctcagcttgcttttgcagtctcatttctatcaccagattccactcatcaattcttttcatcaaaacgctgggctttcccccggtattcaacatgccatttgtttctcttccataatccattgttagctttttcccagccagctctataactagctcatacatacaagggaatgtatgacaaatttatggcttaaagaataataaaagaacaatcatgctcccacctaaacattaccaaacaccctatagtgttcttttaagtctctgtgcctctgcacatgctagaatgtccttccaggccttagtctgcatagtaaactcatcctttggaagctaattccattgacttcctctgggaagcctccattgacacccgtgagggacacaatgcttcccttatgcctctactatggcatttataactattatattcgcttacacatttgtctccctggtaggttgaagatgtcaaatatttgatctctgaatctctggtaaccagtttgaagttctagttacacagtaagtgctcaatacatcagatgaccacacaacccagtttgcctgggagagtcctggtttatgtctgttgccctggagtaattataagtgcttctttcactcataaaagcatcctaacttagatgaccaaatcaccctatccataaatgttgaattaacaaatgacttaaagaatagagaaagactttcactgtcagaatctaggcaggaaaagccaatgtgtggattctgcggccactgtgcctccttctcctcctccttctgactctcctggagacagagaagatgagtttgcacacaccagatgctcaataacctttattgcacaagtaagttgaaaaatgttagcacgttcctacttcaagaaaacctgggccgggtgcagtggttcatgcttgtaatcccagcactttgagaggccaaggcaggaggattgcttgggcccaggagttcaagaccagcctaagcaacatagtgagacccctatctctacaaaattttttttaaaaactaagaaagaaaattagccaggcgtggtggccccactttgggaggctgaggctggaggatcacttaagcccaggaggttgaagatgcagtaagcagtgtttcacgccactggactccagactgtgtgagagagcaagaccccatctctaaaaaaattaataaaaaaaaataaaatctggatgtaaaatgttaatttatagtacagatcaatgtggcagagattattaaatattacctacgtttactacttggttaaatctagctggtagtgaaatgtaaagagctggatttactacttataggaaataaaaaatgcagattcaatactcctaaaatgtcagtggtgacacgatttttaaaaaattaaatagatgcactgtttttaaaaaaacctcttctcggccaggcacggtggctcacagctgtaatcccagcactttgggaggccaaggcgggtggatcacgaggtcaggagatcaagaccatcctggctaacacagtgaaaccccatctctactaaaaatacaaaaaaaaaaattagccaggcatggtggcggacgcctgtagtcccagctacttgggaggctgaggcaggagaatggtgtgaacccgggaggtggagcttgcagtgagctgacatcacgccactgcactccagcctgggccacagaacaagactccgtctcaaaaaaataaaaataaaaacaaaaaacctcttctcagtatgtatgtaggtacatacatacaccagttagggttgcccttgttcttaaggaaagataatctccttgagtttcgtatcataaatacaagttttatttaaacttttttgtaattcaagtaaaaaaaaagctgttttttaactactgttacataaaaagtggaaagtgaggcaatccatcttttcggcaataatcttctcttcttataataatgccatcttctttgaaagtccagataattccaggccaggcacggtggctcacgtctgtaatcatagcactttgggaggctgaggtgggcagatcacaaggtcaggagttcgagaccagcctgaccaacatggtgaaaccccatctctactaaaaatacaaaaattagctgcgtgtggtggcgtgtgcctgtaatcccagctactcaggaggctgaggcaggagaattgcttgaacctgggaggcggaggttgcagtgagctgagatagtgccactggattccagcctgggtgacagagtgagactctgtctcaaaaaaaaaaaaaaaaaaaaaagtccagataattccttgtaaataaggtttttaataaattacaaatatgtaataggtttttatccatcttcttcctaactactcaatgcattgttgcatagcaacagtttttttctgcttcttctttgttggaagtctgagagtctgaaatctgcattggcttggttgagcttgggaatttttctggtaccaggggtgcaaatatccattgtagaagtcagtagctgttagtgatttcttgagcatcactgatcgaacaccaatccaaccatcctaaagggcaaaatacaaatagtgaataggcaggggtggcaaaactaaaaagccaagtaaatattagtttataaaatttttatcatggaaacaaacaaaccaacaaatctttactaaatgcctagctgcaaacagcactacactaagtaacatgtagaattccttgactctattaggttggtgcaaaagtcattgcggtttttgacactgaaattaaaagcttattaccaaggagcgataacaaatgtatagatctgtataaatatttaaatacaaagggagcagaataaaaggtatgtaacatgaaatacacatataggccaggcgtggtggctcacgcctgtaatcccagcactttgggaggccgaggcgggtggatcacctgaggtcaggaattcgtgaccagcctgaccaacatggcgaaaccccgtccttacaaaaatacaaaaattagccaggcgtggtggcgggtgcctgtaatcccagctacttggaagacggaggcaggagaatcgcttgaacccaggaggtggaggttgcagtgagctgagatcacaccactacactccagcctgggcaactccatctcaaaaaaaaaaaaaaaaaaaaagggaaatacatatatatagacccagaaaaggacagcaagacatatgcatccaacactgttccagaataagctggcgagagacaaagagaggttgatggagttttgtattcacagtctgtaggtcagatcaatctatcacacattttaaacattttctttttttttttgagatggagtttcgctcttattgcccaggctggagtgtgatggcacgatctcggctcaccacaacctccgcttcccgggctcaagcgattctcctgcctaagcctcccaagtagctgggattacaggcgtctgccaccacgctcgactaatttttgtactgttagtaaagacggggtttctctatgttggtcagtctggtctcgaattcccgacctcaggtgatccacccgcctcagcctcccaaagtgctgggataacatgtgtgagccaccttgcccggctaaacactcttaagtatgaaatatctcacatgaacaccatatgatgcaaaatacctaggaaatggaaggaatgtagaacacttctcagaacacaccatgatcttataaaacaataatgattccaaagttattttaaaaagttcagaaatctcctctttactactgttaagcagtaaaagcaagtaggatatgtgtgtcctgtagtagttcagtcagatattttgatatgactatcttttatgttaccaagcacaagagctgttaattaaattgggctactgaaaatacacgtgttcttttaagaaagcactcaagttactgaatcttctttctttgagtaataataatgccttggcaaaacttcatcactttcaaaaaattatgctagagacttcactatttcttaagaaaattaaatgatctcctgacccaatctatggacaggcagttaagtgaagttccaactaaaaataataaatgatacagactataacatagtaaaacaactatgataacttgaaactaatgaaaaacataccttgcaataaaccaatagtatttgtgactgtttgtggtatattactgatcctggaataagagcctgtcccgttaattttggatctgaagaatggaaaaaagaaaagatatacaagagaaaaaagcaattatgcaacttcatagtacttcttaaaaatcaaaaaacatcttgggaggcagtactgataccggagagaacacatttgctgatgttgactttgtaaaccaaaacttacaaggaaaccacagtgctctctgtacatcagaaacccaaaggaaagcttcccatgcacatacaaagctataattcctttacccagtgaccacctaaaatgctgaatctacaagttttgtgttagcgctttggtgaaataactagccaacagggggaaatacataggatgtttaggatttaggctggccctttcatccctgcccaaacaaatcctaattcctaggttcctggggaactccaactacctctaaattaaaccagcttcctctgtggctcacattccttctgtccaccgtattggcaggatgctgatgggcctcagaatggacttgtggcatgaagtatgaatacactctggcctagattttcactgatttgcccagatattttcattataatattcaccagaatgaaactaatcgagtcattctgcactctctgaaaaccttaaggcaggaaatcacagagcttaaaatgggataggaacactgctttgcctactccccagggtcctgtaatgatttttttttttttttttttgaaatggagtttcactcattgcccaggctggagtgcagcggcgcaatcttggctcactgaaacctctgcctcccaggttcaagtgactctcctgcctcagcctcccaagtagctgggattacaggcatgtgccaccatgcccagctaaatttttgtatttagtagagacggggcttcaccatgtcagtcaggctagtctcgaactcctgacctcagctgatccacccaccttggcctcccaaagtgctggaattacaggcgtgagccaccgcgcctggcctgttcttgtaatgattaaatgagaaaatatatgagaatgagtgttgcaaagaataagacaataagtgaatgtaaagtattataattactgaactgaaacaaactaaaagttatttttagtaattgtgacatatgataaaacagacgtatttccagatacactacagtgaaaacagcttccatgttagctattcaaaagttagtaccagcaaggactgaactgttaacttctaccaaatccagaagtttaatggtattcgccatccagagcgtctgcaacggaatctgcaagtaaaattaaagaaggtatgataaaggaatacactcaactcccaaacccttttcaactactattttgtgttaatctggacttttctttcaattagaggaattgggaactcagtcactaagtttgatggaacagaccgtaaacatgactctctacatcagtgtttccaggatttataagatctttttttttttttttttgagacggagtctcgttgtgtcaccaggctggagtgcagtggcgcgatcttggctcactgcaagctccgcctcccgggttcacgccattctcctgcttcagcctcccgagtagctgggactacaggcgcctgcaaccatgcccggctaattttttgtattttaagtagagacggggtttcaccatgttagccacgatggtctctatctcctgacctcatgatccgcccgccttagcctcccaaagtgctgggattacaggcgtgagccaccgcgcccggccgatttataagatcttaaatgttactttaaaatcaatgtttatatctaatatactaatatttccaattaaaaatttattatccttataaaaaatgcaagcattacattatgttaaaaaattttagaaagtgatattctgtatttattcccatccctataggtaacgactgttaagtttgatgtgcatttccctgtatttttttctacaaatattattataaaaatctagaacacagtgatagagacaggagacagccaaatgccacccaggtcattatgcacagtgggcttgactcaacatgtccatggtgaaaagttctgtcccttaacacatgcacagtaaaggaaataaatcaaggtggcgtggctcagactaagggcccgcatgagcactggaagaatgggggtggagccaccaggaatttctgccttatgcaggggaagagcctggcctcttcagctcctgtgtggtggcctggtattcaatctgtgaggtgggagcctgttggcaggaccccctctttttttgctgagagctttcttttaataaattccactctcctcacctttcaatgtgtccacgtgcctaatttttcctggttgtgagacaagaacccagattttagctgagttaaggagcaaaaagtcctgcatcaatactgttttacaaggacttttgttatgtgaccataaagcattgatgtttcatcagtacatacttatcaatttcactctatctgctgcacagtaacccattttatgaatatgtaatttatgcaactacctttatgatagatatttgttattttcaatttattgctatttataacactataaactagggtaataaccttgtcgatatatctttgagggcttacacatttctggataatagttttggggttttttgtttttaaagtggaatgcgtgggttaaacagcatcaacattttattgctaaactgcctggataagtgagaaaaaaatatgataatctcttgctgtttattattagcgaagctgagaagctgtccatatatttatgtgcacttttaatttatttatctgtaacctgcctatttatgccctttggttatattttttaaaactgggatggttatctcattaatttgcaaaaatattttctatatttaggaaattagccttttaactcttacatgtgttgtgaatattttcctcagtttgttgacttttaatcttggggacagccattttttccatgcataagttttttattttcataattatatttctaagtcttttctctcattactttggtggttcgtatcatacttaaaaaggcctaccccacactttaagattattaaatattgtcaaattattcagttgtgcttttttatagtccttgtgattttactttttatatttaaatccttgatccatctatattttgatttttttattatggtaaaaaacacataagaaaaatgtgctcaattaacaaattgtaagtataccatacagtattgttaactacatatgcattgttataatatagcacttactatgattttaaaagataggatttgagggcttcccccaccaatggttggccagttatcccaatactatttactagataatccatcttacccttccctccagtatgaaataccacctttatcatgtaacacatttccaacatacctgagatcctacagcctgatttaaatgttaataaaatttaacacacaccaggaaataagttctctaaaatttctgaattgaatgcatttatttccagactgtagttcaatcctctatttcatacatgaagagagtgaggctcagagaaatgcagctattttcccaaggttggacccagctagttagtagcaaagccaggactggcttctgttttctgattctcagtgcagtgctctttttatgacaccccttaaagagggtatttaactttcagaagagttaggttgttgtaataatttgaacattaaatcaaataagtaaatgaatttgaagaacaagttcataactgtatctatgtcatagcctcttctataacttgctagctcacttttcttttgcccgcttcaataaaagttctgaaacgattttcatatgtgcaatttttttcttttaaataactcaaaatatttttgaaacatgcttactgactaaaaaagatttctatttactgagagtaataaacatgctaggtacatactcagaatatagtcttgttcttcgggaggtaaagctcaccttatcatcagagcattgtagaaaggaaagggatggtaagaatataatcattttggtgtctgccatcattactgccaaaatagtatgtttgcatgaatttacattcacctagttcatttcctttgatcttgccagttgtgtacatggtcattaatcccactttagaggtaaaaaaagcagaagctcaaagacaagggccttcctctcattagtaaagggcaactctaggaaccaaaccccaccttctggctcagtcttttatagcacaaagcttttctccatgtacagggaagataaaccgcagagggtaagaatcatcatgtagtaagttataggtgccaagagatttcaagctactggcctaaattgcatctcaggaagttgtctacttgatatctccatatgaacgtcttctaacttaatatatgtcaaacttaacatggccaaaactattgatttctcttcccaaatgttcctccccagacatcctcatctcaattaaatggttccactattcacccagtttctcaagccaaaaatctatgaatgatcctaatttatctatctctaatttcccagattccatcagcaaattccgctgactctatctccaagcatagtctggatgtccacttctttttatccaccattatcattgttccaaactgccatcatctgtcatctggctacagtcgcagcagcttctttttatttttttaatttttttttttaaagaccggatcttgctctgtcatccaggctggaagtgcagtggtggaatcacagctcactgcagcctcaacctcccagggtcaagtgatcctcctacctcagcctcccgagtagctgggactacaggtgcatcccacaatacctagctaatttttgtatattttgtagagacagggtttcaccatgttgcccagactggtctggaactccagggctcaagcgattcactcttcttggcctcccaaagtgctggtattacaggtgtgagccaccacacccaaccaattccctaactgacctccactccactctctagcagcagccagggcaaccttttaagaatgtacatacctaatcccattactcccctgccgtggccctctgatgtcaatcctactcaatcttgcttctcccctcaccttagctactctccatcttgccagctatgctccagccacaccagcctcatttctgtccctcaaacatgtccaactcttttccatcttgggttgtttttttgttttgttttgttttttgacagctttattgagatgtaattcacataccagaaaattcacccttttgaagcttccaagtcagtggtttttagtagactcagggtcattcaaccaatgtcactcgtttttttcttgcctaatttttagaacattttcattacctctctctcccagaaaaaacgccatccattatcagaaaattcccattatcctctctcctccagcctatggatttgcctattttggacatttcatataaatggaataataacatatgtagtctgttgtgacagggttttttcacttagcatatttttcaggttcatccatgtcataagcatgtgattatggttatggctgagtattaataatattccaccgtatggctatataccacatttttttaacgcatccctcagttggatatttgggttgttttcactttttggccattctgaataatgctgctatgaagattcgggtacacatttttgtgtgagcacaatgtttccaattctcttgagtataaacctaggaaaggaaatgctgggtcataagatacttctgtgtttcactttttgaggaactgccaaactgttttccacacaggttgcaccatttttaagaggtaaacatggtaccatgaatgtatgaagtttccaaatttctccacatccttgccaacactagtttttgtctgttttttgaattatagccatcctaatgggtgtgaagtggtatctcattgtggttctgatttgcatatccctaaagacagatgaagttgctgatcttttatatgcttactggccattcatattatgtatctgcttgaaacaaatgtctactcagggccagggcagtggctcatgcctgtaatcccagcacttagggaggctgaggcaggtggatcacctgaggataggagttcgagaccagccaggtcaacatggtgaaaccccgtctctactaaaagtacaaaaattagccgggcgtggtggcgcttgcctataatcccagctactagggaggctgaggcaggagaatcgcttgaatccaggaggcagaggttgcaatgagccaaggtcgcaccattgcactccagcctgggcaacaagagcaagactccatctcaaaaacaaacaaaaaagaaatgtttactcagaatttttggccatttttaattgggttatttgtcgttttactgctgagtcattgtaagaattctttactctggatattaggcccttatcagttatatgatttgcaaatattccctcccattctgtaagctgtcttttttttttttttttttttttttttttgagacagggtctcactttgtcacccaggatgaaacacagtagtgcaatcacagctcactgcagcctcgacctccctggctcaagtgcatcctcccattccagcctcccaagtagctaggaccacaggtgtgcaccatgatgcccagctaattttttactttttgtaatgatggggactcactacattgcccagtctggtctcaaattcttgggttcaagcagtcctcctgtctcagcctcccaaagtgctgggattataggcatgagccaccatgcctggcctacctgtcttttttactttgttgatagtgtcctttgaagcacaactatttttaattttgatgaagtccaatttctctatttttagtctgattgcttatgcttcatggcatcatagctaagaaaccactgcctaattcaatgtcatgaatatttacacctatattttcttctaagagttttctagttttagctattcatttagcttctttaacttttacatatgatgtgacatagggtccaaattcattcttttgattgtggacatccagttatcccagctccatttattgagaatactattctttctccattggattgtcttggcactcttgtcaaaaaaaaaaaaaaaaaaaaaaaaaaaaaaggtgggtgggaggggagagggatagcattaggagatatacctcatgtaaatgatgagttaatgggtacagcacaccaacatggcacatgtatacatatgtaacaaacctgcacattgtgcacatgtaccctagaacttaaagtataataataataataataataaaaagaactatcttttgggaactacctttagaaaaaaaaatcaattgaccataaatgtatgggtttatttctagacttttaaaaaaatttgagacagagtctcactctgtcacccaggctggagtgcagtggtgtgatctcaggtcactgcaacctccacctcccaggttcaagtgattctcgtgccttagcctcctgagtagctgggactacaagcgtgcaccaccatatctggctaatttttgtaaatatttttagtagagatgaggtttcaccatgttggccaggctggtctcaaactcctgacctcaagtgatccacctgcctcagcctcccaaagtgctgggactacaggcataagccatcatgcctggcttatttctagacccttaattcgattctaatgagctatagccagtaccacactatcttggttactgtagttttacagcaagttttgaaactgaaaactatgagtcctccaattttgttagttttggctattctgggccccttgcaattctgtatacattttaggagcagcttgtcaatttgtacaaagaagccaattgggattttttttttaggaattgtgttgaatctgtacatcaacttggggagtagagacatcttaacaatactaagtttatccaatcaatgaatactggggtctttccatttacttgggtcttctttactgtttattagctctaatagttttttttggaacttcttcatgattttctatatgctagatcatatcatccacaaatagagacagctttacttcttcctttccaaacttttgtttggttgccttttgtttcttttttcttgtctaactgccccaacagaacaaagttgaatagaagacatttaactttgagagcgcagacatctttatcttctttgtgatcttaagggaaaggctttgtctttcttttattttctttctttcttcttcttttttttttaagagacaaagtctggctatattgtccaggctggtctcgaactcctggcctcaagcaatcctcccgctcagcctccaaaatacctgggactacaagtgtccaccactgcacttggcttctttcattaagtatgatgttagttacagggtcttcatagatgtcctttatcaagttgaggaaatgctcttctatttctagtttattgaggtttttttacatgtgttggattttgtcaaatgctttttctgcatctattgagacagtgatgtagcttttgtcctttattctactaatatgatatgttacattgactgattttcatatgttgaaccaaccttgcattcctgggataaatcccacttggggcagggtgtgatggctcacacctgtaatgccagcatgttgggaggctgaggtgggcggatcactcaagttcaggagtttgagatcagcctggccaacatggtgaaaccccatctctactaaaaatacaaaaaaatgagctgagcatggtgctgcatgcctgtaatcccagctactcaggaggctgaggtagaattgctagagcccagaaggcggaggttgcagtgagctgaaactgcacagttgcgctccagcctaggcgacagggcgagacaccatctcaaaaaaaaaaaacaaaaaacaaaaaacaaaacccaaaaaacaatcccacttagtcatcatgtataatccttttttatatgttgctggattcagtttgctaactctgtggaggacttgtgcatctatattcagggatatcagtctggagtttccttttcttgtgattctttgggttagcccaccttgggttttgtactagctgttcctctgcctggaatgctcttctctgttctaggcatggctggctccttattgtctttcagatttcagcttaagtgtcagaaagaggctttccccatcaccgatctaaaataacctccagttattctatcacatgatcctatttttattttcatcaaggaatttatcacactatttgatttttttttttttttttttgagatggagtttcgctcttgttgcccaggctggtgtgcaatgtgcaatctcggctcatcataacctccacctcctgggttcaagcaattctcctgcctcagcctcccaagtagctaggattacaggcatgcgccactaggtctggctaatttttttgtatttttagtagagacggggtttctccatgttggtcaggctggtctcgaactcctgacctcaggtgatccgcccgcctcggcctcccaaagtgctgagataacaggcgtgagccaccatgcccggtctttttttttttttttcttttgagacagagtcttgctctgtcgcccaggctggagtgcagtggtgtgatcttggctcactgcaacctctgtctcctaggttcaagcaattttcttgcctcagcctttctagtagctgggattacaggcgcatgccaccacgcccagctaatttttttgtgtgtttttagtagagacagggtttcactatgttggccaggctggtctcaaactcctgacctcaggtgatgcatctgcctcagcctcccaaagtgctgggattacacgtgtgagccaccatgcctggcctgattttttttttttttttttgcttacttgttgtctgtcctcccacaacacctgtttctatagtacctagtacactgcttgacacataataggccttcaataaatattttgtttaatgaatgaatgaataatagcagctatcatttaatgagtacctattctgtgccagatactgtacaagatgctgtaaatatattataccagccctgatattccaaggaacaaactaaagctcggaggttaaataactttcctgagtctacgacgttaggaagtagcagagtcaagatggaacccagcactgtctggccctatggtccttgtttcctgatgccattctgtggcagcaggaaaataataggatttgaagtaagatagatctcgttcaaaacctgactctgactttcattaactagcaacacgacatcgagtaacacttaataacaattcattatctactttaagcctcaatttcttcaactttaaagtgggatgataataactataacatgagtctgtgatcctccttactgaagaatttagcatgctatagatatccaatggtggttccccattttacccaacattaataacagagatggtccattaaaaaccacacacttggccaggcacagtggctcgtgcctgtaatcccagcactttgggaggctgagaagagcggatcacttgagctcagcagttcaagaccagcctgggcaacatggcaaaacctcgtctctacaaaaaaatacaaaaattagccaggtgtggtggtgtgtgcctgtggttgcagctactcaggggctgtcacaggaggctcacttgagcctgggaggcagaggttgcagtgagccaaggtttctccactgtactccaggcctgggtgacagagctagaccccgtctcaaaaaataaaacaacacacacacacaaacacacatacggtaagctcagtgttcaaataacacaagtagctattgaaatgaaaggaaaaaaccccacaaatttatcaatgaactgagaatttaactcagacattttaacaaactgttatattactacacttggtgtaccatatgtagaaatcaatgatttaacaatttgattgtaaaaaattggctaaaggcagaaagacatactggaagaagcacaggattaggagtgagaagatttaagttcattatttagtgactggacattcctgttagtcatctcatttctttcccctcacctatgaagtaggatagtaaaacttggttatgtgaaactgcaatatacatatatttaaaagtgctttgtgaattctaaggtctctataaacactttaaacagcttaaagaatttttaagaataaatttcaggttttctaggttttgttcctaagatcaaccttttatttgggatatttttatttgggattattcctaaataaaaatatttagaaagcaaattacacacatagaaaaccaactaggtagaactgcaacctgacttcccaacttactatatttccaatggcacggtaaagtctgaatatttgttctgaagtttgttcctcccattttatacaactggtaccagcagaaatcttaggggctacaagataaaaccaagagcaaaaatgaacatcagggtcagtgtccatgaattgacagctattgatactgaataagagataccagagaattcattctaacctctcaacttttctttatgttcaaaattttccatatatcaagtaaaaataataaataaataatcatataaatattaaaataaaacatgggtgaacttctttacatcctgggagtagaaaatgcccttctaactatgaaatgagactattcaaacttttttttttttttttgagatagggtcttgccctgtcacccaggctggagtgcagtggcgtgatctcagctcactgcaacctccacctcccaggctcaagagattcttgtgcctcagcctcccgagtagctgggactacaagcgtgcactaccatgcctggctaattttttgtatttttagtagagacagggttttgccatgtttgccaggctggtctcgaactcctaaccttaagtgatccacccgcctcatcctcccaaagtgctaggattagatgcatgagctaccatgcctaggcaaaataaattaaaaaaaaaaaaaaagacaaaaagaaatgccataagttaaatcaaaaaacaaatgacaaactgaatttgcaagttatctcagagaggactaatttctctattatgaaatataagtactcaaaaaactgagaagaaaaagaccaaaatgttgataggaacatgggcaaaagatatactaccacccagaaaaaagaaatgcaaatagttcttaaatatatgaaaagatcttcaacattactgacaggaataaggtacattaaaactactccaagtagttttactatactattctgaataaccatgtgcctgttatcttcctaatcttactattatttgaaatagcaaaagattggaaacaacccaaatgcccatcaataagacatctgttgggttaattatgatatattcacatagctgagaactatgccaccataaaaaacaaaaagaaggccaggcatgcctttgggaggccaaggcaggaggacggcttgagtctaggagttcaagaccaacctgagcaacatagttagaacttgtctctacaacaaattaaaaaattagccaggcatggtggaatgtacctgtagtcccagctacttgggaggctgaggtgggaggactgcttgagcctgggaggttgagactgcagtaagccatgatcacactattgcacttcagcctgggtaacagagaccctatcttaaaaaaaaaagaaagaaggaggaaaatctcttcttactaataggaagtagtctccatgatacactattaagtgaaaaaacaaaggcacagaaaaatatgtattttatgccaccttttgtgaaggaaaaataaaaaataacactatgtaggtgtttgcttattttggcaaaaggaaacactggaagactaaatcagaaactaataaaaatgttacctatagagggaggaatacgggttagataagatagagatggaagtaggacttctatgagtgtacctttttaagctgttttaacttttgaaccatgtaaatattttatgcattcaaaaaataaaatttaatcataaaagaaaataaagcaatccctaaaataaaaaaaaaaacaactgaaacttaactatgtatgaaactaggtaacaaaaccacatggaaaaaataatcattaccaggaagttttgaaggcagtaatctgactgtatatccttaggatatattctaaggatcaaaaaggaaaactgtaaagaaatcttaaatcttacttagtatttttactcttagtagtaatattggtattgtaatgctgaaatgatgttatgaatagcaaataaataggttaatatttaaaaaaagatagtgtgagaaaatataaggaaaaccctttaatgataaatttgaatcataaacaatatgagcttgaatattttttaaaaatataacttctagtttagtccactgataccttatcttgccatacattgttgtaccagatgatctctaattatcaaccccactaaaatgaacaaaagctccctggaaatcacactggttgatttcagtgtgagccagaggacacataggcgagcctgggacatactgtggtggaagcaaggaagcactccaaactagtgggaagtgaagagtgttaacagaatgtaggagccaaatttaaggggctcccactgggcaaatataaagaattatgactgtaaaacacaatcaatgaaaatctacgcgtcaaatgatactaaaaagaacgcatctgacaccaaaattgaaggcaattaatggcatcaacttcttattctaattaaagagaaagaattaagcccctgtccccattttaggatgaactaaaattcacctccaattaatgaggaaaaactcttctttccagaacaataccagctattaaatgtaaaaggaattagaaaattgccattttgtaatccatagtgaaataattcatttgggcaaggaatatcaatctgtactaaaaccatcatgtgaaaggttgttagggaacaggatatctgcacagtgccagagtattaattaccccacagattacctgctaattgcaaaagggaaaacacatcttaacactggaaagatctggtggtcaccatctcaaccaagtgatcaaacttagcttcacttgctttagtacagtctgatatcttggcttactcaagtggtaccttaagactgtaggggacaaaagtgagacttctctaggtatattaacttttgaatcagctatatgttttacatattcaaaaaataacatttaatcataaagaaaaataaaaagtaatccctaaaattaaaaacaaactgaaacaaatgtttatactcctaactctactaaaaaaaacaaaaaagaagaaaacaaatgtcactgaaacacactctttccaaaaactttaagcctgaatccagccaaacctttagaactaattataggaaatataagagatagggaacaagttaaacaacactggaagaaaacaaatcaaacaactggcctggtctcttcaaaaagtcaatgacatagagagaggaaaaaaagaggaattttttttagagactaaagagacataacaactaattacaattaaatcctagtttgaaaaataaaactataaaataaatttttagacaattaggaacacttaaatatgaactgaacattggatgctatcaggaaattgttcatttttcttaggaaaggcatactaaactacttagagatgaaagatcatgattcatacttccaaatgaataagcagaatttaaaatacacgtaataaatacataaagagaaagaaaatatggacaaacattaataattgttgactctggggtaaactggtgtttattataccagtctttctatttaatattttcaaaatcaagaagttggaaaaaaatgctcaatccttcatgaggctatatgctaagagggagaaagaatgctttctaccattctttggaaaagcacacaaaagtgggcactcaatcaaaattaagggaaaagtacagctaagaagtcagaatgttcagatgctatcgtgacaagcagaacctttagaaagatgagagtctctgcagccttcactcaccgtaagtcgccccctccattggctgctgccttccattgctcagactttcaggcaaatttttcaaaactgaaatgagctacaaaaaaaaaaaaaagagtgtgatatattcaaaatgaagggaagaacaaaagcagaaacacattacaattcagcaccatgaaataacctataactttttttctttttcttttttcaaattaaaaaaaaaatctttactattggctcttcaaggctgaacctataactttaaaagatctatgtggcagggtaaggtagtacattggcttaagctgtgaggataggtgtctacttggggaaacctcagtagagattctgctttctgtagagtacaggtcattgattcacttctagagaatgctgtggaagctttggcatcaggatagcccgggcttggctatacacactctcaccccatgggggccaaggcagtgaaacctcacaggacaatgtactatggagtcacccagctctgggttcaagtcctagttctaccacctaccagctgtctcattgtggaaaagttatttagcttgtctctggccttcaatgtcatcatctgtgaaacaatcaacagcaacaactacctcaaagttgagagggtaaaaagaaaaagtccatacagtatctagaacagttgtagaacacaagccaatgttcaataaacggcagtcactattataagatcatttgtgaggtaagtgcctagaataggaaataccatctctacaggtgggaaaaaaatattcctctgtataaaattaacccgttcatatggaaaacataagtttagtcattaaacatttacccagactctactcatgcagtttcaatgaattatatatacaaagccacagaaaaaagaaggatcatctataggtagaatggtcagcagaattctagtgcaaatgactgaagccaggcaaagaaatggaaggaaagctaagagtcgcttagaaaattgctgttagttcattctgacagggatgcaaggtatacataccagagtgcggagagtgaaattgagaagaatagtctaagacctcactatggcatgtagtaggtcatgtaagatcacctgtttcacttgaaagcctttattcagtacttactctttgtaaattctcaaagatttacatgagatcacaaatgccaggctaatttttaggaagccaaagatagaaattactcttttttgtttttaagaaaattagaagtcacaaaattgttcttctttttataaccacttaggaaacccactaaatgagtaaaaagcagtaggatattggggaattataccatgttggcacccagtcttgacaacactgcttccaattcctttgcagtgctcttgggtggcacaggaacagtttcttgtttgagaattgggcctacatcaaacctagcaaaaaatcaaaagcaaataatgacaatgattaccatttcctgaatcaatgtttgtctacacacaaaaagatacaagctgggtacagtggtctgcatgcctatagtcctagttgctcaggaggctgaggcagcaggattgcttgatccctggagtttgagaccagcctgggcaacacagctagcccctatctcttaaaaaaaataaataaagatagtttatcactggctattaatttggctgttagacattagcaaggaagatatgtcagtttgaaagacgggagaacaaaatatggcctgtgtttagagtctaaatttatttttccctaaagcaaagaaacgatacagttgcatatcaggaatttaattacaattacagaaaaattatatcattagtaatagcatgaaaaaatctctatttgtatatgaaaagcataaggcaaagaatttattttccatggaagtacagttaggaagttcataattatttatttctatagtcccttcctcaaaggataagagttttgcctagattatcaccataggtgattataagtagggccaggcgtagtggctcatgcctgtaatcacagcactttgggaggccaaggtgggtggatcacgaggtcaagagatcctggccaacatggtgaaaccctatctctactaaaaatacaaaaaattagccgggcatggtagcgtgtgcctgtagtcctagctattcgggaggctgcagcaggagaatcgcttgaacctgggaagcagaggttgcagtgagctgagatcaccccactacattccagccggggtgacagagtgagaccccgtctcaagaaaaaaaaaaaaaagtaaatgcaagtatatttgcattcccacaagtctgacattttatatcaagctctgtaaacactggtcataggttttcatgagcaatatgctttatttaatttttttttgctttttgtttttgttaattctatttctaacctaggagctttagtaaaatgtttattgtgaaaaattgcaaacattcacaaaaacggagtgaacagtctaatgaatcatcatatacacatcattcagatttttttttttttttttttgagacaggttcttgctccgtcgcccaggctggaatgcagtggtgcgatcttgcctcactgccgcctcaacctcctaggctgaagagatcctctcacctcagcctcctgagtagctgggactacaggtgtgtatcaccacacctggctaatttttttattttttatatgttgcccaggctggtcttgaactcccagactcaagtgatcctcccacctcggcctcccaaagtttaggattacaggcgtgagccaccatgcctggctcagattttagaactaccaaagttttgccactcttgtctcatctactctctctcttgttttctgaagtaagttaaagcaaatcccagataccacgttgttcttgcgaacttgtgaattattcttttctaaggggaaattaggtggtaacaggcagagactgaataaactcctcaagtaattctaaataattgtttctaaaaaattgttctaaattgtttctaaattgttctaaactataggtatgacaggaaaaaatgaatgttttaggacaattatattgcatattgatatacaatatattcttatttcaggttccaaaaattttttggccatagtttagaaaccaaggccagcaaaaccaagattcaaaacaattaacatacaaaaatccatctctcatttatacaatgtattttatagaaatccgagtattaataatataacctatttcaattaacaaattaaaattcacatatggactttaaagagaccccgcataaataccaaaagacatatggtttatgttagaaaccaggagaaaacagaaaggatataaaagcagaagaagcactctggagtcacagaaattagtgagcaccacccattcatccactgccccccaaacaggctgacatcaacatttaaaaatcacaaaaatctcaagaaaggaaaatatgtgctaccttttaggtctaatttgcataattgttactccagtaactgtgtctccgtgaagcactgtatggattacaggggctgggccacgccatctcgggaggcaactgggatgaacattcaatatgccactgagttagaaaatgtagaaattagtatgtcagtgggctttaccacttcgttaccactacctaagctattatgctacttttcattaggaaactttcccagaaatttggaaaaactgacagttaaatctaagtctcgtatcacctgaaaggaaaaaagttacatgtaaattcactctcttaccataagaaaccaatgacatttaattaaaaacagagctaggacaactatttgctgttctaaagatgttctgtctgggtgtggtggctcatgcctgtaatcccagcactttgagaggccgaggcgggcggatcacttgagatcgggagtttgagaccagccggaccaacatggagaaaccccatctctactaaaaagacaaaattagccaggtgtggtggcgcatgcctgtaatcccagctactcggaaggctgagacaggagaatcgcttgaacctgggaggcagaggtgcagtgaaccgagatcacgccattgcactccagcctgggcaacaagagcgaaactccgtcgcaaaatctacaacagcccatgatgtctgggagtttttaaataaaattttaaaatgcatttatgactataagagaaccactcaaaccctattatgcatctcatgaacaattctaattttatagtttagtcacataactatcctcacttcacttggtttacatacagactgcctaaaataagctttttctttttttttttaatttttttttgagacagggtctcgctctgttgcccaggctggatggctcactgcagcctcaacctcccaagctcaggagatcctcagcccaatccaacattcactgagcgcactccatgtgcagacactgttctaagtgttaggcatacaagcagcagtgaaccagacagaaaaaaaaaatcctgccctcagagagtttatgtacaaaaagtgggagataagcaagaaaaaacaaaatatgtacaaggtttgccagatgatgctgagggctatggagaaaataaagcagagaggactatgagggggacatattacaattttagtagtgatcagagaaagctttaccaacaagaaaacacttgaacaagaacatgaagaaggaaataactacgcatatatatgggagaaaagcattccaggcagagggaacattaagtacaaagatcttgaagaaggtaaatgctcggcaaattcaaggcacagctgggaggccagttaggcctggccttttattgagtaagacagaaaattaccagaggattttgagcagagtgacatgatctgacttgttttaaaaggatcactttgaggcagggtacagtggctcatgcctgtaatcccaaaactttgggaggccaaggcaggaagatcacatgcagccaggagtttgggaccaggttgggccacatagcgagatccctgtctctaaaaaaaaaaaaaaaaaaaaaagagttagctgggtgtgttggcacattcctatagtctcagctactcagaaggctgaggcaggaagatcccttgagtctggggctgcagtgagttatgatagcaacactgtactccagcctgggtgacagcaagactgtctctaaattaaacaataaaatagaaataaataaataaataaataaatacattttggctgctggattggtaaaagactgagagggccaaggacagaagtagggaccagttaggaggcttctgtagtaatgtaggcgagagtggcagcagcggaagtgatgagatacagacagattctacacagattttgaaggcagagccaataggatttactgatggattggatatgggacgtaagaaatcaagcatgactccaggattttggtgcaagcagctagaatgatggagtagccatttattgagataaagattttaggagatgctttgggtatcttgaatgtaaagtggctatcagacatccaggaagagctgtggaggcagtaggtattaggggactagagtttggggaccgagctgagctagagggaccaatttgggcgttgtcagcatatatatggaatttaaatgaaggtggatgaaagcctatagagggtgataaggagttaaatacattttgacaactcatgccacaaataaaatgttctttagtacttgaaaagaaaatatcaggccgagtcatgtgtcagccaaatatggctgtgcccaggcgagttgagcaaaggcttcagtgagcccgggcatggctgaagacgacctggggaggcaccaaccagctgctgggagaagagcataaggctcaagatggaaaatcataaatctaatactatcaaggaaaacttaacaatctttgatatcataaccagaaaaattaaccagcttccacaagcagaaaggaatctacctgaagagggatcagcatatgttggatttaatgctctctgtggcctcatagcaaatggtctttttcaatgcgtcttgaacatgacacaggctcttacagctgctggcttaccaatggcagtgatcccttttcttacaacaaacacagcttacaaaagttttgtaaattttccttcgaatacaggtgatttgaattgtgaaacgtgtaccataacacagagtggattggtcttgcttttggtggtctataccctcttttcttgtctatacctgtgactggaggcctagcagcctggtatgaatcaactctgttaccagagaaagggaacatcttaagttactggattcaaatttataagcctgtctttagaaagatgttatttcctattgtgttccagactgtgtttgcagcattccttgggtttaaacaatataaactacttctaaaggcccttcagttacctgaacctggcagagaaattcattgactttaagcaaacatgtacagaaaaataaaatggtaaaaataaaaaaagaaaatattacagaaagcatagagttcaaattatcacattttatatacaaggtccatttataaagaccaaggtttctatactgtatttccttacaaataaaacttactagggaaatttaagaataagagcctcattcaaaagtcggccaaacgaagccactactccaacatcatattctccagatcccacatccggccactcatatacgggaagctgagactgcacagcatattgcttcactggcagtccttttggtgatggggaaggcattgtgaccacctccagtttgtcgattaactcttcttctttgttttccctaaattagataggaagaaaaatgtgacagtgttaaggcaatgactcaaagctaaaactacttcacatatcgctaagtatgtttatgattaatctcatgaagcatttagggctaaatgattaaaactagtgtgagagactgagttttcattttttctttttctttttttttttttgagctggagtctcactctgtcacccaggctggagtgcagtggagcgatctcagctcactgcaacctctgccccctaggttcaagcgattatcctgcctcagtctcccgaatagctgggattacaggcatgcaccaccacacccagctaatttttgtgttttttagtggaggcagggtttccccatgttggccaggctggtctccaactcctgacctcaagtgatccgtccgcctccacctcccaaagtgctgggattacaggcgtgaacaccgtgcccagcctcagttttcattttttatttaattttaattatttaaaatgtaaagagtgacacgtggctagtggctactgtttgaacagtatcattctagggatttcctgtgcatacagaaacatatacagtatggatactttacacaactgggatattacatactgctttgcattttttttccttttaacaatgctatatatgctattatgtgtctttttgaaaaatgggttaaatatacgtatatttgtatattcactgaacatttctagaaggaactgaaaacagtggctgtctctggataaaggaactgggaactgctaaacagaggtggaaggaagtaacttttcactgtatatcctttgaatccatggaacttttttaccataaccatgatgccattcaaacactactttttaaaaaacaaacaaaaatacataacatggctatcattccatggcagtacctgtagcactacctcatcctttctacctgctgcatagcattctagtacccaggggggtacatttattaaacaggtattgtatgtacacgttgaggagttatgaggagtatgtcctggggcactataaagaaagcacaggagtaatggagctgccaagtgaagcatcatcagaagtatcaggataggccaggaatgatggctcaggcctgtaatctcagcactttgggaggccaaggtgagaggatcacttgatcccaggagtttgagataagcctgggcaacatggtgaaaacccgcctctacaaaaaatttaaaaatcaggcgtggtggtgcacgcccgtagtcctagctactctggaagctgagatgggatgattgcttgatctttgaggtcgaggctgcagtgagctatgagccggccactgcactccagcctgggggacagcgcgagacctcgcctcagaaacaaacaaaaaaagtgttggtataaatgtataaatgcagtgagagacgcatgtgacaacagcagcccatgaagggtgtgcaaagggaacatggggtttccttccgggtgtgtgcacagaggggtgtgtggaggaaggaaaaccacacaggggattgacgaaggattcaatacatgaggggctgctgtgaagtatctgtagggaaaaggagatggagatgaccaaaaaaagtggaaggaggactgcgtcagaaaaaaacagaatggggaaataaaaaacattaattgggaaaaagaggcagagaagtatatacggtattgccaccacataccatggactctcaggactggttggatttcaaataattttctttcccagtaaacaaaacttgttaaatattatgaatactaaatgtatacctaacagttctgatttataaatttattcttttgaaaacaggtcgtttttggactatgtccttgtatacaaggagcacagggggagcaaaagagcgagacacgggtgtgccgaaggatgggggtcaggaggaactgcaaagcagggaactttgaagtgggacctggttttagtccgaaccacctcggctgatgaccttgggcaatcgcataacctctctgagccacggattccccacactcaaaacgggcagggaggccgtgggactggcccgggggatgcaggcagagcgcccagccccagctcggcacagcgtgggtggcagggcgcctggagaacccacagaggcggcggggagtgaggggcgcagaccgcaggtactaggcgcccaaaggctgaccggcgggaatggcgcaccttctgggagccagaagacgccgagatctgggcccacaccgctctgccgcccatgctttccgcaaccagaagtccaaaaccctcggggccggccgcccgggcgcggcctggaggccttcagcggccgggtccccggatccctggcccgggtacctggcggcgtgcagcgcccgcagcgcctcgcgggcgaactggtccgtgccgaagaagagcacccgccagggaggcttctcgcggactctggagtcccggcagtcctcccagccgagtcgggccagtgctcgccactggggactcggcctcccacgcctggcgccatgagccagcggaggaccccaacagcgccgcaccaacaccctcatcgcctcggccgccggcggccggccctgcgcaggcgcatcggggcggggacaagggtgcagcctggggagggcggggcttgcctgcttggaggcggggtctggttggagttggtgaacgaatttgcccgctacagcggccctagatttttgttctgtttatttgcactatgtagccaatcctccagaataagtctttcttttctttttaaaatcgctttatttatttatttatttatttatttatttatttcagaaagggtcttgctctgtcgcgcaggctggagtgctgtggcgcgatctctgcttactgcaacctcactgctcctgggctcaagggatcctcccacctcagcctccggagtagctggggtacaggcacacatcaccatgctgggctgattttttgtagagagagtatctcactatgttgcccaggtctcaagcaatcctcctgccttggcctccccaagtgctggggttacaggcgtgagccactgcgccggcccaggataagtcttttggtaacaaatcgtgcatgttttcagacaatgaaacctcatgtatatagtgcatgtcatttcctcaaccattataaccaatatttgctgagtacttcactccgtgccacgtttttgctaagcattttatattcattattctggttaatcatcagatcaaccttaggaggtagatactattacaaatatgttactgaagagaaactgaagctccgtgaaattaaggacttaccagtgtataaggtccacacagctagtaaaggacagagcagaggtgggactcttgtaattccaacgcttgtaatcctagccgttgggccttctcagcgatcctatgtattaggcaagtcaattacccacattttgcacctgaggaaactgagccttagttacttgtctgcagttactttcttgaatcgaaggctccatctttactcctcccctgtgggttcctttgcacacagaaggataccatagaggtgattcctagggaaatggacagggaaccttatccccagaagacctccgaggaccgttagtgcttagattctgtatccccaaagcctccttgagtggagtcagacatccatgaaacaggatctgagcagagactgaaaccgaattttgttctaatcttattctcaccaccattttttttttttttttttttttttttgagatggagtctcgctctgtttttcaggctggagggcagtggcgggcgatcttggctcactgcaaccgctgcttcccaggttcaggcgattctcctgcctcagcctcccaagtagctgggacatgcgccactacacctagctaatttttgtatttttagtagagatgggattcactatgttgaccaggctggtcttgaactcctgacctcaggtgatctgcctgccttggccccccaaagtgctaggattacaggcatgagccactgcgccctgccgtctcaccaccttttcccatcacacagtcttaaacccagtgaccctggaccagtcctttttcctaaattatgagctctgcacatccctgctcctgtgcctttgctcatgctcccttcctagactgccttcccacatctcttcatctctaaatggtatccattcttcaacacgaagttcagacattcgccctgaagcttcaagctcttgcctccttagatttcttgtctttctccatgtgcccctgtttttttttgttgttgctgttgtttttgtttttgtttttgagacagagtctcactctgtcacccaggctggagtgcagtggtgtgatcttggctcactgcaccctccacctcccctgtgcaagcgattctgctgcctcagcctcctgagtagctgtgattacaggcgcctgccaccacgtctggctaattttttgtatttttagtagagatggggttttgccgtgttgggcaggctggtctcgaactcctgacctcaggtgatccacctgctttggcctcccaaagtgctgggattacaggcatgagccaccgtgcttagcccatgtgcccccttaatactctgtagggacccccatttctcatgtagtttggtattactgaggaaggttgtctaatgtatgcatagacattgagaaattcacatgtgttttgaacagaaaagagaagcaaagaggaagatattccagtaattttgcttatctgatcacatatgagaaggagagtgagatgggaccccaaaccctctattcccttgatcaagttctgttccagtatcctctcttagggtgagcagaatgtgattctaatattcgaagactggtcttttcccatacaacatgacctagaaatacaatgcaaatagtcaactggttttcaccttagaatttggctgctgcctaaagtgtaaaccttggtacctgtgtttatgccatttcttccctagtgggttttaagctcttgagttagagagcctgctttatgctacctttaattttcagcagcccgagttctcccagataaccctgccccctagggttgttttgcaccattcccagagtcctttgatgactacagagcgactgctcaggttgaggggctaattccaatcgttttctttcctccacagatccgcctcctatcactggcatctaaatttctagttaacaaacacaaacttctttttaaaattgatttgcagcaaacttctttttttttttttaaaggaacatggtgttactgtaatggctgaggttttcccaggatgtaaaaatgaaaatatttctgaaactcttggtagtgagttaagagtatgttgtagaggacgaggggtgtctactttcaagaccagataaatccaccactggaactatcataaagcacacagagaagatgaggactccagccccgaatggcaaggagttttacataataaattaagacacccagaaagcacatacaaggggattggaacccagataatgctaattcagttggtgctcctgttttcagaaatttatctttcttgatgaatagagtgtgtgcggatgctgaatcaatgaaattactccaggttctgagtctgggtgacaagacaatagcagtgtcattgacgtagggaaataacccacttggtggtcaacatgacatttcacccttgaatgctttgaaactgaagtgatgagacaagcaaatggagacgtttagtagaaaactggaatgcaggagtggcctccatgactaggggctgggagagctgatctgggaatgggaagaggcaacaagcatttccacttcctgttcccgtcatctcaccccactccatgactatatgggtatttctgcagggtgaggataactaccacagaacagaactccagttagtaaggtggccaacgcctaagtccacaagaacccctgcttgtggcctaggaggcaatgccacatttgaccaggggaaggactgccacacataggtgtcagcccagtgccaggggcaggaactgacctcaggggcacagtccagtgaagccttttgagatgcagttcctagcgagccactccatgtactgccatcgcctgcctgtggttgtatcagatgcccgcaaggaggtgctgcccaccagcctgtcccgtcactgagcgtgacggatagtccgtttgctccagtacctctgacagaatctgccctctgtgttgttactgccctgtgtggtccagtagatgtcactccctaacctgtccagcctctctgtaaatcagggccggggatgaaaggccacacacagcagtgtgggtccacaggactctccttgataaggagagagactggagaggttaagggacatctaaggggtatcaggaaccccaggaagcgaagccagatataccacaggtaggagaagcagcctaacaatatggacgtttcctcattgctgctgaggggcatcctagaaaaccaagagaatatttcaaagtacacttaaagagatcaaatattaaaaactttagttcccagccctttacccccagcaaaaatgctagacagtgttaacaaagctgtatgttgttaacaggaggaaagactagttagtaaaatagctacagctgtggccagttcttgttcttggacacctatgtttatatcggaaaacactttttgatgctgttctctgaaatcaggctccacatatggagtgataaaacagaaatccttttttaaacaaaaccgcctttgctacttcctagacagccactagatagcaccacagccttgcttcctcaccctttaccctcacgtgggactcaaagaagagcgattgcatgcaattgattagctccatagtttctaatcagctgctcactagcatgcttcctttatttaccaggttcagaatatgggaaagagaggctgaagctaccccaaggaagttttgtatagattgttattgtgaatatatatcatgtatcctgtgtggggtggtagcatatttctgtttgtatgtaagggctatcaataaatacacttctaagaaaatttttcctagaagtgtaataatttggttggttggagatgcttgtggtatcctctttacattttacaatatagattatcattctctggagatttgccaaaaccttcaggtctataatacatccctctgtgggggataatgatcatctcagtccttatgtaacagttatagaaaggctcatttgcttatatcctgctctcctgtgggaatcctacttgcctccaatctgatgtagctgactctgtaataaattaaaccagagctacccagtcttatcattaacaggtgctttctgcttgctcctcacacttggcctaaaggcccttgtatataagtcagagatcttggcttctggaagaaatatcaaaataaaatttacagccttgggggtaggggctgaaggggctgtaccaggcactttttttttttttttttttttttttgagacagagtcttgctctgtcacccagggtaaagtgccgggacgtgatctcggttcactgcagcctcgacctcccaggctcaggtgatccgcccgcctcagccttccaactataggcacgcgccaccatgcccagctaatttttttttgtagagacagggttttgccatgttgccgaggctggtctcgagctcctgggctcaagcaatcctcctgctttggcctcccaaaatgctgggattacaggctgcaccactgcgcccggccaaaatgcacatcctctttacaggggaaattccctactgtagatagctttgcttgaatgagctcaactacagtgcgaatgctggggcttattgtgttgactgtacggtcaccacggttgccgcatcccgaggacatggtcacttccttgactacctatcttgcctcaagttgaacatttgaattgttcccacttgttggctatgatgaataatgctaccgtgaacattcatgtgcaagcttttgtgtggaaatatgtttccacccgctgggcacggtggctcacacctgtaatcccaaaactttgggaggccgaggcgggcgatcacttgaggtcaggagttcaagaccagcctggcctacatggtgaaaccccatctctactaaaaacacaaaaattaatcgggagtggtggtgcatgcctgtagtaccagctactcaggaggccgaggcaggagaattgcttgcacccgggaggcagaggttgcagtgagccaagatcaagccactgcacttcagcctgggcaaccaagtaagactctgtctcaaaaaaaaaaaagaaatatgtttccaattctcttgggtatatacctaaaagtagaattgctgagtcccactctatgttttattttttatttatttattttttatttttttgagactgagtcttgctctgtcacccaggccagactgcagtggcgcgatcttggctcactgcaagctccgcctcccgggttcatgccattctcctgcctcagcctcccgagtagctgggactacaggtgcccgccaccacacccggctaatttttttctatttttagtagagacggggtttcaccatgttagctaggatggtctcgatctcctgacctcgtgatctgcctgccttggcctcccaaagtgctgggattacaggcgtgaaccactgcgcccggcctctatgttttaattcttagaagtgacaagctgttttccaaagtggctacaccgttttacattcccaccagcagtgagtgacagtgtaccatcatataactactgatactgcagggagtaaactcaggagttcaggcctctttgtgtgaactgattttgccgctgcacatggatacctggcacattgtaccagagcgcttacatctcaggattgccggggtgcctttgtctagaagcagataattctgcaaatgtggactgctgacccaggatccacctatggagaattcattatgtagaactgaatgaaaccaatgatgaaactcagattgtgttttgaaatgttgtcggtatttttttttatgttctatgttctgctaggcatatgaaaaacatctctttagtcctttatgttccatctctaactctcaatttagcgggctttaaatgttcaaactgaaaggcactttcaccacacatagttaaaggaactaccctaaatctccctgattattagctttgtgagtcttaccttggttgctatattatttcagaggacccctcaaaattcatgaaatgaataatattgtatactttagatcatccagttttcagaaatgagagactaaatgcctcagaatacctacccacattgccaaacccccttagaatccaagatgtattaaatgttctgtctaggaggtcaagactgtagaaaatctttttttttttttttttttttttttttttttttttttttttttgagacggagtgtcttaactctgtcgtccaggctggagtgcagtggcacgatcttgcctcaccgcaacctccgcctcccgggttcaagcaagcaattctcccacctcagcctcctgggtagctaggattacaggcacccaccaccatgcccggctaatttttgtatttttagtagagacagggtttctccatgttggccaggctggtctcaaactcctgacctcaggtgatccacctgccttggcttctcaaagtgctgggattataggcataagccaccgcacctggccagaaaaccttaaatggaaaatttaatccaaatggataaattaatatacaggtaaatttaaggatgatgcctccaaaaagtgcaatttgttgtaaaatgggttatgcttagcaaaacaaaaatttccttaaatttttgttttcttattataactatagtatgcctgcaaataatcaagccaggcatggtggctcacacctataatcccaacactttgggaggtcaagacagaagataactggacgccaggagtttgacagcagcctgggcaagaccctatctctacaaaattttaaaaattagccaagtgtagtggtgcacgcctatggtcctagctactcgggaggctgaggtgggagaatcgcttgagcccaggagattgaggctgccatgagccatgatcatgccactccaacctaggcaacagagtcagatcttgtcttaaaaaaaaaattaaaaaaaaaaaaaagagtgcttacttgcctgtgaatgggagggacaaaactgagacaaattaacacacaattcttacttaccaagttgtttgacattcctcaaacacattgttgaacaatatgtctgtaaaatgaaactgttcatagtgctgtgtctgagaatgattaaactttaagcacctcctatagatagactttgattttattctactcttggactctggtttagtaggggactgaagaaaatttttggttatactataaccaggagcaagaggtcaaagacatagaaataattaaggattatgaataagggtcagcaacatagatagtctcaaatgctatcgataagatgaaagggattaaggtggtggctgcagaatatctttccttggagaaagtacatattgtacttgtttttactgtttcacaccagtttttgccaaacttcctatactttgcaaatattcttgaaatgcttccaacaaaacatgtgtctgatgaaaaagactttgatcatggacatccttttactttggtataaagatgacttccctttgaacacctgtcactcctctcaaccatcctattacagatgaaggcctcaagtcagtgcttcactggaaataattttggacttacttcccctaccttttgcaaaaatatccctcactaattccactatttgtttttttttcctcttctgggtttaacataaaaattagcccctagaagaaatatgtggttccgttggtaccataatttaaccactcctctgatcctcgatatttgtatttttgtttcaaaaaaaatttgtatttttttttgttgttgttgtttttctgagacagagtctcactctgtcgcccaggctggagtgcaatggcacgatcttggctcactgcaacctctgcctctcaggttcaagtgattctcccgcctcagcctcctgagtagctgggattataggcacccaccatcatgcccggctaatttcttttgtattttcgtagagatggggtttcaccatgttggccaggctggtcttgaactcctgacctcaggtgatctgcccacctcggcttcccaaagtgctgggattacaggcgtgagcctctgtgcccgaccaacaacaagaataaattttgagacagcatctcactctgtcgcccaggctggagtacagtggtggatcatgcctcattgcagcctcaacctcctgggctcaagcaatcctcctgtcttaacctcccaaatagctgggaccacagatgcatgccaccatgcctggctaatatttttttagagatggggtctcactttgttgcccaggttggtctcggactctgggttcaagtgatcctcctgcctcagcctctaaaagtgctgggattacagacagaagccaccatgcccactcttttttttgctattttaaataatgttgcagtgaacattcttgaacatacatctctgctcccatgtgtcatcatttccttacatcgccactttcagatttcattttattttccatgaagtttactgagaagataacgtgctgtcatcagggacttggaagaactattgttcaaactgaattgttaaactggcttccacatgtaagtgatgcttgtgaaaatgagggtgagaacaaacagctagccaagggcctgtccacccctcctggcgccagctgatgatagatggcccaccccaaggagcagaacagcctgccctggaaatgcagatcagtttccaccactttgaaacctttactggctgtcagcctagcaggcgtcacatcttccgcatggggagacagcaggctgagacgcaggaggatgcttagccttaggccctgaaggtcagggcaagactctgcctcctggaacttaaccctgagctgaggttaaagcatcctctgcaatccagctgaggggtcaggtttctggacagctcagccagtattccctaccctctagcatccatcacaatttagggaaaaagttctccttcatactggtgttttaccttatttagcagaaaagccaactggttgaccccaggtggaaatctcccatgtttaaagggcctggactttgtcattacacaattggctccttctgatagtagttgctaaaatcctttgctttttcactccttgtagaaccttaatgcgttttgataaaaacttgaggtcccagtgactagctcaagatcacacagctggtcagtagcaaagatggacaggactagaagttagttctgctgccatgttatttacttatccaataaaccatttttaaacatgcagaatgtatgtattagttacagtacagagtaagtttctgtaacagggagatccccaaacttttcctgtacataacactttcagaagctgataggtggtccagggcaggtaggctgctcagctacctgaggttaatcaggagctcaaattccttctatcttgttgcctgggttgtcttttttttttttgagatggggtctcattctattgcccaggctggagtacagtggtgtgatcttggctcaccgcaacctccacctcccaggttcaagtcatcctcctgcctcagcctcccaagtagctgggactacaggcatgcgccaacagcctggctaattttgtatttttagtagagacagggtttcaccatgttgcccagggtggtctcgaactcctgaactcaggtgatccacctgcctcagcctactaaagtgctgggattacaggcgtgagtcactgcacccagctggcactttttttgtttggtaaatgaggaccaaatggcaaatattttaggctttgtgggccaatcgtcacaactgctccattctgctaatgtaatgccaaagcaaccctagacaatatgtaaacaaatgagcatggcgtgtcccagtaagaattattattattattattatttttttttttttttacaaaaccaggctgcaggtcagatttggcccataggccaggtgcggtggctcacgcctgtaatcccagcattttgggaggccaaggcgggcggatcatgaggtcaagagattgagaacatcctgaccaacatggtgaaaccccatctctactaaaaatacaaaaattagctgggcgtggtggtacgtgcctgtagtcccaaccacttgggaggctgaggaaggagactcgattgaacccgggaggcagagattgcagtgagccaagatctccccactgcactccagcctggcaacagagcgacactccatctcaaaaaaagagaaagatctggcccataggttaacaacccctgtcctgacatgtcctttccaccatcatatctgtgttccagaaagaggaatgaggaagtggaggggttgaattttctcacaaaaacatgatccacaggtagaaatagtgcagcatagtcacacaatagaatactacgctacaacaagaatgaatgaaccacaactacacacaacgcggatgaatctcacaagtataatgtagagcaaaagaagctgacacaaaagattgcatattgattgattacatttatataaagtataaaaacagacaaaattaatctatggtattaaaagtcaggttgcctttgtaagggatagtgacaagagaagacttctgagatctggaaatgttctatttctttttctttttttcttttagagacagggtcttactctgttgcttaggctggagtacaggatgcaatggtgcaattgttttatttgttgatctggatggcatatgttcccatgcatgagtgtgtccacatgtgaaaattcactaagcttaccatttgtgtactttcctatatgtatactccaacaaaaaaaagtttgtataaatttcaaaaaaaaaaaaatagtgattctgaagttgcaatcacttctcaggtctctttcggccaaaacttagaggaccacttatgactgcagggaatctgggaaatgcaggttcattaatttttttaattaattaatttatttatttattttaagatggagtcttgctctgtcacccaggctggagtacaatggcgtgatctcagctcacgccacctcccaggttcaagcgattctcctgcctcagcctcctgagtagctgggattacaggtgcacgccaccatgcctggctaatttgtatttttaggagagatggggtatcaccatgttggccaggctggtcttgaactcctgacctcgtgatccgaccacctcggcctcccaaagtgctgggattataggcatgaaccaccacgcctggcctgggaactgcagtttccagttgggtggccatatgcctctaaaatttagaggattctcttattaaaaggaagaagggaagaatgtaatctagggggaaattagcaggctgtgctacagtccacacagcagcacaggcccatgacagttatcaaatcctgctgggcatgagctgtgaagacctccaccctggcagtagagtaagttctttggttagcccacctggctgcccttgctactgttttctgggaataactcccttgaccttagttctctgtattatctgagtttactctcagataggttattcgtttactatagagcatggtcacacctttttgtccttcttcccttttgcttttttttctgcttggaacttggatataatggcaggagctgcatcagccatctaggggccatgagggagtcttagaaacctcagccctgatttccttggtcttacgacattaataactggctacttctgacattcttctatgagaaaataaactcttatggtttaaaccactgacattgggtctttgttacccagagccaaacacaattctcaactgatatggaaggcctccctaagaagatgacatttaagctgaggcttgaagggttagcaggtggcagataccagaatagcagaggaaaaccaaaagccctttccactccactacactgctgactgtctatcatcctctaggtagggagataagagactggagaagtcaggagaggagatttcaaggtgggattgattggccaggaatgatagtgatgctgtgaggaaaggagggcttggtgatgtgctctcatctccatgtgtacgtttccttcatggcacttgtcacacagaagttgtgatgacatgatgaacacccgtctgtctgttctgctagactggagtctccatgagggcagggacaatcctttcgactgtttatcactggcataatgcctggcacatggcaaccatggaacaagttattggataggccgtagtagaaagagctagggtaagaggagggagagaaaagacacagaagcagaagagtggaaaacctgggattgtgcaggctccttgttaaggggacaccatcccattagagcaccacaacactcctcagaggcagacaagggggattgaggtcaaatggttccttcaggcacccacatggcatgggctgtccagctcacagcctgtctctcctggctacccaacaggcatgatgagctctgagttggctatcagtggtacccccctccctagccataacaattgatccaagacataggtacatgactcaggctggacaattagagtcctttccaagaatttttaaacaagagctaagaaaagtagctacttcctctgcagctatgagagcatgagcctgggtttcctatcatctggtcaagcttcccggaggtggccagcctggggtaatgagcctggcacccagagaaaagcagggaaagagccacagaaacaaagcactacgggtcgtcaaatccctggttcccgtatgcctcaggtcagctccaccctgcccttcctagtttatgagccaataaattccttttgtgtttaagagagttagtgttgagcttctctcttgaaatctatcaactacctttctctccaaaatgcaccctgaatctgaccacttctcatcatctccactgccaccagcctggtccaaactactaatatgttttgcctggatgaatataacagcctcccaatggtctccctgttcctctcttgctctcctacaatccattttccacccagcaggccaagtgatcttagacaaatgtcaattagattatgtcactttcctgcctaaaccctccagtggcttctcatcacttttagggtaaaatacaaactccttaccctgttttacaaggcccaccatgaggagtggatactcctgtctgtcctctgactttattccatgccacttccccctcatcactatgattcagctatattggccacctttttgttccagacacattaagctcattatttcttcagtgtctttgtacctgcttgctttcttttcttttctttttttttctgagatgaagtcttgctctgttgcccaggctggagtgcagtggtgcgatctcagctcactgcaacctccgcctcccgggttcaagcagttctcctgtctcagcctcctgagtagctgggactacaggcgcctgccaccacacctggctaatttttttatttttagtagagacggagtttcaccttgttggtcaggctggtctcgaactcctgacctcaggtgatacacctgccttggcctcccaaagtgctgggattacaggcatgagccaccacgcctggcctttgtacctgctttttcaggtctttgcatggttaacccctcatcattcagtttttagtgtagtaatatagtaatcatgtctcccccacctcatccctttctatcttattatgttgtttaagatattcacagaaatgatcactgctataattatcttttaattatgcttttgcttacttttttgttggctatctcccctggagtttgagctccaatggagcagggccctcacctgtcttatttaccatgtatctacacagtagatgctcaagtaacatttattcaatgaataaatgaatgcattacaaaatgaggaggagctggagttccaggcagcccctagattccctgttgggtcttctttcctctgccccatgcacacacagtacacactgttgactaatgtttaactcatagaggagtttgggcttgacatgtgacctcactcagcctctgtttcatttgtgaagtaagaaataagagtgggcggctgggcgtggtggctcatgcctgtaatcccagcactttgggagtctgaggtgggcagatcacgaggtcaggagatcaagactatcctggctaacacggtgaaacaccatctctactaaaaatagaaaaaattagccgggcatgatggcacatacttgtagtcccagctactcaggaggctgaggcaggagaattgcttgaaccggggaggtggaggttgcagtgagccaagattgtgccactgctctccagcctgggtgacacagcgagactccatctcaaaaaaaaaaaaaaaaaaaaaaaaggagtgggcttatttcacataagcccactccttgctaaaccaacaatgattgcctaagatgcacggagccagttggtggaaaagtccatagactatcagagttgaatggtgctggtcaggtgggaggagcacctcattcctgcttccccatcaagttacttgccttggcctgcttcctactctctgggtcactggtgctcacacagcctttcccaacccccacctccaaaggtcatattttacagctccttgtgaggaattcacatcatgccatgaccttcactatgagaaagcacaggctgtaaaaggccagcctggctccctgctccgtggttaaatattgatgatattgggcaatagagacctggagtgggcacactacatatccccctgcagtgatggaacccacagaccgcaggtcctctgcagtccattctcctgcctgtccagaggatccggatgttttctctttacttgaggccaacacataacaatgaaagcactgggctactggtgctttcggattgtgaaagtcaggtggagcctgtttgcactctgagtgcactcattcaagaggtcagtcaccctggagtgatacagaaggctccaggcctgggcgtgtgctaaggccagagctaccagatgggtccagctgccgcaggctctccaggcactgtcccctaagtgacagctgttactgcctgggagagctcaagtgcaaagactatcctgttctcccataaagaggaggaaaaggaagatacagaaatcggtgctgctcccaacagcagatcaaggcagtcgtcaggaactcaggatccggggtgagtgtcctcatcttgccttggggatgggtggcccaggtctttggcagaagtcacagtccaatggcacgatggttaagccctgtttaaaatgcagagatctcccagaggggcttaaggagacaagacaactaaatgcagtatgacatcctaaatgggatcctggaacaagaaaagaacattaaaggcaaaactaacaaaatgcaaataaggcataaagtttaatttaatcatgcaaatgacaatatgatgctcactttagaagcaaactggatacgtgctttgatagaaatatgtctttggccgggcgcagtggctcacgcctgtaattccagcacttttggaggccgaggcaggccgatcacctgaggtcaggagttcgagaccaccccggctaacgtggtgaaaccccatctctactaaaaatacaaaattggccgggtgcggtggctcatgcctgtaatcccagcactttgggaggccgaggcagatggatcacctcaggtcaggagttccgagaccagcctggccaatgtggtgaaatgctgtctctactaataatacaaaaattagctggatgtggtggcgggcacctataatcccagctactcaggaagctgaggcaggaggatcacttgaactcgggaggcggaggttgcagtgagctgagatggtgccactacactccagcctgggcaacaagagtgaaactctgtctctaaataaataaatacaaaattagctgggcatggtggtggatgcctataatcacagctacttgggaggctgaggcaggagaatcacttgaacctgggaggtggaggttgcagtgagctgagatcatgccattgcactccagcctgggcaaaaagagtgaaactctgtctcaaaaaaaagaaagaaatatgtcgcttgtttctgtggcatctaacatagctgaggagggctgactctcggttctggatttgtatccaatttgtcattttggttttttgttggttggtatgtgtttactgtaacaatattaaacatattttaaacatattttggccaggcgcggtggctcatgcctgtaatcccagcattttgggaggacaaggtgggcaggtcgcttgaactcagaagttcaaggctggcctgggcaagatgatgaaaccccatcgctacaaaaaatacaaaaattagccgggcgtggtggcacatgcctgttgtaccagctgctcaggaggctgaggtgagaggatcgcctgtgcccgggagatggaggttgcagtgagccaagatggtgccattgcactccagcctgggtgacagagccagactctgtctcaaaaaacaaaaaacaaaaaaacaccactccactgtggacaatagcttacctgcgtctttgtacactgatctgattagttccattaattaaatatcaaaaattggaattgttgtctcaaaaggtataagtacaataatacctacatttaaaaatgcatacaaaggctgggtgcagtggctcacacctgtaatcccagcactttgggaggctgaggtaggcggatcaccaacctggcaaacatggtgaaatcccatctctactaaaaatacaaaaattagccaggtgtggtggcacatgcctgtagtcccagctactcaggaggctgaggcaagagaatttcttgaacctgggaggcggtggttgcagtgagccgagatcacaccattgcactccagcctgggcagcaaaaacaaaactccatctcaaaaaaaaaaaaacatacatacaaatagacaaaatatacatagaaatatatacacacattaaaaatggaattacatgtattgttctcatgaaagcagtgtatacgcataagaaaccacacaatacaggagtggtcaacatgaatatcccatgtgtctaaatctcatcccacaccctagaagaagactgtgtttggtttctcaacttcaatacttttctttgtgagttcaggggtttgcatatggcacaggggcctgtggctgatgttactaatcaatccaggcactcttacatctgagactggatggaatgtcacaatccttcttggacagtgctctggacagtcagttggagctagaacacaagatcacatctgttggccattcttgtaactttgtctttccatgattttagatgggtaggtaggcagatagatagatagacagatagatcgatagatgatagatagatagatagatagatagatagatagatagatagaatctccctcaaatgagtaagtaggcagtgtgcatgtgagtccttgaaagtctaagaaagggccaggcacggtggctcaggcctgtattcctagcattttgggaggccgaggcgagtggattacctgatgtcacgagttcaagaccagcctgggaaacatgaggaaaccccatcattactaaaaatacaaaaattagcctggcgtggtggcatgccctgtagtcccactacttgggaggcagaggcacaaacgagaaccgcttggacccaggaggcataggttgcagtgagctgagatcacgtcactgcactccagcctgggcgacagagcaagactccgtctcaaaagaaaaaaaaagaaaaaaaaaaaagtctaagaaaggtctttttttctccctgacttccatctccaccttggcatatgaatgatcattcacatatgaaaagcttaagtcagtattgtatttgtgtcaaaatattttcccttgcaatttgtagatatgcctttttagttttctcagagcatttagtgctagaggaaactctgatgtaaagctagtccttttgttgatactccaattttctgtctggctgtttgccatctagctgtttttgaatgcccctggctaagtgtccaaaggctatttggggctgagattgttgagcacctaaggcagtgacagagtgtgaggggacctgagaatgcttcgatcctccctgtacactttttttcttggtgccctatggcatgttttataattgatctgttcaaaacacttctcttgttttattttagttacgtttatctccattcctactcccttcctcctcctccccaagacacagcttaatgtgtttaatgcgtgtccttttaaaaaaatgtgttattgggtcaggcgcggtggctcactcctgtaatcccagtactttgggaggccaaggcgggtggatcacctgaggtcaagagttcgagaccagcctggccaacatggtgaaaccccatctctactaaaaatacaaaaattagtggggcggtagtgacatgcgcctgtaattccagctacttaggaggctgagacaggagaatcgcttgaacctgggaggcggaggttgcagtgagcagagatcgtgccactgcactccagcctgggcgacagagtgagactccgtctcaaaaaaaaaaaaaaaaaagcgaaataacttaacaattttaatattggcctgaataatatatgttgtcaaaattaattttacctatttctttttgttttgtaaagtatggatgctagaaaattttatattaagtagtaataatgcagttagtacaagaagacgtcaaaatgtctgactgttttgagattgactgaggttcagtttattattaatagttgggatggaaataggcctacacgaagtaagggatttatccagagagcatggattcaagttcttcccttgcaaataacagaaaccaattctgctaacttgtccaaaaaaaaaagaaaaagaaaaaaaaagctctcggggtcggggcagggggtgccctctcagcatcaggagccggcagctgcctttccctccggcacttttcccttttctcctctctgtgtcgtaggcgtgccaatccccaggagagaggcgtgataggcccagcctttgacatgtggggaaacacaggcctgtgattggctaccgcatgacacccaagggacaagttgctatggcaacgcgtgggcgcgctgtgggctcgtagaagccaggtgcggacgctgaacaggcaggcgaagacccgagatgtcctttgcaagggtcccagaactcgccagtggctcagtcctcctcactcccagaacagtgctcctccacacatgcgatggcttttaataaatatttgagtcactcccacttccagtctctgcccctccaggctccacgtgctcctgggttcgttcgggtcgtttttgtcccataactttgggccagaggagatctggatttgggcacagagggagatcaaactcgggtgggatatccagtcatgctgtctgctttgtttccaggggtcttcacggcttctctgcccaggggccagaaccgaggaggccaggagggctgctggggctaaggggtctaaggacctcgttgcacacgctaccaggagcaggggcatggagcacagtgagggggctcccggagacccagccggtactgtggtaccccaggagctgctggaagagatgctttggttttttcgtgtggaagatggtaagtggtgagagattgacggcaggggtgggggtgtgcccctcaacacagagcagagtttggctgaaggtcctgacactgtcgtcccctccaggtcaggcggtacatttcctccaagacagggaatcagtcggggtgtctcagtacccagaggggtctggctggaccgccccttccttttctcagggtgtggtcgcttatttatgcagccctccaatcatcacatttattaagctcctactctgtaccagacactgttctcagcactggggcgacaatagtgaataaaacacaaaaatctctgccttcatggaatgtacattctagtggggattaaaaataaacaactaaaacgcatagtgcgttggtgatgagtaataaaaagaaaaattaaacagagaaagagaataggaagtatgcagcaagggcagtaatgtggtcaaggaaggcctcactaaaaaggtgacatttttatcatcaggaaggtgacttgcaggaaactaaggaaataattaggtatgcaaattatttgggggaggaacattcctggagggaggacagcaaatgcaagagctctgaggctggaccctgcttcatttgggtacagcatggacaaatcttgagtagccacattcagtttagtcacttcatgtattatctgtgggcagttgccattccttccacccttctccctgccttctttctttcctttttttttctttcttcttcttcttctttttttttttttttttgccttttttttgaggcagggtcactctgttgcccaggctggagtgcagtggtgcaatcttggctcactgcaagctctgcctcctggattcaagtgattctcatgcctcagtctcctgagtagctgggattacagtgtatgccaccacacccagctaatttttgtatttttagtagagacagcatttcaccatgttggccaggctggtcttgaactcccgacctcaggtgatccacctgactcggcttcccaaagtgctgggattataggcgtgagccactgagcccagccttctttcttttccttgtgctccgcaggtccagcccaggctggcaaaactgaagattgtgaagtttatcttggcccacctgtctcctgccctccgtaggcctctgcccttcacccctgttgccccactattatttaactgcagtactgtctcctccattagattagggcttctccagagtagagactgtcttccaccctcccacctgttagactgggagtgccccagggcaaggggcccatctttgattagggtctccacgcaaaggacagttgatgctgtaagctgggtctgagcccaggccccagctgttagcgggcttgagaggtgcctggccattcctcagggctctgtcctgtgtgtccttccccagcatctccctggaatcattccatccttgccctggcagctgtggtggtcattataagcatggtcctcctgggaagaagcatccaggcaagcaggtgaggagctggtcctggggggatggggtggtctctgtggggtagaggccctgccttcccagagggaaatctagagaggggtcacttaggggtcattgctgtccaccctttgggacagcaaaattcagccttcagtgtccttcgagaaccccaagctgttaaaaacaaacaaacaaacaaacaaaaaacagcaacagtccctgattaccaccccctggccctggacaggaagcaggcatgacctggaggagtgtagccattcagaaggcgagcttgcccctctcaccctatcagcacacatgcacctcagcaaagtcaactcagagatgagtggctgtccatgggtacagcagacctgttccccctacgacccagtcagaatctctaggcagacagcttaccaccgctgggtccctccactatggccaggaagtctaggggtaccttgaataaaaccaatctggagagaggacagacacatgggagttattaaggaagtgggcagtgggagccaatgaaggtggttgggggaggggagtgatgtgtacacgatggggttttagaaacatgactggtgttgtgcctaggctggtttggagaaggaaacacctagaggcagagagattagttagaaatttcctgcagtagtgtgagggatgaggtgtgtggtgacaaggacctacgctaagtaggatgacagtccaaggtcagagacagtgtggttaggtgaaaagaacacaggattcaagagtcaggaggcttaagtgcacacactagctatgtgcatccttggctttttttttttttttttttttttgagacagtctctctattgcccaggatggagtgcagtggcacaatctcggctcactgcaacctctgcctcccaggttcaagtgattctcctgcttcagcctcccaaatagctgcaattacaggcacaaccacacccagctaatttttgtatttttagtagagatggggttttgccatgttggccagactggtctcaaacacctggcctcaagtgatccacccgcctcagcctcccaaagtgctgggattacaggtgtgagccactgcacctggtctccttgaagcacatttcctcacttggaaggtgcgggggtggcaatgatacttgagctcacaggtgacagtaaggattccttgagatgacacacactcaagggtaagccatttctctgttgaaggaatatccaaccattgccgcttctcctctagtagctcccaaactgcatagagaattttccccttagactctttaagccatttgggcgacccagtcctgccccaaccactcagcccccctcattaacactgttccctgtccccccagaaaagaaaagatgcagccaccagaaaaagaaactccagaagtcctgcatttggatgaggccaaggatcacaacagcctaaacaacctaagagaaactttgctctcagaaaagccaaacttggcccaggtggaacttgagttaaaagagagagatgtgctgtcagttttccttccggatgtaccagaaactgagagctagtgagggttcagagaagccccatcctaagccagacacatgatgtgggctcagctcagtggcctgaaacctctcaggttttagagtctctcccaagaagccgcttttttctttttctttctttctttttttttttcttagcagatacaatgaatgaactgcaagcaaactaaaattctgttattaaaaaaaatcttttattaaaatgctcctggaagggagcaggtggtattgcatagtttgttcagatggcagtggtacacacacacatacacacacaagtggcctggagcaaaagtgcaaaatccgtagctggcctgtgggtcgggaagcctgtaggactgcaagcatgtggtcttgagtagttcacagcccccctctgacctcagctcctccatttacagaatgagtccgaagactgggtcagagatgctgtttgcaatccaacagtagtcctgagacggctgagaggggaaggagcaggcttccaggcccagaatccccttcccaatccttccacccaccaggaccctctcttttccctgcttgtctgctaagagtctgtgcaagacttccctgggacctggcgtgtggtaaacaaaatcagacaactaccacactgcctgccttggacagccttttcttgctaacagtgggatctcaaaggtgtgtcctgatcccatgtctgagccatggtgtcttggtataagctgcggtgacaccaccaaataacataagcaaaattttgct

SEQ ID NO: 189 - DNA, 167394 bp, Homo sapiens
cttgtgagagaccacaatgagggacatggcaagttcctggccactgcccagaaccctgctgatgagcccactctaggagccccagccccccaagagcttgtgtgtgctgacaagcaggatggccagtagaaccttcaggcagggtgagcaggcaggagcaggggaggctcgcatggcgctccgatcccctcctccctctctccgaagatctttgtgaggtgagcctcactgacagcgtggagcccgcaccaggagaggccagggagggttctccccacgacaaccccactgcacagcagatcatgcagctgcttcctgtaacgcaggactccccaggagcacccaggcttgggcagcaatctctgcatgcctttcttttcgagctgccgagaacagggagataaacaccaccatcatctaagagctggtcaagaaattaaaaaaaaaaaaaagttaaggggttaatctcctacacaattcatttacttcatttgaatgttagagccactcatgtttatttgtgtttctaatttatagtttaaattttatttgtaaaaagttaaaggagagtgggtcttttcctcatgttcactctggcatcctttagcatgtttcttttttaatttgataattgtaggtcattagcatgcatatcaagtttgcccttatgtggtgggtgttcaaacacacaaagacccactatttgcacaaaactattcttcctggtttgggataggctgccatgcttttttaatgttattgcagcatgtatatttattatggaattcagataaaatttgcttatgttctgctattatgtttgatcgaatcctaatcacagtgagctcttcatcagctcaatatgtggtttgccctgaagtgcgcggtctattactttgtaatatgccactgtgagtactgacatttacagttgcttaaaggcggagcactggaaacagcctttccccctttttctgtgtattggggatgggagtaataacattttggggagctttttaaatctcccagaagaggaaagtggcctgctctggcaggtatgtgcaggatagagtgtgttttatttgttttggtgccaagaatgagcactgtactatggtagttcccttaggatttgtatgtgttctgggcttatgaagatattgcatcatgagctgtggcagttgtactcttttttgatgacctaaaaagggcttatttctgaggaatgaaaggctcccatcgttgattgtggatgtggaaaacctttcctagcttagagcatttatatctataacacattttaaagtcagagttcatggtccctgttttaatcacgtgactacatgtcccagtacacaaaagggcactggttggcattcttcttaatgtatttagtaaagatcataagaaatcctttaagagtttagatgtccctgaaacaggcatacaggctctagtcaggaatgaattcgagtgaaggaaagctatgtgacacctggcattcctctctgttcacggagcttctctgaggctagaagattaattttaccatctagacctctctggctcatacctattcttcaaccacattggctactttgacataggaaattacttcttttccttgaatggagaacactttaaaaataatattataaatgaatatatgtgagagtacttggttgaaagaaaaaggagttttagtagacagtattattctatatttgaaaatcaaggagaagtttatgcgacttaaaatgtttacaaactgcagtgcaatctactgtttgtgaatgtcaaagtcttatcaggaaaagtgtctgtacaatcacagagtcctacttcctccgaaagttctttacgaagagtgaaatatgtttttgtacctttcagtttcagttagaggcatattttgtgcaatatttatgtgaatgcgcctatatattatgaatgaattatttcagtcatatgttgcctaaatcataacttgatgatgcttgggaaagaatcaacagttaaaacctcatgaagttctaatgtctgtattccaaaatacatcacattattaggatgtagggagagatgtatgtgcgctccctggtgtggggatttgtagttactagaccgtctccatttggcatcctcatgatacttttataaatatgacattaataggaaagcagtattatttttcagacaaaataactgatttgcctggattcacggaaaaaaatgcaaatattgggtccttgtgacttcaactgactcttccaaattgtatgaatttattaatgtattagataaacctagtttcagaatgataaactgttagaccaaataatgtggctaattaacagtggtacgatttctagcccgagggtttaaaatggacttaaggtcctgttgttgccttttattttctgaacttgctgcttttgcattctttgagttcagtttaaagacagttactttaagtccattttaaaccctcgggctagaaatcgtaccactgtcaattagccacattatttggtctaacagtttttctttatcattctgaaactgggtttatctgatacattgataaattatttcaaaggtattttaatagttcaaatcacttcacttttacattgataaatgtaaatgactaggaatgaccttcggatagcgtttagcatctgtaatcaatctgacaataatgtgttcatcaggtacctctggattaactcacataccggcatacttaagctgaatgtctgtctggaaataaatttactatattaactgagatactactttttgtgtaggtatttttgtcatatatttaagaaaaagctaacaaggatggaaatcatattataataacttaagtctttcttcaaagggcatgcagtcttttgcaatacctcattcagccagatatttgttctctttctcattcagtataagacagctttcaatttgcttagcaggcaacattagaaggttagagttcatggaaacatagaattttaaaatgtgagttcaaccgaataaatttgaatttctgtaggaggtaaagaatcaaaatacttgtttatttaaaggttgcagtatatgataatcattttgaagtatttgattaatactaataggttttccagaactgaaaaactaatgttaaaaccaaagctgatttctagaaaatttgaaaatgtaaatcagccttatccagaatatagtttctctaaaactttcttagtcattttacaatagtataactattaaaaaatgtaactgctattttaatgttttgaaataaattaaaacattttaaaatatgaatactgtagcttaaaagaaagaaactaggggaaggaaaagtaaagaaagaaatgccaattccagtccaaaactttatttgccaagttttcttataatgacttaccaatttaggaattcttgtaaacagaatctataatggaaatactgaaagacttttgcctaaagtggcattattgaatactgctgtgatgctactgtatgtaataaattattgttgcaaagtgctgtttttgccttaaatttttattttgtgtgtcttgaaaactatagtattaaaggtattgagattgtgcaaatgccaggcatgcttggcatgaaatagtgtttttatttttacaaaattgtaatatgactatgcaagcatttaactaattaattaatttatttattttgagatggaatttcactctgttgcccaggccagagtgcagtggcacgatctcggctcactgcaacctccacctcctggtttcaagcagttctcctgcctcagcctcccgagtagctgggactacaggtgcacgccaccatgcccagctaatttttgtatttttagtagagatgggggtttcactatgttggccaggctggtctcaaactcctgacctcgtgatctgcccacctcagcctcccaaagtgctgggattacaggcgtgagccaccgcgcccggctgcaagtgtttaccaaaagaacacatactgaaaaaatagttatgggattttaaaaagttaggagattaaaaaaagttatgagatttaaaaagttatgagattaaaaagttatgggataaagttacgttatgggataaaaaagttacgggataaaaaatgttatggtcagtggctcactgggcttacaggtgtgagctaccgccctgggcctagttccctgcttttggatgaccgcgatcttcatctcatcttcacctgtctcccccatcagacacttctccaggctttgctgaaagtggcctgcttttatttatttaatatttatcacataactttttttcgtaaaactttttttggaatatttttccataactttttccataacttttttcccacaacttatttccaaaacttttttatttttatttttttgagacggagttttgttcttgttgcccaggccggagtgcaatggcacaatctcagctcaccggaacctccacctcccaggttcaagagattctcctgcctcagcctcctaagtagctgggattacaggcattcaccaccacgcctggctaattttgtatttttagtagagatgggtttctccatgttggtcaggctggtctcaaactccctatctcaggtgatccacccactttgggatcccagtactttgggaggctgaggcgggcagatcacctgaggtcaggagttcaagaccagcctggccaacatggtgaaaccctgtctctactaaaaatacaaaaaattagccaggtgtggtggcgggcgcctgtaatcccagctattcgggaggctgaggcaggagaattgcttgaacccgaaaggcagaggttgcagtgagcccagatggcaccactgtactccagcctgggcaacagagcaagactccatctcaaaaaaaaaaaaaaaaaaaaagttacagaaaaaacgtgattaaaaaaagtcatgggataaaaataaaaacaaaagcaggcccctgtcagcaaagcctggagaagtggggccagaggctccacccccaccatgtccctgccaccccttcccagtcacccctttaccattagagtagcaagacaagacccctgtctaatagggagagacaaacagaccctttgccaccctggccagggctgagtccttaaatttctggatgatgatgattgttatttaagaggcagaggctgatgggagttggtttgttcggaggaggcctcatggcctccttactttcaccaaagcaatttttccctcaggctcccgtcttcttagtcagagaggcagctgaggcgggacagtggggctaactgtagaccaggcaagggcatgagctgctgagggtggccccccttcccccatgtacacattgtgtctgtgtaacgttttatatattctggggggtagggccgcccctgtatagtacctagtggagattggagctggcacatggcggggaggttctaataattatttgcagctggggaatttatttgatagcataggacagaggaaggaggcggggatggggtcgtgacttcctggcgatgcaactcctgtttattttgctttttattttggaataaatggatttagccatactgctagcctggtgtgttcctgcttcccccactgggtcctggagtttgtgccactgaacgaggagccccagagtgtccgagcatgtccagctggtctgttggggaccttccagacctgttacctgtatgctgcctggtgacgcgtgggggagtccacagggactgccatggcgcctacggggcacagtccggccctgacggccaacaggctcagaagcctgatctagcggtggccgggaaggcaggatgccagcacccacgggcactgacttccatgcaccccaggcatcttcctttccgccccactgcctccctcgcctgtctgcacctggtggcctgttcgacatgtctgtccctccagagtgccggctgcccctcaggctccttccgggctgagttcatggccctgccccctagtggccagagcaggcttcacaggatgagagccagctaagctccaggggctttccaggaaaagtgttccttggaaaggatgtggccttttcaccgctcccagtaccctagtaatggcttggccttacccctcccctgagctccaaagacaacacagagagcagaggacacattccgcgtcatccagaaatgggtttgcttgtcagccaagggagagcaggactggtagagactgtcaggccacacggcaccccccattcttggcagggggtgggagggatggtggggctggctgtccacaggccgggcatgacagggaggcccactggaggtggcgcactttggaggggggatgttggggaacagatatgggtctcagtaaagaaatctgctcttttacaattcctgcaccaatttgccatacttggagatgacacatagcagcttgttttttactttttcaagaaaggatatcatggaaagaaatcgagctgcctttctatgaatagaactcagttgccttccagccataggctgcatgcttcaaaatgttcttcagaaataagaaatgggttgagctgcaccatccacagccttaccctgagcgttcccaccatgacctctagcacatacgaagtgctttggttaattatgaaaccagtgaaaatgagatgaaaagtcctattctcatgcagacccgttgggttatgcagagacaaggtcgcagggacacagccctaaccacagtctgccctctggaaaacacgtgtctgttcacatggaaatgacacaagtctagttctcgtccaaaagtcatgcagcaaaacaaaaatgtctgcaaaactggcaagagtttttaccatgactttaattttgagggtgctctttagcagaggctgttgatgaaggaagaattctatcaaccaggaccactgagcaggaatgaatctatagctcccttttttaaggccagaaaggaccttaagttccttttgtttccggaggagggacctgaagcctagagatgacaaaagatttggcttctttaaaggatccatccagccccctccatgaaaaggaaatgagccagtgttggtttcagtattctaaacttttggaaaatggtaaaactgaaggacattgaacaaaattactagggttttttctatcttgttcagtgagtgtcaacatactacatgtttttcataatggttagtttttatgataaaaatacattctcattgtataaaatttgggaaattccaaaacctatggagaagaagatttatccataaccccacaatttattcatttgcttattccagcaacaaataaaagtgcatgccttactaagagcagggcatgttccaagactgactatccagaaatgatagccttgaattgattcccttccaacccttttctcaatacactactactactaattttaaaatcaggttatttcgttttggaatctccttttcacttaatatatcacaaaccttttcccagtttatcaaataatattccaagctatgattttaaagctgcctcacctcagctcacatcatatcacatcacatcacatcagtttacattattaaaccattctacttgggacataagagatgatcaatttttcaacattataaataatgttgcatgtaatattctttggtcacatacctgattatctttggaaagcttccctaggattcagattgttagatcaaaagccttaaatatttttcaggttctagatacacaatgctcgattgctttccttttttttttttttttttttttttggggagacagagtcttgctctgtcgcccaggctggtgtgtagtggtgtgatttcggctcactgcaagctccgcctccccggttcatgccattctcctgcctcagcctcccgagtagctgggactacaggtgcccgccaccacgcccggctaattttttgtatttttagtagagacggggtttcactgtgttagccaggatggtctcgatctcctgacctcgtgatccacccgcctcggcctcccaaagtgctgggattacaggcgtgagccaccatgcccggcccaattgctttcttgaaagagtgtaatagttttacttccaccagctacaagagtgtgtttcagtcatacagcaaggcctgcctctcgaaacaacacctatgggttaaaaaaaaaaaaaagtcattgtcaactgagtcaaaatggtttttcttttaatttgcatttcttacttgacaacataagtcaaactttaaaaaaaaatttgtttcttcataaattacctttgcatgctttttgtcattttcctatggaactgttaatgtttcttcttagcattctagtcttaatattttttagcaaaggatttttctgactgcattgtgagatctggcctcctggctggggcggcaggaggtgggatggagaaagggcggggtgtcagagccaggcctgttctcttagtccttccacaatcgccaaggtgtgacctgggccaactcttggtatctctgggcttcagttcccttccctgtaaatagaaaggtcttaattaaggtcccttccagtgctgtaaaagggagtttcaaagcttctctcactgttatgattgtgatcagcttcgaaggaggtagtgctagtgggtaaacatcaaactgtaagcttgcttccccagttccaacctaccagtaccacctacactgagaaaatcactttgatgctcttagtttcctgatctgtaaatggaaaatgtgttttacagatttgttgtaaaagttatgtgaaataataaaaatcaaagtgtatagattataatatactacagacgggccgggcatggtggctctcggctgtaatcccagcactttgaggggctgaggcagacagatcacttgaggtcaggagttcgagaccagcctggccaacacggcaaaaccccgcctctactaaaaatacaaaaattagccaggcatggtggtttgcccctgtaatcccagctactccagaggctgaggtgggagaatcacttgaaccccggagacagaggttgcaatgagccgagatcataccaaggcaccccatcctgggcaacagagccaaactcatcccaaaacaaaacaaaacaaacaaacaaacaaacaaatgtatatatatacacacgcaccacagacatacacacacactgtgaagttgcatttttaaagaatttaattttcataaatcttagtgcacaaacaagtaaagaaaacattttttaccctgttgcatgtatcctccctttcaaactagactctagcctccaggggtccaaagagaatgagatgacagagagaatgtaaatagaaacaaaagaagctaaatcttagtgtttgggcttctaagtatggagcctcaagtgataatacgcaattttctgaagcacttctgtacatgattttctccttgtgtgtgctgacttgacagcttaattcacacacataatacacacacacatacctcacacacataaatctaccatatatatatatatacacaacttacataagtgcttcacacccactatatatctaattccttttataggcatatggcaatgaaagcagaaaatgtgattcaaaaaatagaaaccactctcattttctttaactctttcctttaattttggtcatttaaagcttataaatttgacagactgtatttttaaaacagactatttttaaaacctttaatactagtctcatacatggtctatttctattggtttatagtttgtcagcaaattgtattttctacccataggtaaatgtagcactgttctgagcaccaagaagacataggcagggaatagacactaccttaggatcaagaggagacaagacatgtaaacatgtcattagctaagtgtgtacataaatccagttctgtcattaaagagtaaatatgagagcagggagattttctggtgggtgggcgatgattgcttttttcttccccacgctctcctggcatttttctccccttccttgggactggattatagaatgcaggggcaggccaggagcgatggctcacgcctataatcccagcactttgggaggccaaggctggtggatcatgaggtcgtgagtttgagaccagcctggccaacgtcgcaaagccccgtctctactaaaaatacaaaaaaaattagctgggcctggtgtcgggtgcctataatcccaactactcggtaggctgaggcaggagaatctcttgaacccaggaggcggaggctgcagtgagccgagatcgtgccactgcacttcagcctgggcgacagagcaagactccatctcaaaaaaaataataaagaatgcaggggcagttcagcttatacatcatgggcataaacaatggccactaattgaaatggtagtttgaagctagccagaaatagctcttcacaaaagagatcaagtcttactctgtaaaaagagagtaaaagctgagaaaatatttctgaactaagttcaccttacacaaagaacatatccagagttctagaatatatggatatgctaggggaagaaatacagatgcaggcaatcccctctcctcaatcagagggacaaagggtggaatatgatctctgttctaaggccgtttgcactttctgttcatccttacccacttgtgatgtgttgttgtggtggttgtttctcagcaaatgctcttaagtctgttacgtaacctttctaagcactttacacatatgaactgatttgactcacataataatcttctgggataagaactattagtatcattcccacttgacagatgcagaaaccgaggacctgagagattccataagtctccctggcaaattggattcagccccaggaagtctggcttcttggcctacattcttgactataaaagttgcactgtctctttagctgaagggtgaacttaggcatttgaacagccaaggggttgtgggtagagtgaaaaaagaaaggaaaggctttgaaagttatcctgttgtttgaaaacacgaaaagagaagagaaaaagaaggagagagcctggaatagctgtgagaaggcaatagaagaagtggaagaacaggaaatggaagaaaaaaagcaaagagaaattgaccttgtccctgctagggtccaaatctaacggcttgctcgggctggaggggctagaagtgggtgtctctgctttcaagcagcgcatttaacttcaccggctttccccaggctgtctctgcagcaacccacacgagggcctcttttcacagcaattatgaaagtgatggtgggaggaagtacagctcacttattgaggttaaaaagccacccaagtaaaagcattaacccagtagtaagattaaattcctggccccaaagggaaattatcaggaggtgtcctttaccatgtgtgaaatggaaacagtttcctctcttgggcaaaataaccaattgctgtgggaggcggaaatcaatgcagtgtttggtgaaaacttgggtttctctgatgagttctgtgaaacgctaacgtctaacaggggttgttcagtctatccaataacattttcttcccgtgaccttggatcttaacgttggctccgctcataaatgactgtggaatgggaatgagagagtaagctcttgacagctacagggaaatgcacttctaaagaacttggtataagagggaaaatgagatggtcctccaagagctaaacaacaagatcaatacatattgtatggagcagagatgtgcaaagtcatcatgttgaacattctgacttgttgaacatgttgaacaatctgattgaggataataacacagctaaaggaataatagtcaatttaaggtagagtttgattccatgaaagaagaaaaaggagagagaagtaaatgcatgtattctgtatatatattgagagtctgctaagcactgtgctaagggcatgaacaaattctactcctgcctttttggggttccagagcaggctgacagggtccatctaagaacagctcagaagaaaaaaatgcatcttcgtcaaagatatccagtatcctggccaagagcagtgcctgccgtttttgtagacgctgttattctttttcccatattcccatctcaggctcatagatgagggaacttctccccatctgacttgcagaccattttagggaacacttggatggacacgtactctctcgctttccctcctttcattcttctctccccaggataagagtagctaatctgactcaagacagcatatcacccatgtggcctcacatgtcagaaggggttgattatggagttggggcactgcttgtgcatggcacacttttttgccttctttgattggcctgcccagtctcagggcccttgcaccccagctcctcagctggcttccttttgctttccttctgctccagcttctcacagtgcatccaggcaggcaagtcacgttggccctgccctctcttcagtctaggtgaggtatcaaaggccagtactttggctcaaccccaagttgaagtctctagctctgagcgctggagcttggggggcacagcctaccacactcatctccagaaagttccctgggtctggtctccttctcatcaagaaactatgtaggtaaaaggtaaagattggtaagcctcacttcaagccattcttactagataacattaaacctttatagtcacctcccatccccctttctacatcaacattcaccaggcaaaattctaactgggttatgagttcacatgggctggtcaggttggctccagtggtccaggctgtgtcacagttattgtcatcataggttaatcaggaggcattctggttgtccacacctccactggatgacatgacccgtatccgagataccagctctcagcttgttgacaaaagtgggtgtctgaacctgcagagctacagagggttcaagtcaccaagttcatggaatcccacgagccttgtgcttggaccacccgcttatctttccctttaactccccaaaaccaatacccgctgtcctttgatgtgtaaaacttccacaagaacaaccttgtaagatgtttgagaagatgaaagataatgcaggagagcccctaatagggtgcctgacagccagtagacaataaccatgggaattgctgctgctgctatttattaatattttggagataagtatatatatatagatgtatatctatatatgtatatctatacatatatttatctattttaaaaggaataataattattatttattatatttattgattataattattatatatacttatatattattagtattattaatatattaatattatataattgtgtttattatatttattgcaattatttataattatatttacttatttaattatagataattatttataattaaatacatataattatttatcattattactccttttaagatacataagataaatatatatatttacacatatatgtatttacacacatatataaacaatatatatatatgtgtgtgtctcaaattattcttaaaaggagtaataaataattactgtccataagaagtaggagaaattatttcccaatgtacctaaagacagtgaggtagcagttaggccacagtagttctaagggcctgccattccctactctcttatcactcttgcaattacttggtctgaatggctctatctagcccaactccctagctgactgttcatcttccaaattatacccaggtgtcatctgctttaaagtggcatgcattcatgatttgactcaatatctaattctagccctgtgaagcactggccctgattataaatcccgcacgtgcaggcattcgtggtccctgtgggtgcacaagatcagggaacattcccagctaccttttcattaactcctcagaggcattcatgaatgctcgcaacagcagggcctttaagcctttctgataaataaccacagcaagaagtgtacacccaacgcacacacgtgcacatgcacgcacatacacacacatacacctacaggactgaaacagaagccttataaaacactacttactcttaaaatgtagactaattcaaaagtctatttttttaatacgggctaagattcactaaattgatttcaaaacctactaagggctcaagcccggctattttaagggacactgtaatgaagactctacacagagatcaccagacctcgtgttacggtctcagcctagtttttcatcacatttttttcttgcgagtcctgagagtgctgtgtatctattgtgaggctttgctgttatttttgttgtcgtttttgatgttggggctaacagatgatgatgagacatggtttaacaatagcttcacattaggaaaagtatttttgttacccaaaacaaagatttctgagaaccttggtgtcttgagcctgtgcacaatatggagggaggatgatgatgatgatgattgtgcttttcgtgtattaaagaatcattgtaaaaatacaaatactgcccacacacctggcaccaagtagggacccatgggagaggagtgatggcactcgtacccacccaacactcactctccacaggtccactgacctgtcatgtggctgaatggagggtgacctcaggcttcaggaggcagacccaggtcacagacctgatgacactgttttccagccctgcagccttacgcacatcatctaatctcgctgagctttggtccactcatctctgaaatgggcataatacgaaagccatggactctttgagaggcttgagtgagactgcatcgtgtgcacaaagggaagccagccagtcctacgtggctggaggaggaggaagagagagcaaaggggaaggtactgcacattttacaacaaccagctctgtgagaactctatcatgagaacaggaagggggaagtctgcctccatgattcaatcaccttccacccggcccctcctccaacactggctcaatcttcgctcactgcaaccttcgcctcctgggttcaggcgattctcctgcctcagcctcccaagtagctgggactacaggcatgcgccactgcacccggctaatttttgtatttttagtagagacggggtttcaccatgttggccaggctggtctcaaactcctggcctcgagtgatccactcgcctcagcctcccaaagtgctaggattataggcgtgagccactgtgcctggcctgtcttttgaataaaggctattttaactgaagtgagatgatgtctcattgtagttttgatttgcatttctatgataatcaatgatgtcgagccccttctcatgtatctgtttgccatttgtatgtcttcttttgagaagtctctattcagatcttttgcccatttttcagttagattattagatctttgctattaaattgtttgagcttcttatatattctgttattaattccttgtcagataggtagtttacaaatattttctcccattctacagggtgtctctttagtttattgattgtctcctttgctgcacagaagctttttaatttgatgtgatcccatttgtccatttttgctttggttgcctgcgcttgtagggtattgctcaagagatctttgcccactccaatgtcctggagagtttccctaatgtttttgttcagtagtttcatagattggggtcttataattaagtgtataatccattttgatttgatgtttgtatgtggtgagagagaagggtttggtttcattcttctgtatatggttatccaattttcccaccaccatttattgaagagactgtcctttccacaatgtgtattcttggcgcctttgtcaaaaatgagttcactgtagatgtatggatttatttctgggttctctattctgttccattggtctatgtgtctgtttttatgccagtaaccatgtcactttggctacttagctctctggtataatttgaagtcagggaatgtgattactctagttttgttctttttgtttaggacagttttggctatggcgggtcttttgtagttccatatacattttaggatttttttttctatttctgtgaggaatgtcatcgatattttgatacagattgcattgagtctgtagattgctttgggtagtatggatgtttgaacaatattgattcttccaatccatgaacacggaatatcttttcatttgtgtcctctttaatttcttgtatcagtgtatagttttcattgtggagaactttggcttctttggttaatttctaagtattttattttatttgtagctattgtaaatggaattgctttcttgatttctttttcagactgtttgctgttgacatacagaaatgccattggtttttgtatgttgattttgtatcctgcaactttactgaattgatttatcagttctaatagttttgtgtgtgtgtgtgtgtgtgtgtgtgtgtgtgtgtgtgtgtagtctttagagttttccaaaatacgattataccatctgcaaataagaataatttgacttcttcccttccagtttggatgccctttatttatttcccttgtctgattggtctagctagaatttcctgaacaatgttgattaacagtggtgaaagtgggcatctttgttatgttcttgatcttagagaagaggctcttggttttcccccattcagtatgaaactagctgtgggtgtgttgtatatggcttttattatgttgatgtatgtgccttcagtttttaaggggctttcatcctgaagggatgttgaattttatcaaatgctttttcagcattcattgaaattatcatgtagtttttgttcttcattctgttgatatgatgtatcacattgattgatttgggtatattgaattatccttgcatccctgggataaatcccacttggtcatgatgaatgatctttttaatgtgttgttgaattcaatttgctaatattttgttgagaatttttgcatcaatattcatcagtgatattagcctgtagttttattttttggatgtatctttcgttttggtatcagggtaatactagccttgtagaatgagttggaagtattccctccaccactatttttggagtagtttgggtaaggttggtattagttctctttaaatgtttggtaaaagtcagcagtgaaaccatcacgtcccaggcttttctttgctgggagactttttattacagctttgatctcattatttgttgttggtctgttcaggttttgcatttcatcgttattcaatcttggtaggctggacgtgtttaggaatttatccatttttttctaagttttccaattttttgcatgtaattccttataatattgactgatgatcctttgaatttttgtggtatcaattgtcatgtttcctttttcatctctgattttatatatttgggtcttctctctttttttcttagtcttatttaggctaaaaggttgtcaaggttgtttatcttttcaaaaaaccaacttctcatttcattgatttttttattgttttcttcatttcaatttcacttatttctgctctgggatctttattcttttcttctactaattttgggtttggattgctcttgcttttctatttctttaagatgcactgttacgttgtttatttgatgtttttctactttttttttttttagacggagtttcgctcttgttgcccaggctggagtgcaatggtgtgatctcggctcaccgcaacctctgcctcccgggttcaagcgattctcctgcctcagcctcccaagtagctgggactacaggcatgcgccaccacgcccagctaattttgtatttttagtagagacggagtttctccatgttggtcaggctggtctcgaactcctgagctcaggtgatctgcccacctcagcctcccaaagtgctgggattcaggcatgagccaccatgcctggcctgtttttctacttttttaaggtaagtgtttattgccataaacttccctcttagcactgcttttgctgtatcccataggttttggtatgttgtgtttccattatcatttgtttcaagaaatgtttccatttccttcttaatttcttcatcgaccccactggtcattccagagcatattatttaatctccatgtgtttgtatatctccaaaatttctcttgttattaatttctagttttattccattgtggtcagagaagatgcttgacattacttcaatttttttttaatgtgttaaggcttgttgtgagacctaagatatggtctgtccttgagaatgatccatgtgctgaggaaaagaatgtgtattctgtagccattggatgaaacaatctgtaaatatctattagttccatttggtcaacagtgcagatgaagtcccatgtttctttgttgattttctgtccagaagatctgtccactgctgaaagtagactgttgaggtctccagttattattgtattggggtctctctctctctttagctgtttagtgtttgctttatatatctgggtgctctagtcttgggtgcatatctatttaaaattgttatatccccttgctgaatgacccctttatcattatataatgaccttctttgcctcttcttatagtttttgtcttgaaatctatttagtctgatataagcatagccactcctgctctttaccagtttccattggcacgggacatctttttccatccctttcttctcagtttatgtgtgtctttgtaggtgaagtgtgtttcttgtaggcaatatatcactgggtcatgtttttttgtttgtttgttttttccattcaggtactctgcataacaactggttatgatcagggccaatgactccccaccacttcccagcagataaggctcaggcattgaagcagagagtccctttgggccctgaggatgcaggaagtacctgcacccacctaagacctccatcattggttcatccaaactacttcctaatgtcagaataagaaacaagtctcttttgggctcacacagggtatgtgtctcatttttgctagttgtgtcacagactcagggccactaaatatgattgggaaaagaccattggacagtgttgtaggatattgtaagactggcctaaggaaaaggctaaaggggtgctcatcttaagaatgccaggctgggtacagtggctcatgcctgtaatcccagcactttgggaggctgaggcgggtggatcacctgaagtcaggcgtttgagaccagcctggacaacatagcaagacctcgtctctaattaaaaaaaaaacaaaaaaacgaaaaaacagaccaggcacaatggctcacacctgttatcccagcactttgggaggccgaggttggtggatcacaaggtcaggagttcgagaccagcctggccaatgtggtgaaaccccatctctactaaaaatacaaaaaaatggctgggtgcggtggctcacacctgtaatcccagcactttgggaggccaaggcggatggatcacgaggtcaggagatcgagaccatcctggctaacacggtgaaaccccgtctctactaaaaatacaaaagaaattagctgggcatgatggcaggcacctgtagtcccagctagtcgggaggctgaggcaggagaatggcgtgaacccgggaggcagagcttacagtgagctgagatcacgccactgcactccagcctgggtgacagagcaagactctgtcttaaaaaaaaaaaaaaaaaaaaaaaaaaatttgtcgggcatagtggtgcacacctgtaatcccagctacttgggagactgaggcaggagaattgcttgaacctgggaggcagaggttgcagtgagctgagatcacgccactgcactccagcctgggtgacagagcgacactctgtctcaaaaaaaaaaaaaaaaaaaaatgcccagacagagacactggggaatgggatcagggaagtgttgacttaaaagagggaggagtgaaattcagtccaagaaagtgtcagtgaataattgtgaaatcaagtatcacatgacgcatgcccatggaaaaagaaaagctacagcaggaatttttttttttttagaatggatttttttcatccccccaaggccagtatcacttgggatttgtattaatggtttgcattaagtgtgacagagggagaccctttagctttaggctttggaccttgtgttcctccttggtggatgctggcttttctcttagttctcctgtgctggcctgaacttctccaggactggataacccaggccctgttccagccccttcttgccaagaggaggaaggagaatggatttacaacctctggccagttcccacgccctattctgaactgcactattcaagaatacttgtgggaggacacagaggtgctccaggctgcacaaaatgactcagaggcagccccagtgtggggtggtccttgccaagacacagagacaagagcggtgctggggtggcttgggacagggtatgttttagcggggatttctctctgtaatcttcaatgccccccaagctattacaagtaaagactaattataaagattggaaggaaaaacaaggcagggaaaaaatttaaatacatacacgcatgtatacatgcatatatattcgtagccccctggctgtttggtttataggaagaaaattatccctaaaataattagttgactattggaaagaaaaaaaaatcttgtaaccttcagtaaaagcagtgactcttggcaagcaaaagtggctttaagttccctaaccggcttgtcaaaccagactgctgctcccaagctacacctattacaaatattaaagccactaactatgagatttaccgagccacatggcctggagatggaaacatcctcagggaatggtctggtgccagagactgttcccttaatgggcttttactgttcccttagtgggcttttactactgtgtgtttgattcgcttcatatacacacaggcaacttgaattttttttttttttccaagacggagtcttgctctgttgcccaggctggagtgcagtggtgccatctcagctcactgaaacctcaaattcctggcacaagtgatcttccagcctcagcctctcaagtagctgggactacaggtgcatgccctacacccagctaatatttttattttttgtagagacaagttcttgctatgttgcccaggctggtcttaaagtcctggcctcaagcgatcctcccacctcagcctcccaaaatgttaggattacaggtgtgagccaccacatgccaagccattaatctttttttttttttgagacagagcctcactctgtcacccaggctggagtgcagtcgcatgatctcggctcactgcaacctccagctcgtgggtgcaagcaatcctcaagcctggctaattttttgttttttttttttagtacagacagggtttaaccatgttggacaggctgatctcaaacccctgacctcaagtgatccacccgcctcggcctcccaaagtgttaggattacaggcgtgagccaccacgcccagcccattaataatttttaaaatgcaaatgaaagcatatatatatatatatatgtatgtatatatgtacgcacacataatatttatcctatagtattgggtatgggcaaatttttttaagtgtaataattcacaatggtgttggtaagaaaataattcactttcacactgttggttttagtataaattggaatatatcttgtagatgtaatcacaaaaatatgccaatatatgtacaagaatgtttattacagcaatatttataaccaaaaacagaaaaacaaccaaattatttaaatgtttgtggacagaggcctagctttaaaacatatggaacatctataccttggaattctattcagccatttaaaaaaaatgaggttgatttctacatactttaattaattaattaattaatttactggagacatagtctcactctgttgcccaggctggagtccagcggcacgatctcggctcactgtaacctccacctcctgggttcaagcaattctcctgcctcagcctcccgagtagcagggctaatttttgtatttttaatttaatagagatggggttttgccatgttggccaggctggtctcgaaatcctgacctcaggtgatccacccgcctcggcctcccaaagtgctgggattacaggcatgtgccaccacacctggccccttttttttttaatgtatatgcgtatggtgtagaggccaagaggataagttcttcttggccttctgaagtttccctgaaaaatcaacttggaaaagacaggttaataagagaaaaagcacacagatttatttaacaagtatacaattaatgaagattcaaagatacaggtggaattgtccatttttatgcttaggtttaacaaagtatggagagccatgtaaaaatatgattgggccaggcgcggtggctcacgcttgtaatcccaatgctttgggaggctgaggggggcggatcacctgaggtcaggagttcaagaccagcctggccaacatggtgaaaccctgtctctactaaaaacacaaaaaaattagctgggcatggtagtgggcacccgtaatcccagctacttgggatgctgaggcaggagaatcacttgaacccgggaggcgaaggttgcagtgagctgagatcatgccattgcactccagcctgggtgacagagcaagaccccatctcagacaaaaaaaaaaaaaaaaaaagacgtacaaatggccaacagttatgaaaatatcctccatctcattactcataatggaaatgcatagcaaaactacaatgagatatatctcaccccagttaaaatacctctatccatggcgaaactccatctctactaaaaatacaaaaattagctgggtgtggtggcatgtgcctgtaatcccagctattagggagactgaggcaggagaatcgcttgaacctggaaggcagaggttgcagtgagctgagattgtgccactgcactccagcatgggcatcagagcaagactccatctcaaaaaaaaataaaaataaaaaaataaataaaataaaataaaatatatatatatatggacagaaagaatatggtctactgctaatagactgagtggggaaacccagcccagcctgtctctccagattcttggactttctctgcagcattccttccttctgggtgaggggcagggacctgccgggaatggaggtcttatgatctacagtcaaacaagttaagtcagataatttttttttcttgagactgggtcttgctctgtcaccaggctggagtacagtgtcgtgatcacggcatactgcagcctcagccttctgggctaaagtaatcctcccacctcagcctcccaagtagctggaaccacaggggtgcaccgccacaccaggcaaattttttaatttctatttttgtaaagacagggggtctccctatattgcccaggctggtcttgaactcctgagctcaattaaacctttgcctctgcctcccaaagtgctgggattacaagcatgagccactgcacccacctagataatttttttgttttgtttttatttgagacagagtctcgctctgtcacccaggctagtgtgcagtggcatggtctcggctcattgcaacctccacctcctagattcaagccattctcccacctcagcctcccgagtagctgggactataggcacacgccaccatggctggctaatttttgtatttttagtagagatggggttttaccacgttggccaggctggtctcaaactcctgaccttgtgtcatctgcccgcctcagcctcccaaagtgctggtattataggcctgagccactgtagccggcccagttagtttctttatgggcagtttgacacagaaaggtggaggggaaattagagtcatttttttgttttgtttttttgagatggagtctcactccgtcacccaggctggagtgcggtggcgcgatctcggctgactgcaacctctgtctcctgggttcaagcgattctccttcctcagcttcccaagtagctgggactacaggcacacgccaccacactcagctaatttttgtatttttagtagagatggggttttaccacgttggccaggctggtctcgaactcctgacctcatgtcatctgcccacctcggcttcccgaaagtgttgggattacaggtgtgagccactacacccggcctagagtagcatttttaagttttatggctgactatagggaaaagggactctgatttctatgggtaaccgcaggggagaatggtactgagagaaaggcatggaagagaaagtcagaggaaaacgtttgcttacgaagctgctgctgaggttctcattttaggctattgttttctgagccccagcagtggccagctgtaccataacaatcaagatgcatttaaaactttttctaaaaactagctctatcctttaactactgacttagccaattacctccttcttagagctactccttctctgggattgcccaggaacctgaggcatatgtcatgcacaaaggagtcctgtggacattcataccctttggagcggagcccaggagtccctagcggtggtctgtggctgtttctgcccttgctcttaaccaccacaaggtgtcactcttcgctgctcctgcgcgttcccaccaaggcggtaactgctggccagagaggaagaatttcctctgtccccgcactagctaatccagagtccttaccagttcccagggcttcatagtacccagccctttcaggcccccgcaaagcctcgccccgcaagcccgccgccagccccagcactatgtcaggactggctcagaggaacacccattccagacaataacaactttttctttcttgcccaggtgttttcaacccttaaaccagactgggcttgttctatttttactttttaaaattttaactcctctactatcattcccaaatgggcttgttctaattccttcccggaccatagagctacaaacttccccgaagagcgacttccaattggtttttaggcatccttggtgtgcctttcatacataaaggtaggtcaagggttccctaccttctctgacaatagagcctgattgtctccagttggaggaccagcccttaaaacagctaaattccttttactttccctagaggaaggggagctccgtggggagtcagctacccgggggcagactttctggcattctttggaaaagcagtgaaaataaaactcacaagttacatcttcagcagagtatctgctacatatgaatatattgtacacatatttttatatggttgcaaacataaaacatataggtccatgtcctgatttttcatgtactgcaatgtatgttgagtattttcccatgtcgttgtaaattcttcataagcattatttgcagtggttgaatgatcttttttcatgatagggttctattgtaattttgtaataattttcttatttttagacactgatcattttgttttttgctgtattgactattcttatatatttttatatatatttctgattatttccttataagagacctagtattgaaattactgagtcaaaaacatttgcaagtctttttattcatgctgcaaaaaacttcctagaaagcttgcatcattgtgtactatcaacaccaagtaccataaggaatgcacacctaattgcaccctaatcaaaagtaatgaaaacaattttataaatctctcttatcagtgcactggtaaaaaagatgttttaatttgcaattaggctggacgtggtgggtcacgcctgtaattccagcaccttggggaggccaaggtaggaggatcacctgaggtctggagttcgagaccagcctggccaacatggtgaaaccccgtctctactaaaaattaaaaaaaattagccgggcgtgatggcatgtgcctataatcccagctactcgggaggctgaggcaggagaatcacttgaacctgggaggtggaggctgcagtgagctgagatcccgcgattgcactccacgctgggcaacaagaacaaaattatcatcttaaaaaaaaaatcaattaattactagtataaattaacattttaaaatttgtatttctgttttttataaattgttagcagtttttacttatttatttacttagagacggagtcttgctctgctcccaggctggaacatagtggcaaaatcatagctcactgcagcctccaacttctgggctcaaggggtcctcctgtcttggcttcccaaagtactgggattacaggcatgagccatcatgtctggcccttttactcatttatttattgggatcttaattttaaaatccatttgtatgacccctttatttattgaagataccaatctattgtctgctatattgttataagtgttttctcaataaatatattgcttaatttatagttttatgaatatttttgtcacaggctgaacccccaattttgggattcagtcaacctgggaggccacgtgggttcttggctttgcacaagaaggaattcaagagcaagccaacagaatgaagagaaagcacatttaataagaaagtaaaggactgctgggcttagtggctcacgcctgtaatcccagcactttgggaggctgaggcgggtggatcacctgagatcaggagttcaagaccagcctggcctgttaacatggcaaaaccccatttctagtaaaaatacaaaaattagccgggcatggtggcacgcacctgtagtcccaactccttgggaggctgaggcaggagaatcgcctgaacccgggaggcagaggttgcagtgaaccaagattgtgccactgcactccagcctgggcgacaaagtgagactccatctcaaaaaaaaaaaaaaaaagaagcaagtagaggattttgggaggctgaagtgagtggataacttgagcccaggagttcgacaccgacctgagcaacatacggggaccctgtctctacaaaaacatttaaaaagtagctaggcttggtgttctgcacctgtagtctcagccacttgggaggctggggcggcaggattgcttgagcccaggaggtagaggctgcagtgagctatgatcatgccactgcactccagccttggcaacagagcaagacactgtcagtaaataaataaagcaagcaaaatcccctggtgaccatccagcaggctccagagacaaaaactccttatctgaggaatttagaagtaattagactttcctattatctaaagacacttggttccaggcctcttttcaacttaaaatgtgtgagtaactaggatttctgtacatccccagaatgcatgcatgccgaaactcattgttcaacccttgctaacatcaaggcaacaaaatgtctaaaaatgtaatcatttatcgtgcaagttacccttcatctcctgctttaggtccataaatatccctaaggaaaagaccaccgcagtggctcagtgctcttgctgacgtgccccactgcacttttctgcaacgttccttctttctatggtaataaaacctgtactgttgtcagtaaattcttaccaaccctcaagttgagtgttaccggaaaggggtcccagtccagaccccaagagagggttcttggatctcgctcaagaaagaattcagggtgagtccataaagtgaaaccaagtttattaagaaagtaaaggaatgggcggggcgcagtggctcacttttgtaatcccagcacttcgagagggcaaggcaggcagatcacgaggtcaggagttcgagaccagcctggccaacatggtgaaaccccttccctactaaaaatacaaaaattagttgggtgtggtggtgggcgcctgtaatcccagctactcgggaggctgaggcaggagaatcgtttgaacccggggggcagagggtgcagtgagccgagatcgtgccattgcactctagcctgggcaacagggtgagactctgtctcaaaaaaacaagaaagaaatatattcatgtacatttccaaatttccgataaaacaacgtagggtccatgcactatagtctatttgtggttttctccacctcactttagccccttctcaagaccctaaaactactggaggcagtgagctactggggagttcctgaagggcgagcactttttccactcatttctaaaataaaaagttatgaaaaaaataataatttttatctgactaatgcaaatcctttttttttttttttaagaaagggtcctgctttgtttcccaggctggagtgcagtggcatgatcacagcccagtgcagccttgacctcctgggctcaagcgatcctcccacctcagccttctgagtagctgggactacagatgggcaccacaacacctggctaattttttatttatttatttgtagaaaagaggtttcttgactgtgcgcggtggctcacgcctataatcctagcactctgggaggccaaggtgaggtggacaacttgaggtcaggagttcgagaccaaggtgacaacatggtgaaatccccgtctctactaaaaagacaaaattagcagggggtggtggtgcatgcctgtaatcccagctacttgggaggctattatttttagtaataataataatttagtaatttttgtattttgtattttcaccatgttggtcaggcttgtcttgaactcctgacctcaggtgattcacccacctcggcctcccaaagtgctgggattacaggtgtgagccaccacgccccgccaccaaaaccagttttattgaggcagcagtgttaccgctctgtaactgctcctgcaggaagagctagcccatagtcagtgtgtggagagtagcagctaaggggcagttccacagtcatatttatacccacttttaattacatgcaaattaagggatgggtttttcagaaatttctaggaaaagggtataactcccaggttgttgccatggaaaggggcagtaacttctgggtgttgccagggcactggtaaactgacatggcactggtgggcatgtgttatggagaggtgctttcccctcttccctgtttcagctagtcttcaatctggcctggagtacaggcctgcctcctgcctcacaactgctgctaatcaggatgtatactgagggtaacttgactctatgctcccagtttgcaatatctagcttggcccaaatagatcctctgtcttactattgttatttatttttttttaagagaaaaggtcttgctcctgttgcccagactggagtgcagtggcaggatcttagctcaccataacctcgaactcctgggctcaagcaatcctcctgcttcagcctcctgagtagctgggactacagacatgagccaccatgcctggctaatttttaaattttttgtacagatggggtttcactatgctgcccaggctgttctcaaactcctggcaagcaatcctcccaactcagcctcccagaatcctcgattacaggagtgtaccactatgcccagccccagataaattctctacttatattaattttgcttcagcttccttctaggttgacagttcccagttgactctcaaaatgtttgtgaaattaagcaatttcactggggcatggtggctcacacctgtaatcccagcactttgggaggcccaggtgggcagatctcttgaggtcaagagtttgagaccagactggccaacatggtaaaaccctgtttctactaaaaatccaaaaaaaaaaaaaaaaaaaaaaagtcaaccaggcatggtagcgcacgcctgtaatcccagctactcgggaggttgaggtgggagaatcacttgaacccaagaggcggaggttgcagtgagccgagatcatgccactgcccttcagcctgggcaacagagagagacttcatttaaaaaaaaaaaggcaatttatttagtgatgtaaaagttttcatggatatataagggaatcagggagtcctcaaggcggaagaaggtgaaggaacagagcaggggaggaagaggagggaggagaatctcccccaggctgagcagaccagggcactgagctccagatgtttgcacccctcctttgttttccccatctcttccctactctccaggccagtcagatggcaaggcctggacaactggaaggaaagagaatgaaggatggaactggggcggcagctgtgttggccacacaggcccttctgactgggcagcatggaggccacttctgccagcctgagagttgcagaagtagatggcagggaatcccctgcttggggatgacacagtaggtagattagaaagttggagaacaggaaccgtaagccactagcaggaacatggttgaagagccgaccgtggagtccagactgagggaggaggtagaaaaggaacaataagcaaggaagcagaggaggctgtggcaaggataatgggcagccccagttattctaagggaaaaggagagatggagttgagaggctgaaatggaagcagctctgtgatgtggctggcctttcgaggttactggagcagaggaggtaaagggaccatgagcacaggtggtggtgctgtaattaataaggatgaggccgggcacggtggctcacacctgtaatcccagcacttcaggaggccacggcaggtggatcacttgaggtcaggagttctagaccagcctggccaacgtggtgaaaccccatctctactaaaaatacaaaaaattagctgggtgtgtggcgggcacctataatcccaactactcagggggctgaggcaggagaatcacttgaacccgggacacggaggttgcagcaagctgagatcgtgccattggactccagcctgggcgacaatagcgaaactccgtccccccaccaaaaaaaataataaaataaataagtatgctgaagccactgaggatgagagcaagacactgggataaggggagcctggtagccaggtcctaaagccattccagagggctgcagaatggcccagagaagaagttctcagctaaggcatggcactaatgactaatcgatggttgtaatcatttcttcctttttttttttttttgaaacaaggtcttgctctgtcacccaggctggagtgcagtggcacaatcatggctcactacagccttgactcctgggttcaagcaatcccccttccttagcttcccaaagtagcattacaatcagcaccaggaattgagcccagctgaactgagccaccatacgcatagcaactacaattgaaatctagatgggcgtgctgtgcgtgaggcaggtgttggtaggtcaggctacaaattaagtctcaatcaatattattttattttattttttgagacaggtgaaatctgagaacattataagtgaaataagccagtcagacaaagacaaatactgtacgagtcagcttatatgaggtacttagagtagttaaaatcttagaggccaggcatagtggctcacacctgtaatcccagcactttgggaggccgaggtgggaggattgcttgagcccagcagtttgacgctagcctgagcaacatagtgagaccctctctctccaaaaataaaataaaatagaataaaataaaataaaatagtcaggcatggtggcacacgcttgtaatcccaggtattccagaaactgaggtgggaggataacttgaacctgggaggtcaaggctgcagtgagctatgatcacaccattgtattccagcctgagcaacagagcgagaccctgtttcaaaagaataaaaaataaaaacattatagagacagaaaatatgacgataattgccgggggctggggacaggggaaagtggggagttattgcttaatgggtatagagtttcagttttacaagatgaaaagagttctgcagatgtgtggtggtgatggttgtgcaacattatgaatgtacttactgaactgtatacttcaaaacagttaagctggtaaattttatgttttgtgtattttgccaaaattttataaaaaattaaaaaaataaaatcattggaggctgaggcacgaggattactggagcccaggagttcgtgagcagcctgggcaacacatcgagacctcatctctacaaaaagttaacaattagctgggtgtggtggtacgcacctgtagtccttgctacttaggaggctgacatgggaggatcacttgagcccaggagttcatgaccagtctgggcaatacagcaagaccctgtctcaaaaggaaataaaatataataagtaaaaaatattggtaatatccagtttgataaagatgcagaaaaagaggcactttcataaactgttagtagaagcataaattgaaggagcctttgagaatgtggtttagcaatatctatcaatactttaaatgagtacattctttgaatcaacttgtacttttgggtatctatcctagagaaatatttgcataggtgtatatagagacatgcacacactggctgtaatgtaaaaaggtttgaattgacctaaatattgatcaacaatgagtggttaaactgattaagttagagtcatagtgtttaattttaagtacagttgatgcttattatctgagggagttgttctctaatatcacattacaaacactgaattcacaaatatggaaccattgctcctagaggaaatacagggttggttcctgtaagcctctggtcacaatattttcattaatcaatcatgtgtgcttctgtttgaaatacattattcagtgtacctttcttacaaatgattgattgcatagtccttcaaagatttaaagcctggggtttggaggctatttgcattatataggttaatttgccaatgtccttgtaaaacaagccagtcttttttttttttttttttacactttaagttttagggtacatgtgcacaatgtgcaggttagttacatatgtatacatgtgccatgctggtgtgctgcacccattaactcgtcatttagcattaggtatatctcttaatgctatccctccccgctccccccaccccacaacagtccccagagtgtgatgttccccttcctgtgtccatgtgttctcattaaaacaagccagccttatcagagttgaaaaactgctttcctacctaacccttacccttttcccatattacacttagtttgtatagcttttttttttttgagacaggatctcgctctgtcgcccaggctagagtgcagtggcacaatctcagctcactgcaacctccacctctcaggttcaagcaattctcccacctcagcctcctgaatagctgggactacagacatgtaccgccacgcccagttaatttttatatttttttggtagaggtggggttttaccatgttgggcaggctggtcttgaactcctgacttcaagtagggatctgcttgcttaggcctcccaaagtgttgggattacaggtgtgagccaccatgcctggccttgtataactttttttttttttttttgagacagggtctctgttgcccaggctggagcgcagtgactcaatcacagctcacagtagtcttgacctcctgggctcaaacggtcctcccacctcagcctcctgagtagctgggactacaggttcaagaaaccatgcccagctaatttttattaatagagacagggtctccctatgttgcccaggctggtctatgaactcctggactcaagcaatccgcccacctcagcctcccaaagtgctaagattacaggtgtcagccaccatgcccggcctttagcttgtatgtttaaaattattctgcagcctcgcgatctgtagaacttgcctataaaaataacacttttaatgttataacacattttgaaacatttgaggcagtaatactagctaagccagtttaacattttcctgacccaatgtgactgtaaatttctttggcttttcagcctcacaacagctgtctaatgcccttttttctttttttattggtcatcatctcctgaatccacaaatttggccacttttgtatcttttccacagcttcatcatacactacagacattactctatttagcactttctggagcagcctcaggtacaggttgcccaatgtcctcttcctttttctaggtatgttgtgttgttgattcattgaggaactcacagcactatgactcctgtctgaatgaagcttatctaaccatgtctgccaggcacgtcccatcacagccttcttgatcatacaaacactagataacacttcagcactgcactgcacttcagcacttttgcatttaaaaaccaaaatcggctgggcgctgtggctcacgcctctaatcccagcacttcgggaggctgaggtgggtggatcatttgaggtcgggagttcaagaccagcctggccaacatggtgtaccccatctctactaaaaatacaaaaattagctgggcgtggtgtcacacacctctagtcccagctactcaggaggctgaggcaggagagtcgcttgaacccaggagacggaggttgcagtgagccaaaacctcaccactgtactccagcctgggtgacagagcaagactccgtttcaaaaaaataaaaaacataaatataaatagcaaaatcaacagcaaaaagcataaacattcaaaaaaaaaaagtggcaccaaatggaccacaggaggaacacttgtatgacagatgaagcaagaagacagtgtcgccctgttcagcctcatttaggaatgtgtgcgtcaagcaactcagatttttcactgctttgcacatgtctacaaatgatccccaaagctatatgaatattgattttggggttacaaataaatgcaatgagtaggcaaattcacaaatatggaatccacaaataatgaggatagaccatatgtattaaaaataatacaatgggccgggtgtggtggctcaagcctgtaatcccagcactttgggaggccgaggcaggcggatcacctgagatcaggagttcgagaacagcctggccgacatggtgaaacctcatctctgctgaaaatacaaaattagctggacgtggtggtgtgcgcctgtaatcccagctacttgggaggctgaggcaggagaattgcttgaacccgggaggcagatgttgcagtaagctgagatcacaccattgcactccagcctgggcaaaaagagcgaaacttcgtctcaaaaaaaaaaaaagaatacagtagatcagtatgtatttgcatagaaggaggcctgtgatatgttttcaatcaaaaaaagaagctgaggctgggtgtggtggctcacatctataatcccagcactttgggaggccaaggtgggcagatcgcttgaggccaggagttcgccaccaacctgggcaacacggcaaaaacccatctctacaaaaaatacaaaaattagccaggtgtggtggctacacctgtagtcccagttactcatgaggctaaagtgggaggatcacttgaccccaggaggcggaggggtctcaatgagccaggatcatgccactgcactttagcctgggtgacaaagcaagaacctgtctcaaaaataaaataaaataaaataatataaaagaagctggtcatgatggcatgtgcctgtggtatcagctactcgagaggctatgggaggatcgcttgagcccaggagtttgagaccagcatgggcaacataaagagacctcgtctctacaaaaagagagagagagaaagtcattgaacaacatgtacaaaggttaaaaaaaaaaaaaaaaaaaaaagcaaacacttataaaagccaggcaggcaacataaaatggtaaggtgggccagtgtaagacacctgggaatggtgggggctggagaggaggggatctcactcttctaccaagggcaacccaccactcagtgtcagtcaatccttcccaggcagcagggcaagcccagtaatgccttattttccagattttcaagactcccatgaaatatcccaattttaaaagctggctactaattcagaatataagaagaaaatactgccgggcatggtggctcacacctgtaatcccagcactttgggaggctgaggtgggcggatcacctgaggtcgggagtttgagaccagcctgaccaacatggagaaaccctgtctctactaaaaatacaaaattagttgggtgtggtggcgcatgcctataatcacagctactcgggaggctgaggcaggagaatcacttgaacccaggaagcagaggttgcagtgagcccagatcacgccattgcactccagcctgggcaacaagagcaaaactccatcgaaagaaagaaaagaaagaaaagagaaagaaaagaaagaaaggaaagaaagaagaaagaaagaaggaaagaaaataccatgtgagtcaaaaaaaaaaccattatggagccaggcttggtggctgccatagctgggactatatatgatggtggttgaggcgagggcttaggagttgcaggctgcagtgagctatgattgcaccactgcactccagcctgggtgacagagtgaatcctcatctctaaaaataaaataagaataaataaaaatccaaaacccattatgggctacatttggactacatactggcagactggggcctgcagtgtgtggtagaatttatgagaaaaatacacatatgaatagaaaggtacaaaaaatgatctgcaccccatgaaaccagtaataatgtgtacgttggggtagatgagaaagaacgaggttgctgaaggtatggaataggtctttatcttttctgtattgtttgtgaccttgaacatgaaaatgtagttacctattacctatgtactttctttctttaactttttttttttttttttgagatggagtctcgctctgttgcccaggctggagtacagtggcgcaatctcgactcactacgacctctgcctcccgggttcaagtgattctcctgcctctgcctcctaagtagctgggattacaggagcatgccatgatgcccagctaattttttttatttttatttttagttgagccgggttttcactgtgttggccacactagtcttgaactcctgacctcaggtgatccacctgcctcagactcccaaagtactgggattacaggcatgagccaccgcgcccggcctacctatgtactttaaaaagaagaaaagtgccccctgaattagaataccaaacattattagtcctgtggccctctaggttgggcaatattagaattctctgctttggattgcaagccttcaaaacgcaaagtttatatttcaaaattgctttttaaaaaaattcatagtaatgttttccttatttggggaatgctgattttcaaagaatggaaactcactcagaatagcaccagaacaaaagagggatttggtgggaaggtatagggtggttttgtagcatccagggcatgaattgaaaccaggcgcacaaggaacaagaaccccaaggctggaagccacgtggcctcagagccagtcttcttgtcttctcctgtcagctttctactgtttgtttctgcagtttattcttctgcttggtatgcccacttcctagttcattacacatggccctatggcaccctcaatcacagggttgccatgacctcaaaagtcctgcacacttgggtaggagtctccgaaatcccacgtccatattcctgggaaagagaatctgactgtggccactgagtttatgacctagatcaaatgtcctctccccatccaaccattggacaagaggaaagtgggatcctatggttggcgcaaaccggccccagggaccctctccagcaggaaagggcatttctgagagatggaggatttagcctggggaggggcctcaaaaggaatccacagatgcagctattatacaagttccatgtttacaggcacctgtgaatgctgaatcggatagaacacatttgttcataagggaggtagcagagcaaagtggccgagatatgggacttcagtaggataactaaccatcccagtttgcctaggactgaaagaggttgtaaaattgaaaggatacagcctttcatgtaaaattgaaaggacccagcctttcaattttaaaattgggacagtttttaaagatttcccagcatgtgagactttcattgcaaaaaccaggaaagtctcatgcaaaccacgatgagttggtccccttagattttggagctggatctagttatgaatcctggctcagctgctgcagctgtgtgaccctgagcaagtcactttacctcttatacctcagttttctccttgcaaaatgagaataataatagttcccacatcacagagtaagataagcacccgtgagcactcagtagaaattaggcaattaggtaatgtcgacgaaaacagtcaaactctataacatatttgaagaaacttattctgagccaaatataagtgaccatggcccatgacacagccctcgggaggtcctgagaacatgtacccaaggtggtcaaggtgcagcttggttttatacattttagggagacgtgagacttcaatcaaatacatttaagaaatacattggttcggttcagaaaggtgggacaactggaagcggggcatgggttccaggttataggtgggtttaaaaattatctgcttgacaattggttgagtttatctaaagatcttggatcaatagaaaaaaaaggcctggatttcttttctggagactggaaaggattgcagagaccaaagttcttatttgtagaggaagccttcagagagaatacgttgtaaaatgtttcttatcagacttcatgtctgtgttgatgtcagtgccagcaaggtataatgaggcatgtctgaacaccacttcccttcatggctgaaccagtttctcaggttaaattttttttttttttttttttttttttttagatgaagtcttgctttgtcacctgggctgcagtgcaatggtgcaatctcagctcactgcagcctccacctcccaggttcaagcgactatcctgccttagtctcctgagtagctgggactacaggcacccaccagaacgcctggctaattttttgtatttttagtagacacggggtttcaccatgttggccaggctgatctcgaacttctggcctcaggtgatccacctgccttgggctcccaaagtgctgggattcaggcaggagccaccgcacccggcgtcaggttaaattttaaaagagccctacccaagaatgtacatggttggtgggggccttagaattttatttttggtttacagtaataatatatatggttaaaaaattgtctacaatcaataataatttaattgtacatttaaaaataactaaaagagggctgggtgcagtggctcacgcctgtaatcccagcactttgggaggccaaggcaggagtatcacttgagcccaggagtatgagaccagcctgggcaacatagtgagagcctgtctcagttttagaaaataataataaataactaaaagagtatataattggattgtctgtaacacaacggcttttgaggggatgaataccccatcttccatgatgtgattattacgcattgcatgcctgtatcaaaacatctcaggtaccccataaatatataaacctactatgaacccacaaaaattaaaaatagaagtaaaatttcaggccaggcatggtggctcacacctgtaatcctagcactttgggaggccgaggcgggcagatcacctgaggtcaggagttcgagaccagcctggccaacatggcgaaaccctggctctactaaaaatactaaaattagctgggtatggtggcgcacacctgtaatcccagctaactcaggaggctgaggaaggagaattgcttgaacccgggaggtggaggttgcagtgagccgagattgtgccactgcactccagcctgcgtgtcaggaatgagactttatctcaaaaaataaaatacaataaaataaaatttcaaaattggaagcaaaacaaacagtgaaaagtaagactcactcccacctctgtcgctcaggccacaggtccccagttcccttctccagagtaactacttagcagtttcttacgtatcattccagatagtctgtgaattatagaaaggtatatacagatctttttttttctttttctttttttttttttttgagatggagttttggtctcattgcccaggctagagtgcaatggcacaatcttggctcactgcaacctccacctcccaggttcaagtgattctcctgccttggcctcctgaatagctgggattacaggcacccaacaccacacccagctaattttttgtaattttagtagaaactgggtttcatcacgttggccaggctggtctcgaactcctgacctcaggcgatctacccaccttggcctcccaaagtgctgggattacaggcgtgagccaccgcacccagccaacctcattatttttaatggctacatactgtttcatggccttggaatcataattcatttagactgtctcctactgattgacatttgggttgtttctatttattattattattattattatttttagagatgggggcctcactatgttactcaagctggagtgcagtggctattcacaggtgacatcatagtgtaccatagccttgaactcctgggctcaagggactcttccatcacagccttctgaatagctggggctacagatgtgtgccaccatgcctggctgttccactcttttgttactacaaacattatgacaaacaatgtaatattatcttgtatacacaactttgtgtacattcagaagtatctctaggataaattcttagaagtggaaatgctaggtcaaaggagctattatcaccattcattgtaattattataattaatctctaagaagtcagatgttggatctacttccttctaaaggcaaatagtagctgttatatctgagcataaagagatcttctatatcaactgccttttgtgagtaaaaaattattaagtcctgatactgacatcttggaaaattccagaatgctgcttctacctctcctctcttttcataccccttctcttttccctatttacattggcacatgaccacattcccacaaaatgtgtcagttgagttggtgtcttagcctgggttccttagaaaagagagcctgaggcaaagctttatgagagtatagaatcccagggaggcatgagtgaagggaaaaggggaacaagtcaaacaacgaggacgagtcaacataagagcatgcatgatggtcctgaccacaacttaggcaagcacaattgcttcctcactcttagaagaagcaactgagctcgcataggggaagcgagtctctgagaagccagagtaagccactgcatctctccacactctgtgcagtcacaggaagaggcccaggtggggagggggtaaggaagggaatacgtttatctataggctgccatctcctattggtcgaagtttgcccctcagggtgtcaactccttttagcttatgagttgagccgcccaactcctccagcagccatggagaaagccagaacccaagacagaagtgtcagcctctatggccaagcatcaacctggagggtaagccactgtgcatccatgggatttgagatggtccacagggtctctcatatcaatagcaacaggaaacccacatggcaggaggataggagcagagatgctggtgcaaggccaggtgctgtggtgtcatgcccttacgtgacatgaggaacctggagtagctaccacagagcaagtcattgttagagttctggccagaaagcaaggcaagtgcaggatttgtaacggcatgtaaaatgaatctggtacagggccaggtttgatggctcatgcccataatcccagcactttgagaagccgaggcaggaggatcacttgagcccaggagttcgagaccagtctgggcaacatagagagacccctgtctttataaaaaaaaattttaaaaattagctgggtgtggtggtgcatatctgtagccccagccactctaggggctgaggtgggaggatcatttgagccccaaacattgaggctgcagtgagccataatcatgcctttgcacttcagcctggatgacagggcaagaccctgtctcaaaataaataaataaataaataaaacagaaaacaacaaaaaaaaaccagtctagtacaggtgggaacactggcactttgcacactgcactcattctgagatgtacattttattaccttttttttgagttggcgtctcgctctgtcactgagcctggagtacagtcatgtgatctcgtctcactgcaacctccgcctccctggttcaagggattctcccccctcagcctcctgaatagctgggattacagatgcccgtcactatgcccggctaatttttgtatttttagtagaggcagggtttcaccatgttagccaggctggtttcgaactcctgaactcaggtgatccgcccatctcggcctcccaaagtgctgggattacaggcatgagccaccatgcccagccattttattaccttttaacatcattgaaatcaggatttatctcacaattgacagaatgtcagagtttaatcggcagttttgttccctttcttggtggtacataagtggccttctagatgaaataaggtaatgtatttaggctgatgtgtaccaacgtgtctcttgatatccttggcccagaaatgttctcacaaaagaggcactgcccatcttctatgagaaagacccacaatgaggaagagcaattggcaaattcataagccagggatgttgcattcccgttgtctataacaagcattcattacaattaccattaatatgactatttgttgcttatagatattggtgttgaaatgtttgctaatgtcaagcccaggctgtgaaacaaaagttcattcatgtgctcatgatgagcagtggctttggttaggtcagaattcaatgctaaaaatcaatacctcattagtcttgataaaggaagtgtaatggagtgtttcagcagagcccaggctgggaatcagttggttgtattttgatctgatgggtcatgatgcttttgtggatttgtttgcatgaatcattatgttcataaatacggttaagttacagaagcaagttactaaataatatcaacagcatgagttcattattgcttgtttgaaaaaaaaaagtgtgtatatgtatgagtgtgtttaaccagtatgttccaggttcatgtctacattgatatcttaaatcactgtgctctaaaatgtagactttggtgtctaaatcttcactactcaaggtgttgtccttgaaccagcagtatctcaagcaacacctgggaagttactagaaatgcacaatctcaagccccatcctagaccggctgaatcggaatacggatttaaaaatgcaagctcccacattaactgacgaatggataaacaaaaacggtacattcagctggatgtagtggctcatgcctgtggtcccagctactccagagatggaggcaggaggatcgcctgaccccagaagtttgagaccagtctgggcaacatggtgaggcctcacctctactttaaaaatgcaaaaattagccaggtgtggtggcgcgtgcctctggagtcccagctacttgggaggttgaggtgggaggatcgcttgagccctgcaggttgaaactgtagatgctacaacatggagaaaccttgaaacattacactaagtgaaagaagccagacacaaaaggccacatgttgtgtgatttcatttgtgtaaaatgtccagaataggcaaaactatacagacagaaagtagagtagtgtttgccaggggctgggagaagggggtaattgggaggcactgataatgggtacagagtttccttttggggtgatggaagtgttgtggaattagatgctggtgatgattgcacaacattaggaataaatttagagacactgggctgggcgtggtggcttatgcttgtaatcccagcactttgggaggccgaggcaggtggatcacttgaggtcatgggtttgagaccagcctggccaacatggtgaaactctgtttctaccaaaaatacaaaaattagccaggcatcgtggcacctgcctgtaatcccagctactccggaggctgaggcaggagaatggcttgaacccgggaggcagaggttgcagtgagccgagattgtgccattgcactctagcctgggcgacggagtgagactccacctcaaaaaataataataataaataacacactgaactgtacacttcaaaaatgtgaattttatcttgtgaattttttctcaaaaaaattaaaaaacaaaaccaacttagcacattgcctgcaaacttttaaaaatagcatattgctttctttcgttcccacaaaggaggaaaagaaaatgctgtgaaagtcatcatattccaaaaaattgccatatgatatttaatgttccctggccactcaaaaatactgtggatttattttggatcacctatgtaagtgtaatgtacaaggtttcctgcaaatacaatgctgctgctaacgtcattaaaagtaaaaatgatcaaagtaataaaaggcgtttaaaagttttttgtttttttttaaatgcaagctccccaggtgtttgagaagcaatttgagaaacaccatctccttaactacatggcctcagtgttgtttctcaccctcattcggaaaatccttcccttttcgtttgggaatctctacaggtggcactatttcacacattaagtacatgccctgcagcctccacctgcagcctcctccacctcccggttgcctgcactgcagcagccctgcttaggggcgtggcgctatcatggggaaccacagtcagcaactgattaggacatggtgtcacctgggaccaaggtctcactcctttgttctcagttgctgttatgggctggcagaagaaaccagctgacaccagactgttcaccaaagtgtcctcctctctgcctccctaggcaccgctgtaccaaaaatctcccctctctttaaacataaaagggtttacattacaggttcatgcctgtaattcctgtgctatgggaggccgaggcaggaggatctcttgagctcgggagttgaaggctgcaacgagccatgatcagtttaaaaagaaaaaaaacaccagatgtcaacacacatagaggatccaaatggagtagggaaagaaagggagtctctccctctctccagagatgtctgaactctagcttctgctcagagaaaattttctattgcacagacttgaaagatatgtaacaattttttttttcttgagatggagtctcactctgtcgcccaggctggaatgcagtggcaagatctcagctcactgcaaacctccatctgccgggttcaagcaattctcttgcctcagcctcccgagtagctgggattacaggtgtgtgccaccacactaggctaatttttgtatttttatttatttatttatctattttcttgaaacagagtctcactctgtctcccaggctggagtgcaatggcacgatctcggccactgcaacctccgcctcccaggttcaagtgattctccagcctcggcctcctgagtagctgggattacaggcgcccaccatcacacttggctaagttttttgtgtttttagtagaaatggggtttcaccatgtcggccaggctggtcttgaacttcttacctcaaatgatctgcccacctcagcctcccaaagtgctgggattacaggggtgagccactgcacccggccgttacgtaacaaaatattaatagtgtttttgtactggatggtaggaattttctctttatgtatatttctaattttctttaaaaaaaaagaatgtatattatataatcataaaaataaagaaaagtgttttgttagaggaaatgagaaattccccatggtgatggaatatgtgatttcaacatgcatctttattttttttatttttattttttaaattcctcctacttaggaggaaggtagggtttagcaatgtgttttattttattatttatttatttatttattttttgagacagagtcttgctctgtcatccaggctggagtgcagtggcgtgatcccagctcaccgcaagctccgcctcccaggttcgcgccattctcccgcctcagcctcccgagtagctggaactacaggcgcctgtcaccatgcccggctaattttttcttgtatttttagtagagatggggtttcaccatgttagccaggatggtctcgatctcctgacctcgtgacccacccgcctcggcctcccaaagtgctgggattacaggcgtgagccaccgcgtccggctattttttattttttgagagggagtctcactctgtctcccaagctggagtgcagtggcgctatcctggctcactgcaacctccacctcctgggttcaagcaattctcctgcctcaacctcccgagtacctgggattatgagagcccaccaccacgccgggctaattttgttttgttttgagatgaagtctagctctgtcgcccaggctggagtgcagtgacctgatcttggttcactgcaacctctgcctcccaggttcaagcgattctcttgcctcagcctcctgagtagctgggattacaggcacctgccaccacgcctggctaatttttgtatttttagtagagacggggtttcattgtgttggccatgctggtctcaaattcctcacctcgtgatcgccctgccttgttctcccaaagtgctgggattacaagcgtgagccaccgcacctgtcctgatttttgtattttagtagagatggggtttcaccatgttggtcaggctggtcttgaacttctgacctcaaatgatccaactgtctcagcctcccaaagtgctgggattacaggcgtgagccttcaacatgcatctttaaatagagaatttctgtcttgcaaaaattagtgtatgaaggtcacaaaggcttcctcatacggttcacagcacacagaacagtctttttataaaggatgtggggttgcagaaacaggaaatgaagttggttcccagatcttggcaggcatagatggggagtccctccagaaatctactcaggcctccctcctgcaaatgtgggcatgctgaccccttgttatctgtaaagagggagctcttaagataactgtccattatcaaaccaattggtgataatccctgcctcagccttttaaatcacttagacctagacattaagtactttgttgtgaatttccaccaaggagttgaattggttaactatcctggaagtggttcagcttaaaagggtttgagataattttgctactttgttattattagcaaagatgaaaactgctcattttgtttctaattttattcacttttgggtgaattatctggatcctttacaatgaataattttaaatgggtaattctaaaaattggtattaaaaattaatgtgttctttaaggaagatttaaaatacagataagaaaaatgtatttctgtactgtatttatgtacatatatgtgtatatgtgtgtacatatgcatgaaacagaaatgatggtgcattagtgggaaatgtttgaattgcaagtgcctggactttaccattcaaactatcttaggcaagatgggaatatttattgactcataaaacaaacataaggaaaattcagagttatttctggcctcagtgacccaggattcaaaatgctctcaaaagttttccagcttctgccctctgcttccctctctctgccttcgtctcattctctcggaatgcggtccagctggcaggaaatatggctgccatggcctacagactcacgtcttcccatctttacttctggaaagcaacaggtccttttcctttggttccagcttacaaagtcccaggagaggtccctgataggctcagcatgagtcatctgtgctcttcttgacaaatcatcttgggcaagatagcacagttctgcggtaggctcagtttgggttgagtgctcacctccaaaccagaccctgtgatggagaggagggatcaggtaagcagatggcagctcccatctgaactatgcatggggtgctgttctgtaaagaaaaatcagttgctatttcccctagaaggatagtgtgctggtagacaagtgacagatattcaccagatgcaaatggaatcatatttcacatgtgttttgccacacactttgttacatctttcatttgtctatgttccatgacataatttcagtgataataacatttaatggcagagcattctattgctctggcagaatattctattccggaatacagccatgatgactggaagtgaccatgaggacaagagccacccatcagggttgacagagcaggaagacagagaacacccaggtccttgacagcatcctggagttactttactagccaagtattaccaatctctagactttttttttttttttttttttttttttttttgagacagagtctctctctgtcatccagactggagtgcagtggtgcaatctcggctcactgcaatctctaactcccaggctcaagcgattctcttgactcagcctcctgagtagctgggattacaggcatgcaccactatggccagctaacttttttgtatttttagtagagacagggttttgccatgttggccaggctggtctcaatctcctggcctcaagtgacccacccacttcggcctcccagattgctgggattacaggtgtgagccactgcaaccagcctttttagacttcttgatacatgagaaaaataatccctgatttggataaaccacagtagtcagggttctcttgcatatggacaagtgcagttcctaataaatacacttcttgacagccttccatgattaaaggtaggccagggaaattaacatcaatgggaaaggtagggaagggtaataataggaaccccagagaggttgaggggaagctgaaataaaggaacttgtagcctacttcttttttgaagtgttgaaggaaactgacccatagagcattctggagccaacattctatggttgcaacagagtagaactggcagtcatagctgaattgagtagcaagaaggtaagaggtagtacccaagactttgatcctatgtagcatgaagggttgcagaagtctctaaggctcctagtttgagtaatgggatcgtctccccagttccccatacatagagatctttactgtaagtttccttaaagagctgtcataggagcatgatggagtacatcacaaggacaatgtcctaaagtcctctgtagtccctgtggtagtcagcctctaaggtggcccactatgatggttaattttaggtgtcagctgggtgtggtggttcaagcctgtaatcccagcactttgggagactgaggcagggggctcacttgagcccaggagttcaagaccagcctcagcaacatagcaagaccccctctctataaaaaattttaaaattagccaagtgcagtagcacatgcctatagtcctagctgcttgggaggctgaggtggaaggatcacttgaacctgggagtttgaggctgcaatgaactatgatcacaccactgcatggaagcctgggtaagagagtgagaccctgtctctaaaaaaaaagtttcaggtgtcaacttgactagattaaggaatacccagatagctgagaaagctttatagttatgcctgtaagtgtgtttggaagagactggcatttaaatcagtagactgataaggaagatctgccctcacccagggtggatggtagcatccactcagctgagggcccagatagtgcaaaagggcagaggaaaggcgaattttctctctctctcttctgagctgggacacccttctcctgatgttagacatcagaactccaggttcttcagccttcagacttcaggacttgcaccagcagcccctcaagttcttgggcctttgaacttaaactgactcacactactggcttccctggttctctatatctatatatcctattgattctttctctctggagaacccagactaatacactcactgtgatccttgcctccaagtattcatacctttgtgtagtcccctcccacactgtaccagggttggtctgtgtgaccaaaggagtatggcagaaatgatggtctatcacttccaaggttagattgcagcttctgcttctttctctcaatcactcaccctggggaagccagctgacacgttgtgaggagaagctacacgtgaggaaacagtcacatgagggagcttgggagcaagctgatcatccagccccagtcaatcctacagataactgtagtcccagccagtgtctagactgcaaccttgtgagagaccttcaattagagatactcacctaggctgttccagattcctaatcaacagaaataaaataattttttttgagacagggtttcactctgtcttccaggccagagtgcagtggtgccatcctggctcactgcagcctcaatctccccaggctcaagtgatcctcttacctcagcttcccaggtagctgagactacacgtacgcatcaccaaacccagctgatttttttatttttagtagagacgaggccttgccatgttgcccaggctggtcttgaactcctgggctcaagcaatcctcctgcctcagcttcccaaagtgctgggattacaggcataagccactgcacctggcaaatgttttgttttgttttttaaggtaagcaattatttcatttccttggtgaaggggtggcctgcccctccacacctgtgggtatttctagtcgggtgggacaagagactgagaaaacaaataagacacagagacaaagtatagagaaacaacagtgggcccaggggaccggcactcaacacaccaaggacctgcactggcaccggcctctgagttccctcagtttttattgattattattttcattatttcagcaaaaaggaatgtagtaggagagcagggtgataataaggagaaggtcagcaaaaaacatgtgagcaaaggaatctatgtcataattaagttcaagggaatgtactatgactggacgtgcacgtaagccagatttatgtttctctccacccaaacatctcagcggagtaaagaataacaaggcagcattactgcaaacatatctcgcctcccaccatagggcggtttttctcctatctcagaattgaacaaatgtacaatcgggttttataccgagacattcagttcccaggggcagacaggagacagtggccttcctctatctcaactgcaagaggctttcctcttttactaatccacctcagcacagaccctttacgggtgtcgggctgggggacagtcaggtctttctcatcccacgaggccatatttcagactatcacacggggagaaaacttggacaataccccgctttcaagggcagaggtccctgcagctttccacagtacattgtgcccatggcttattgagactagagaatggcgatgactttcaccaagtatactgcttgtaaacattttgttaacaaggcacgtcctgcacagccctggatcacttaaaccttgattttatacaacacatgtttttgtgagctccaagttgggtcacagtggttgggtcaaagtggctggggcaaagctacaaattaacaacatctcagcaaagcaattgtttaaagtacaggtctttttcaaaatggagtctcttatgtctttcctttctacatagacacagtaacagtctgatctctcttttcccttcacttggcctgacagcattgacttcattacacaagaacttgcagctgacagaactgacacacagatttcccccaagaggaagaacccttttcatttgcagagatgaattgaaatgtcatgtctgagtgcaattcctgctccccactcccaccccacaaaatcctataagtgataataaatcaataaaatccccatgatttactaaaagtcatccctgcaaacctttctaactagcagctgcagtggataaccaagaagggaagcagctggccatcacatagcattcctgtgagtgtgagaatgaagggacagcagcatgggagcgagaatcctgaatgagtgagaggtatagataatctacctcacttcatacctgccccttccctacataagacatctctgtcctgatacatggaaaatactagaggagatggtagaagtggttttagtctgcaattggaaatgcctgaagcttattaaattccaaggtaggggtgagatgaggagcaccagagagaaagagcaggttagacagagatgctcaactcactctgtcaattccagtttaatgctatttaacaacaaaattatcttcttaatcataaccaccctcatgcctaacccctattttccaaagataagagatccctgtctaaatttctgggttggtgtctactgccgcccctggggtggtactgtgatgtttgtgagtgagattgcaactgggatgggagaaaagaagtgtgggatacggaagatcgggggccacgatgcatcaattacagtgggtctcttttcgtccccaggtatggcccactaccacaagtcccctttccctacctgtcttgtgcaactgtcaaaaacagaatctctgcccaaagagaagggagcacagggagttgctgctggactgccatcatctctgaccccaacttgtccacctcctgaccgacctttctatgaaactgcacaaaaattaaatctcaggaatgccataaaattacatcatccccattcctctatcaaagccaatccaacagctctgtcctgacatgctttctccctgggccaaggaagcaacaaaaaatatcagttgagcatgtgaaaatgcgttgacggtgtgtgcggtgtaaagtttctatatgtcttcaccttctgtctcctcacggtgggagccgccctctctttccccaagtcacacacacacccctcccctacccctaagtccaggtgcttccatctgctgggcttccaaccactcatttcccatagacactctcattactgtaggccacatacagaaaatcatcttcctcatgactgtcctcatatagttggcccatggtagcactagtgggagggatagtgttgttgacaaagaagaataaggcgtcctcaggtctcaggtggattctcttccggattaaaaggtagaactggccatcggtaaggtcggagggcactaggtacttcctcctgtccagatcaggcacccttgcttttggagccttctctacaatcaaggggaccctgtccggatatttcttccggatcttttctccttcctttttccgatactcaaagggatggacctccttgtactggaacttcatggtgaatcacagggcttccgtgatccccgcgcagggcctgcctccttcgccgctgaccgctggccacgtcccgctccctccgccgacgtgtgcttagaatagctgcagaaatgtccgcttccgggtcaacagcactggtccaagtgtgcgggagggcagaaggtggggtgggagggggacctcgggtgcgcctgcctggaggtagaggagagccaggtggagaaataccggcggcttttccaaacagctgggagcacaaaaaccaaatatttggttttttaaaccaataaattttggggtaatttgttacacagcaatagataatgatagactctctctttaaaaaaatcagttctggcagggtgcgatggctcacgcctgtagttccagcactatgggaggccaaggcgggtggatcacctgaggtcaggagttcgagaccagcctggccaacatggtgacacccccgtctctactaaagatacaaaaaattagccgggcgtggtggtgcacgcctgtaatcctagctacttgggaggctgaggcaggagaatcgcttgaagccaggaggcagaggttgcagtgagctgtgatggtgccattgcactccagcctgggcgacagggcaagactctgtctcaaaataaataaataaataaataaataaataaattcagttatagcaagtgctgaagtctttctgtcttttcatgctccttgaagtcctttcacagtttttcctggctcttctacgcctcctctcggccacgccctttagcacccaacccctcaacaggtaatgatcctctcttcacgtggccattgcgggtacatgattggtttcctgtactgactgctcttctcgtgagaccaagcttcctttcccctactccccacacacctgatcattgtgaacaaaccgccgagagaacaaggtaaggcagaaggaacagaagctgcagagagcggcaggggatagccaccagccagattctgtgactcttcattcatctccccactccagtcccagattgaagaataatcttcatgatctccttaatggcaaaatgctagaaagacttaccgaggggtctgaagatgccttcggttctccaggtcctgaactctgttccagttacaggaggactggcaatccctaggtttcctgggtgttactttgttactgacctcctctgagatttccattttcctcaatttcgtctaactaaatctaactacgtctaactacctctgctaaccagacatttgttcatagtcgacagagtttccgaaaatgcaatgtagttaccttgcagatgactataattgtgtagcaaaataactaagatgccactggctatatggaaaaaaaaattacttaggattttgataccttttatggtttatttccccttttggcctgtgaacttcatgaaggtaatggttatgtatgattcccgagtaatcacagttcccagaacgatcttttttttttttctttctttttttcttttttgagacggagtcttgctctgtcgctcaggatggagtccagtggcgcgatctcggctcactgcaagctccacctcccgggttcacatcattctcctgcctcagcctcccgagtagctgggactacaggcgcccgccaccacgcccggctaattttttctatatttagtagagacggggtttcaccatgttagccaggatggtctcgatctcctgacctcgtgatcctcccgcctcggcctcccaaagtgctgggattacaggcgtgagccaccacgccctgcccccagaacgatcttgagaacagaatgttcccaataaatatccactggaaaatgcaccttatttttgttgaaggaatggtggaattagcatcaaagggatcttcaacattaactcgggccgggcacggtggctcacgcctgtaatcccagcactttaggaagccgaggcgggcggatcacgaggtcaggagatggagatcatcctggctaacatggtgaaaccccgtctctactaaaaatacaaaaaattagccgggtgtggtggcgggcgcctgtagtcccagctactcgggaggctaaggcaggagaatggtgtgaacctgggaggcagaactcgcagtgagccgagatcgtgccactgcactctagcctgggcgacagagcgagactccgtctaaaaaaaaaaaaaaaaaaaaactctatggctggtaattctaagcgttttataatacatcacaaaatgttcttttatttttctaaattgcactgaatcaacaaacggagtagacaggcacattttcttcactttaaggaaagactttgttgttttttagctaggggccgacccaaagtgatcactggctctcacatgagacccaggagcctccccagtttgaagcccgatatcacatttcccagaatacttgatgccctcgcccgcctcctctggctatcaaccagacggaaaggggatgtgcctgggagtttgatgccaagggaaggatgcggaatgtctgttttctactaagggcttctgctgggcctttccaatgtccagtttgagttggtctgggacctggcctccgcaaacaccctgcaggctccggccgccggggatgaggtggaagactgggcagaagagaggccgcaaaggcccgagggctgagctgctctgcgctggggaggggcgaagtgccagagcgcgggagacctcatggtgggcaccaggctgctccgcggtaggtgggtgaggccaggagattcacatctgcagatgccacagtgaggatacagcatttagatccctcggctccaaacaggcggttccgggggaccggtagctggggaattgggtttagcactttccaacgcttggaactggacatccacggctccgagtcctttgaggtcttgctcgggactacgtttcccagaaggctaggcgataattgacagctctatcagcctatggacagagaaaaattctagccatggaaactgaaaagccaatagcaagaggatgggggcggtactttccggccgctggctgtcgaagccggagtcccacctgtgtccccacagccctgtcacgaatcccggtcgggttctgggaggcacagcctcggggttgcgggccgggtgcggctcggcggtggaggactcacttcctgctccatccccggctgggccctggggcggtgagtgattcaaggagggagaccgcggcggcagcggcgcgctgctgaggggcgtggagggggcttgcccgccacccagacgttttctcagcggggttcccgcgctggcctttgggagcccccgggtcttgctgggctgtgggagaggtagctgtggtctctataccgtcggcgggataagtcattctcttaatcagttttcttgcttctcgatggtggtcccagggtttcagctgatctgtgaccctctgaccgccgcaccccggttagggcgcgagcaccgagaagaagaacggggttcggccccacgcgtgcagtcatgttcctattaataaacccggtgaacgcactggagcttctcacagtggcacttagtcacagcccctcagcgctgtggggcctttgaggtcacctgtgcatggggaaagggacgggctgggaaacagggtttctataaccgtggctaagacgtctcccctcctcagtggcgctgtctccagcaagtgggccctgcagctgtgttttgtaatgaatgtagaaataaaaattatactcaaaactcttttttttttttagacggaatttcgctcttgttgcccaggctggaatgcaatggcgctatctcctttcactgcagtctccacctcccgggttcaggcgattctcctgcctcagcctcccaagtagttgggattacaggcgtgtgccaccacacccggctaattttgtattcttagtagagacagggtttcaccatgttggccaggctgatctcgaactcctgaccccaggtgatccgcccgtctcgtcttcccaaagtgctgggattacagtcatgagccacagcacctggccaatactgaaaactcttattacaatttttactttctaattacattattgttgtttgttaaagttttaaaccagagagatggtttttagatccttaaaaactcaatactttataaatgaccaataataatgtctgtaaatacaaaaatatttcccccaaaagtgtgtgtgtgtgtgtgtgtgtgtgtgtgtgtgtgtgtgtgttccagtagtaaataggtgatttgtagtgggacaaaagatgtgaaagagtaaaacttcttcaccacagtctggtccttcctcccttgaaatgcaatattctttgtagtgggtggtcatgctggctgcattttttttttttttaagggagagacaggggctcactctgttgctaggctggggtgcagtggcgccatcatagctcactgcagcctggaactcctgggctgaagtgatcctcccacttcagcctcctgagtagctgggaccacaagtgcatgccaccatgcctggctgatttttaaaagttctttgtagagaaagaggtctcaatatgttgctgaggctggtttattggaaactttttaagggaaaaaacattatcttaatttctatgtgactcctatgcctggcaacatattaattgttgaataaatgactgatccatccagtaattcactcttgactatcctccaaaaagtaatgtttttcatgatattgctgtcgatttattaatatattaatgattggtttcagcccctaagagttgtgttttgtgcttattcccactttcacttatttttacaacctatccatgtcttcttttttttaaaaaaaaaatgtctttttcagtcttatttctgactccattaagatcttgaaatagaatggtatccaacacagttccctttggggttctgtataatctgtcccttgaggttgacaccaaatctgcaagccaagaagttagctgctcccataactaatatgagtatagttaaggccacaatttccttgcttgctgaggaaaatgaagttggggagaatcaaaagctttccagaaatcaaattacacctgccaactctctcctttgtttaccttgttcatcgtggacaatttgttcctcaaaaagtcaatgtgtctaaaagactgggttctgtcgatgtgtttgggaggcctaggcctctcttagtaatgggaaagttggccaggagaagacgtatgtaaaaacagacttagaaaagcacccctctgtggttgacagaatttacctcaggaccattctggtcaggtgtggggggttgtttgtgtacactggtggccattttttggctttcagacaatggtgagaatatctagggagctactgatgcacattgaggtctcttgctttaggaactgatgacgcttgataatgtggctggggacttcagggaagagtgggttacctggacactgcttagagaatcctctccaggaatgccacccagcacagttagaagaatgggctctcaaagggtaagaatgctactctcctttatttcatttatttatcttgttttttttgagacggggtctcgctctgtcatccaggctggagtgcagtggcgcgatctcgattcactgcaatctgtgcctcctgggctcaagcgattctcccacctcaacctcctgagtagctgcgatcacaggcatgtgccaccatgcctagctaattttttgtgtttttagtagagacaggattttgctatgttggcaaggctggtctcactatgctgtccaggctggtctcaaactcctgagctcaagcaatccactggcctccgccttccaaagtgctaggattatgggcgccaccatgcctgaccactgctctcctttaatttgagacttagatatttggagagggcccaggtctgaggagtttctggtatgttggcatcttagagctccagacctctgtaagattaattgttgcctccttgggagaaaaacaattacttccttatgcattttatggtttgcaaatgtctttgctatttattgtccttttaatatctcatcataactttttgacttatgtattactatcccccttttccagcctgggttggactctcacctctgccacttaacttctgagacttctgaggtctttgtggaaaaggaggtaattttttctgtcacttaaaaacaggctgggggcagtggctcacgcctgtaatcccagcactttggtaggctgaggtgggcggatcataaggtcaggagttcgagaccagcctggccaacatgatgaaaccctgtctctactaaaaataaaaaaattagctgggtgtgatagcgggcgcctgtaatcccagctactttggaggttgaggcaggagaattgcttgaacctgggaggtggaggttgcagtgagctgagaccacgccattgcactccagcctgggcaatagagcaagactctgtctcaaaaaaaaaaaaaaaaaaaaaaacaaggctgggcgcggtggctcatgcctgtaatcccagcactttgggaggccaaggcagggagatcacaaggtcaggagatcgagaccatcctggctaacatggtgaaaccccgtcttactaaaaatacaaaaaattagccaggcatggtggtgggcacctgtagtcccagctactcgggaggctgaggcaggagaacagcgtgaactgggaggcggagcttgcagtgagccaagatcatgccactgcactccatcctgggcgacagagcaagactccatctcaaaaaaaaaaaaataaataaaaaaaaccaaaaacacctccaatgctctttctcaaatatcatggctacccttcctcctgctttacttctttctttctttttttttttttgtggcagagtctcgctgtgtcgcccaggctggagtgccatggcatgatctcggctcactgcaacctctgcctcctaggttcaagcgattcctggataattttttgtatttttagtagagatgggttatctccatgtggtcaggctggtctcaaactactgacctcaagtgatccgctcacttcggcctcccaaagtgctgggattataggagtgggcccagctctaatttttgtatttttagtggagtcgaggtttcaccatgttggccaggctggtcttgaactcctgacctcaagtgatccgctggccttggcctcccaaagtgctgagattagaggtgtgagccactgcgcctggcctacttcatctattatacaagtaatgtatactcattcaataaaaagtcaagcaaaatgaaaacaaacatcatccctaatcccaccaatgaagagttactatcctaccagcatttttctaagcatatatacaattttaaaagaagcacaaaagaataatattgggattatgctgtatattcagctgtacattctttcttccatgttgtattgtgagtatatctttctttacatcacttaaaataaccacctagtattttgttttatggaatacaatattattttgttgatgaagtcaaacattagattgaaccatatatctgacctttttttaacctataaaaatagcaattgcctgagctacttgggaggctgaggcaggaggatcccttcagcacaggagttcgaggctgcagtgagctatataattattcctttgttgtgggacatttaggtcatttctaaactttcaccaggttgtgataaacatcttttagctcgttttttaaaaagtattttttattgaagtataattttatcattttcttagaattctcagaattagaattggtgggtcaaagaacagatacatttctaaggtatttaatactttgcaaaatgccttccaagaagattgaatcaattgatttattcccacaaacattatatgaaagtgcgcatttctttatattctacctttcacagtgggtattataatttaaagagtctgggcctgggtgtggcagctcatgtctataatcccagcattttgggaggctgaggcaggaggaccacttgagctctggagttccagaccagcctgggcaacataatgagaccctgtctctacaaaaagttacattaaccaggtgtaggggcttgtgcctctggtcccagctacttgggaggctgaggtgagagaatcgcttgagccaggagctcgaggatgcagttaactgtgattgtaccagtgctctccagcctgggtgacagagcaagagcctgtctcaaaaacaaacaaacacacacacaaaacacaaaaaaagagtctgggaaaaatagcaataatagttaacatttattgaagttttttttggagatggagtctcaatgtgttgcccaggctggaatgcagtggtgcaatctcagctcactgcaacgtccgcctcccaggctcaagcaattcccatgcctcagcctcccaagtagctgggattacaggtgtgcaccaccacacgtggctaatttttgtatttttagtagagacaggatttctccatgttggacaggctgctcttaaactcctggcctcacaagtgatccaactgccttggtctcccaaagtgctgggattacaggtgtgagctactgcacctggccaatggatcttattcttatcccaatttttttttttttttttgagatggagtctctctctgtcgtccaggctggagtgcagtggtgtgacctcgattcaccataacctctgcctcctgggttcaagcgattctcctgcctcagcctcccgagtaactgggactacaggcctgtgccaccatgcccggctaatttttagtagagacggggtttcactatgttggccaggctggtctcaaactcctgacctcgtaatccgcctgcctcggcctcccaaagttctgggattataggtgtgagccactgagcctggcctcttatccctattttattgatgaagacattgagacacagagtttaagtaactttcttaaggccacacagcttgtaagaggcaggatgatgactcagacccaggcagtgtgactcttgagtttgcactcattacctctacactatattgcctcagtgtatcattgttataatggaatttctttgattatagtgaggttaaacatttttcgtatatttacaggctacttaacaactgtttgtctttttctcatggcttttttgactgctgccattctgggaaaattttaaagcccaacattatagttaacttccttcattgtttctaagggtgaggtcatggaggcttggtttctgataaaatcctctccatatttagctttagccttgtaccttcagaaatggttattgtatttacttcagagtttctgtcacctgagtctggttttttttctttatgggaggaaaagggcttttttttcttaacattttggggaaatcaccgtgttttatcactgtaccatggctgcacttttttaatgacaccaaatacacgttagagctccccaggtgttcttccatacctaggcagggagtagggcttggattttgctcaggccttgtgtgattggctcagactcacatcctatgtttacattcctgtgtagaatttccaggcctagtgtaatctcccagccggagcagaaagaagagccatgggtcctaccactccaaaactttgaggcgaggaagatcccgagggaaagccacacaggtgagatgtgagtgctccccagtggaaggaaatctagcatttcagccttgtttagatgaagaatttggaatgctgccttagaattttgttcttactagcagacattttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccactagcagacatttaaatttgacttaatggtcagtagttgactaaataaagtcttcattttgattaagcatttcacttttgtctaacctatgtttttttttgagatggagtctccctctgtctcccagcctggagtgcagtgacacaatctctgctcactgcaacctccgcctcccgggttcaagtgattgtcctgcctcagcctcccaagtagctgggactataggcacccgccaccacgcccagctaattttcatatttttagtagggatggagtttcaccacgttggccaggttggtctcgaactcccaacctcaagtgatctgcctgcctcggcctcccgaagtgctgggattataggcgtgagccaccacgcctggcctaaacctataatatcttctaaagaaaccgcacaatattgacaatatgtggtctccgcttgaaggatatcaagattcatctggccatcttaaaatttaaaaagtttaggaattcacgtgttctgacagctcaatgaacctcaataaacttttcacaaagtgaaaacagagcggttgaattaagtgcagtctgctgcagaaacagggattttaatctttgtcactgctttctgatattccttcctgataactgataactttattctctgttacttacattaatttttcagactgtgagcatcaggtggcaaagctcaatcaggacaattctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatgtaggagagaagcctatgtgtgcagaatgcgggaaaagctttaaccagagttcctatctcataagacacctaagaacccacactggcgagaggccctatacgtgcattgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatgacaaggccaaattatcgtagaggatgtttgcggtcttgtgacttggaggctgaaagaatttcagaagctcttttaaatggcagtgtatggcagtgtatctaccagaggtttgctgtcatctgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggccatccaggttatgcactagtacattcctacattcaattgaaataaattgagggacggcaagtgtgttggaaagaacaccgacttcattgagaaggtaaagtatttgagtcctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttttccaagaaaattttggctaatatttctttaggtattcctttttctctcatagtgagggattaaaaaaaaaaaaaactgttgaaaaattagggcgtaaaaatgctaaatgacatgactcatcatgggccacgtagttaacagaagagccagatttggctgcaagtcactagatttccagcctgcagtcctcctctgcaacaacagaccagctctgggatttgttacagtgcctgtgagacattacaggactggaggacccatattatatccattaaaccagtctgaatttggaaatgatggagggtgtagtctaagttgtagggagctttgcaagaacctgtgctggggtccttgatcctggtggaatgggggtggaggagtgagcgcaaatgcaaggggttaaggagggagctgggtagttatcactttttagagtgcaaagtggtggattaaaggtttcttttctttcattctcttccattatatggaatgccatctgagtgctgtggctcatgaaggatagaactcagctgataaccttacctcagtttttgaaagcatcattagataattgaccagaaaattttttttagttaatccagtgcagtggttctcaaactgtgagcccagtccagtagcatcagcattatctgggaactttttagaaatgcagattcaggccgggtgcagtggctcacacctgtaatcccagcactctaggaggccgaggcgggtggaccacctgaggtcaggagtttgagaccagcctggccaacatggcaaaaccccacctatactaaaaatacaaaaattatccaggtgtggtggcatgtgcctgtaatcccaccaatttgggaggctgaggcaggagaatcacttgaacccaggaaatggaggctgcagtgagctgagatcacacctagtctcgaactcctcacctcaggtgatctgcctgcctcagcctcccaaagtgctgggattacaggtgtgagccaccgtgcctggccacctatcattttgtttgtttttcatgttgttcagctattgtaagatgtgagggtttttttgttttttgttttttttaggtgaagtcttgctctgttgcccatgctggagtgcaatggcatgatcttggctcactgcaacctctgcctcccaggttcaagcgattctcctgcctcagcctccggagtagctgggattacagatgcatgtcaccatgcccagctaattttatatgttaagtagagacggggtttcaccatgttggccaggcgggtcttgacctcctgacctcaggtgatccacctgccttggcctcccaaagtgctgggattacaggcgagagccacctcacctggccacctatcactttgattttcatgttgtttggctatggtaaaatgtgagctctcgaagggcaatgtgagatttgctttgtggccctgccaatcccctccctcctccctgtcttcctgcccacccccccccactcccccgccagccatgagcagggaatatttcaatgctattgctgagagtggaggtaaccctttctatagttttcttttgtttctacctcatgactagatgattcactgcttgaacatgctccacacatccgttctttctcactccaaaattgaggtcatcaccaagccccattaattttacctcccagattcctctcgaacctatctgtcaaatctgtccatcttcactgccacccttcagtaccaaatgaccagtctcttacctgaattcctgtagcagcctccaaactgatcttcctgatatgatttttgctctgaaaaaactggtttcactcacagaaaccagagtgaacttttaaaatcctaaatcgaatcacatcacttctcagcagctttccattgcttttagaatgaagacccaaatccttacccaggcctaagaggcccttgtggttttgtcccctccccctccatcctcttgtgatatccccttccctctcccttgcctcacctcagcactcttgagttctctgctccttggtcatgccaaggttgtgtgctctttagacccttggtactaactgttccctctgcccagaatgttcctcgcccagtcctttgtgttgcctcctatttgtcaaccaggtttcagcctaaacctatctccttaggaagactttccctaactatcccatctaaattagtcaccctccatcacattatcctcttttttcatcaaagtccttacacctgtctggcaatttcttattaattgatttgtttttggtaaactccacgaaaggtgggagtcatttctcttgtttccattctttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgttatcaccaagcaccagggcaggcaccacaacaaaaagataagatccctaacccttcttttacctcgaaataattcctcctagaccctatcatcgcattccttctcttccccttttgtcaaacttccactcacatgtagatattctcagggttatcatgcctaggcctttttaatagggccacttaccctagcatgcttctacaactggaccctcaaaggtcttttagggctgagtgtggtggctcacacctgtaatgccagcattttgggaggccgaagccagaggactgcttgagcccagaggttcaagaccagcctgggcaccatagccagaccctgtctctacaaaaaatagtttcaacaaattagccaggcatggtgatgtgcgcctgtcatcccaagtacttgggaggctgaggtgggaggattgcggattgcctgagcccaggagttcaaggctgcagtgagctgtgatcataccaccgtactccagattgcgtgacagagctagaacttgtctcttaaaaaaaaaaaaagacttaatttccacatctgaaggcctcttgttagtcttcttctgattcaacaactctttactgtttgatgccatttacatatgtttattattttttagagatggggtctcattcttttgctgaggctggagagcagtggtgcgatcatggctcactgcagcctcaacctcccagactcaagcaatcctcctgtctcagcctcctgagtaacagctaggactacaggcacatgccaccaagcccggccttttaaaatttttggtagaggccaggtgtggtggctcatgcttgtaatcccagcactttgggaggtccaggcgagtggatcacctgaggtcaggagtttgagaccagcatggctaatatggtgaaaccccgtctctagtaaaagtacaaaaattagccaggcgtggtcgtgggcgcctgtgatcccagctactcgggaggctgaggcaggagaatcacttgaacctgggaggcggaggttgcagtgagctgagatcgtgtcattgcactccagcccaggtgacaagagcgaaactccatctccaataataataataataataataataataactttgctagagacagggttcccctatgttgcccaggctggtcttgaactcctgacctcaagcaactctcccaccttggcctcccaaagcgctgggattacaggtgtgagctactgcaccaggcccatatgcctttttaaaaaaattatcttttccattggtgactatgaggttgagagatgattctcctacatttctggctgctcctcttcaagtaccttccctggctcctctggatttttttgttttgttttgttttgttttgttttgtttttgagacaaagtcttgctttgttgcccaggctggagtgcagtggcaggatcttggctcaccagctcactgcaacctccacctcccaggttcaagggattctggtgcctcagcctccagagtagctgggactacaggcccagctaatttttgtacttttggtagagatgggggtttcaccaggctggtcttgaactcctgcctcaggtgatctgcccacctcggcctcccaaagtgctgggattctaggcatgagccaccgcgcctggcctggctcctcttcttcttccactcagatatgcctgaccctgtcaacactttggttgaggtcttctttcttctttcttttttgctccgcacatttagcttatgacttcaaccatcatttctcagagcatgggtctggctcaacctctctcctgaatttcagacctacaagtctagctacttggtggagacctccccagaatgacctgctgcttcccaaaagcagactctccaaattacagtcagtatctcccccggaagcattcccccaggcatttctctttctgccttcaattccccattctcctacattgccttgccagaagcctgctggtcagcttggatttctttttgtccttttttttctatattttgctggtgcctagtcatgtagttgctgcctctacactttctcttctttaaaaaaaattattaaagcaccacgtgcttgttgtaaacatttccagaaaatacagaagtgctcaaagtgaaaaaatggaaatgccttgtcccttcctcattccctgccctaacctcacgccccagattcagctatgtaatagtctgtcatgccaagtcttatttccagctcctcttttccatccccactgccatcatctgaactaaacggattgttttccatctggtctccttggcttttcctttcagtgcagctcaacagacattaatcaagtgccttccacacaccaaagtcctaccctagatcctagaggttcagagacaagtaagatagttaaagagatccacattccagagctgtttaactttgggcaagttacttaatctctctgacccttacttccttatctgtaaaatgatgctaatcccagcacctttttcatgggtttggacgagcattaatgagatgatccatgtaaaactctttgtactaactacctggtacactgtatctgctccataaatgtcagtgacaacaatgataataatgacaatgtttggaggagtttatagcttaatggagagacttaaagcataagaattatctaggcgaagaatgatgagaaaatatttttggaaaaggaaaacaaacagttctactaaaattaaaaggctgatgtagagacttgggaaactgggaggtaagagctcggactgtgtcctctaagacagtaattcccgaagtgtgagcaaaagtccacctgcatcagtcttacttggggtgattgctcaaaatgaggatttaatggctgcacctccgagcaagttggtaatttacatatcggaatgctatccatcaaggaaaatgggcagactacagttacatgcatcaacacagacaagcttcaaacaatattgagtgtaaaaagcaagacatagaaatatatatttagtaagagtaaaaatacagtaaaggtaaaaaagaggcaaaactaaacaatatattgcttaagcaataaggatacacaaactaatgaaaatcaaaggatttactaatacaaacttcagtatagtaattaattggaatgggagagaaagatgcaaagtttctatttctttttttgttttgttttgagacagtgtctcattctgttgccaaggcaggagtgcagtggcaggatctcagatcactgcaagctcagcctcctgggttcaagtggttcttctgcctcagcctcccaagtagctgggattacaagcatgcaccaccacacccagctaatttttgtaattttagtagagatggagtttcaccatgttggccaggctggtctcgaactcctggtcttaagtaatccgcccacctctgccatcaaagtttctgtttcttaagttggctgccgagtacacaggttttctttgtaaaataattatttaaattgttaatatgcattacttatatgcttttcatttacaatgtatttcacaagaaaaataaaacaaagcaaataagaaaacagaacacttctccagagattgatctttttcactcaaatctcattgagttatactgagggggaaaaagagtaatctgagtgcctgggccctgaacagacacactagatcagttccttcattcccactcaaacacatgcacacacacgcacaaacacacattttcttatatttccttcagcaaaccccccgccccaccaaccaaccccaaaacaccctctgctcctttatgtatataaattagagcagataaatgtccagaagattataggccatctttctataaacagccaatcttggacctggtgtctgaatgggggatgccctgctgcattaaagatgctcatgtgaacattttgttgtttcccagaaaaaaagtttccacattttagattattttcacagggtgagaacaattttacacctcccttacttgctgcagaatcttttttttttttttttttttttttttgagacaggtcttgctctatcactcaagctggagtgcagtggcacgatctcggctcactgcaacctccgcctcccaggttcaagcaattcttctgcctcagcctctcgagtagctgggattacaggtgcgcaccaccatgcccagctaattttttgtatttttagtagagatggggtttcaccatgatggccaagctggtttcaaactcctgaccacaagtgatccgcccacttcggcctcccaaagggctaggattacaggtgtgagccaccacgcctggctgctgtggaatcatttttaaagtgattgtatcaatttacagtgttccgaacagtaaatggctactagtctcatcacaccctcatctttaaaaaagttttgctaatttaatagacatgattcttacatattgtcttaatttgcatttctttgcttaccagtgaggttgaacatttttttctatgttagaatctttcttgtatttcttctgttgttttcattagagtaactcagagcaggattgggaatctgaaaacatgaacatttgattttgaggaagtcattgttttcctgttgtcttccttccccctctctgctttattattttttacttcaggttcatttatagaaatatcagaaaatacaattaagcaaacagagtaaattccacttcccagagataaccactaccgtttgttgtatatccttttaagctttttctctgccaaaaatattcacaaatatatcgcttattctttctgagcctgtttcctcatctatcaaatggaatacttgttcttcaagttgataattaactggtgggagcacatgaaagtattttataaagtgcacaaatgcaagttgctgctcttatgacaaagaaaaaatgtattttattctgccaagcagaatgatgacactttgtttcctgaacacagcctgctctctccagtacaatttcttctctctagaatagcttcttgcttcaattcctcctgctgaactactatctactctttttttaaaaaaatcaatattaaaatatacaaaaattagtgtaaagagcaaccacgtacccactatacagcttaggaaaagagtctggcatttctcactcctatgcctttatatatacttgctttatttcctgtctctctatatatacatacatatatatttagtaagagcaaaaatacagtaaagatcagggaaggtgcggtggctcacgcctgtaatcccagcactttgggaggccgaggcgggcagatcacgaggtcaggagtttgagatcagcttgaccaacatggtgaaaccatgtctctactaaaaatacaaaaattagccaggcgtggtggctcatgcgtgtagtcccagctattcaggaggctgaagcagaaaaatcccctgaacctgggaggtggaggttgccgtgagccaagattgtgccactcactccagcctgggcgacagagtgagactccatctcggggaaaaaaaaaaatacagtaaaggtaaaaaacaggcaaaactaaatatattgcttaagcaataatgatactcatacaaactaatgaaaatcaaaggatttactaatacaaatttatagtagttaattggaagcatatgtattatataaatatacatgtattatacatatatgtatatatgtatatatatagaaaaaagcaaatatatgtatatatacatatatatctatatatgtaaaatttttatttataaaatgtttttgagcatgaaatgatatatcattgtggtgttaatatgcgtcttagctgggcatagtaggtcacacctgtaatcccaacattttgggaggctgaggcaggaggatttcttgagctcaggagttcaagaccagcctggacagcatagtgagaccccatctctaaaaaaaaaaataaaaattatctggcgtggtggctgatgtctgtagttccagctactcaggaggctgaggtgggaggatcacctgagcactggaggtcaaggctgcagtgagctatgatcatgccactgcactccagcctggatgacagagccagatcctgtttcaaataaataaattaaattaagttaaaaagtatctccctgattagtggggaagttacccaactttttttttttttttttagacagagtctcagtctgtctcccaggctggcatgcagtggcacgatcttgtctcaccgcaacctccacctcctgggttcaagcaattctcctgcctcagtctcccgagtagctaggattacaggcatgtgccaccatacccggctaattttttgtatttagtcgagatggggtttcgccatgttgggcagactggtctcgaactcccgacctcaggtgatcctcccacctgggcctcccaaagtactgggattacaggcgtgtgccaccgtgcccagcagttacacaacttttacaagtttattgttgttcatgttgcctcttcagggaattttgtttataaagtacctattcttcaaggccccattaaaacacctccctctccataaagtatttccagatctcctctatcaagcagataggatttcctttggacttctataatcctttctttctacatcttgggtttcactcacttcttatttcatcttgcattacagtcacttgtgtacttgtctaaagggcagtgactatgtttaactcaactttatgcccttgttcatactagtacaaaagtaaacatttcataaatctttgttgaatcaaatcctactcctcccctgcttataaaatcttaaatcatttcctattgtctacagacgaaagtagaatctcgtttaatgtagaatttaagacccttccacgggctctagcatcaaccttcctttcttgctcttctcctgggaggaccttgctttccgccccagatactagattcttcatccacagtaaggtcccagtccactaatgtttggcttttctctctgtagctgggatggcaggttggtcccacccattttagttgcctataaaattcttttttttttttttttgagatggagtcttgctctgttgcccaggctggtatgcagtggcatgatcttggctcactgcaacctccgcctcctgtattcaggcaattctcctgcctcagcctcccgagtagctgggattataggcaactgccaccatgcccggctaatttttgtatttttagaagagacggggtttcaccatgttggccaggctggtctcgaactcctgacctcagatgatccgccctcctcggcctcccaaagtgctgggattacaggcgtgagccaccgcgcccggtctgagccaccgcgcccggtctgagccaccacacccggtctaatttttgtatttttagtagaggtggggtttcaccattttggccaggctggttttgaactcctgacctcgtgatctgcccgcctcggcctcccaaagtgctgggattacaggcttgagccactgcgtccagcccaaactctttaagagaaaatctcttgggatcttgaagccagaagcttgcttttattactgagtttgccctgaatctgtcacttatgtactaaaaatacataaatttccttatccaggtgacttgggctcaactgaaggaaacctgaagcatctaaatgttagcacctaagcctgagtctaggtgccagcatagcctgtcttccctctccagagtcagaggcatgttacaaacagaatatatggacacacgtcgaaccccacattgtatctctctaatttattcaatttaattcagtaaacactcattacctcttatatccaggcctagttgagggtgctggggatacaggtataaacatgacagttctcttgaggagcacagagtggttgtgggaaacagacatacagacacacagtttctttctttcttttttctttttttttttttttttgagacagagtctcactctgtccttcaggccggaatgcagtgaggtgatctcagctcaccacaacctccacctcctgggttcaagcgattctcctgcctctgactccccagtagctgggattacagtaatgcgccaccacacccacctaatttttgtatttttagtagagacaggcttttgccatgttggccaggctggtctcaaactcctgaactcaggtgatccgcctgcctcggcctcccaaagtgctgggattacaggtgtgagccaccatgcccggcccagacacatagtttcaatacaagaagtatatgtcagccagagaagggctatcttgagagtcaaggaaggctccctggaggaggtatcacttatgccagttggtacatgaatgagtaaatgcaaacaagccatgatactgaaataaagctttgtttaattaaccttcacatgtaaattcagccacagaagacattctgatacatgggggcattgccagtgattccacgaaactggataatgtcattgatgcttgtggttgagagagcttgtttctgtattgtaaggaaggtggtacaacctggcctttcttttaaaaaaaaaaaaaaattcaaactggacatgtgtcaatgaactgactggagtcttagggaggaacattgctccatagctatatgtctctcccgttttttcctgtgttagtctttttttttaatttttttaaaatttttttgagacagagtcttgctctgttgcccaggctggagtgcagtggtgtgatcttggctcgctgcaagctccgcctcccgggttcaagcaattctcctgcctcagcttcccaaatagctgggactacagatgcatgccaccatgcctggctaatttttgtatttttagtagagacagaatttcaccatgttggctacactggtttggacctcctgacctgaggggttccacctgcctcggcctctcaaagtgctgagattacaggagtgagccaccttgtctagctctttttttttttttcttttgagacaagttcttgctctgtctcccaggctggaacgcagtggtgcaatcacagctccctgcagcctcgacctccccagctcaagtgatcttcccacctcagcctccccagtagctggggccacaggcatgcaccactacgcccagctaattttttttattttttgtagagatggtgtctcaccatgttgcacaggctggtatccaactgctgggctcaagcaatcttcctgccatggcctcccaaagtgctaggattacaggcgtgagccactgtgcccacgtgttagtctttacataactgaatagtgactgaagtcttgcagtttctaccttgccctgcactggcattataagttgtagtagaaatgtcactcattgcttgtaatctcatgagaggcctagttagatttttctgtactctacttccagaggagcttataggaaggtgactttccataaaggatgtgagctttctaccacccaaatatcagtcgtaaagaaaatgaggagtgataaagaaagaaggtattgagaggtgaagccagctgggcttctaggttgggtggggacttggaaaacttttctgtctagctagaggattaaaaacgcaccaatcagcactctttgtctagctaaagtattgtaaatgcaccaatcagcacactgtaaaaacgcaccaatcagcactctgtgtctagctaaaggactgtaaacgcaccagtcagcactctgtaaaatggactaatcagcaggatgtgggtggggccaaataaggcaataaaagctggccagcgaagccagcagcaggcaacccactcgggtgcccttccatgctgtggaagctttgttctttcgctcttcacagtaaatcttgctgctgctcactctgggtccgcactaccttcatgagctgtaacactcaatgcgagggtctgcggctgcattcctgaagtcagcaagaccacaaacccaccgggaggaacaaacaactccagatgagccacctttaagagctgtaacactcactgcgaaggtgtgcggcttcactcctgaagtcagtgagaccacgaacccactggaaggaagaaactccggacacatctgaacatctgaaggaacaaactccggacacaccatctttaagagctgtaacgctcaccgtgaaggtccgtggtttcattcttgaagtcagcgagaccaagcatccaccaaaaggaataaattccagacgcagtatttacagcccagtgtccacccattccccatgtagcaacccctggtacctgaggaaaaaggtcacagcctctgccaatggtggggcatctttccgaagaggttccacttggactttttgaaacatcatgtggctgtgctgtttgagaagcctggggtgaaattaactatacaagaatcagggcatgatcacacacgcacacacctttgcaatttttctggctttgtttacactgttactgcaacttgtgccctttctcacccttttcataggtcttccctgcaaagtctttttttttttttttttttgagacggagtctcgctctgtcgttcaggctggagtgcagtggcgtgatctcggctcactgcaacctccgcctcctgggttcacgccattctcccgcctcagcctcccgagtagctgggactacaggcacctgctacctggcgcagctaatttgtgtatttttaatagagacgggtttcaccgtgttaacgaggatggtctccatctcttgacctcatgatctgcccgcctcagcctcccaaagtgttaggattacaggcctgagccaccgcacccgacccatcaactgttctcttatctgtgctcctagatctctatcttgatgtctgaaagcttcttgagagtgctttgtcaggtctatgtccatcacattctttggtggatgtggcctcacaaatctttcaactcagccctctaggtcctcatgtgcattagtggagaatagcgttcacatatgtgggctttgggtccaatgcagtttgaatactgagtatgtcactaactagttgtgtaatttttggaacattgttaacctttctgatttcagtttccttatccttaaattgaaaattctagtagttcctacctcataggattgttgtgaaggtcaaatgagatcaaatacttacaactggacctaaggggcactcattatgagttagctgttgttactagtaacccattgtcatccctgtagatgtttcaggggtttgccgtggggaaccctgccatgcaggcttgtctcaggttctgaccctgtgatggggtctggtgttccctgcctcgtttaccgctctttccccatactttggtctgactctccaatgagctcatgattcctatgagcgatttctgtctcttgatgaatctttagatttgtcctttgtcttaggccttgagactgcagtagaaccttgtggcctattctaaccccagcccggaaaccaatgccccaactccattctgggctgacttcctggcttcctcccacaacttccgggtctctgtttttatatattgttcctagactaggatatgggtgttcacaaatgtttgttgaaaggttttcagaggcaattaggcatatttaagaagtgaatgaacacctgctcattgatatgctgtccataaactaggacacggtgttgaatgatgatttgacagagattttagaatcagagagatggaagcttgatcctaactctgaatcttatggccttaagcaaaatatctaacctctttgtgcctgttttctcatttgtaaaatgaggataattatatttcctcatagggttattgtgaagattaaatgagacaatataaataaagcacctagcattttctggaacatggtaagcagttggtaaatagctgcaactaccaacaggtagttcaaaacttttcctccatctgaaaaaccaagagttgaagaaatggctgaagttggaatatctggcaggagctgtgcttaaacacaagatccggaatatctgaatatctttaggacaagatgaaataggtttctctcaaatgagttggttaaggagttaagcagtgataggtaacacttgaagtttcacaaagatgaaaactggtacttgacagacagccacttgatggtattctgaagtttactgaccctttgttctatttctagaacaaggtgttctatctctttgcccaaggtgttcaaagtatagagaaacaaagaagatcagtaattacatagaccaaatggagtatcggatttattacgaactacatctgctcaaaagactcatgaactatatggagttagtcctatcagagagaagcagggtatccagctagctcataggcctttttatacaaaagtttaccattagcatgtttggtaacattacttataagccaccccaaccccctccccacacactcaagtttccttaagtgtatgtattagttttctattgaagtacaggcaagcttgactgggttctttgctcagagtcttacaaggtcaagattaaaatatccactagattaaggacttatcttgagactgtgaggagaatctgcttccaagctcatttaggctataggtagaatcaagttccttgcagttataggtctgaggtccctgtttccttgctgactatcagtcaggggccactcttagcttctcgaggctgctctcaagtcctttccatgtggacccctccatattcaataccagcaatggcccattgaaccatcccatgctttgagtctctgacttcttttgccagctaaaggaatctctctacttataaatggctcatgtgatgaccaggataatttccccatcttaagatcaactgtttagtgccttaattgcatctgcaaaatcccttcaaaatagtgcctagattagtgtttgattgaatagccaaggattgggaatcttgggcagtcatctcagaattctgcctacacagcatggttacaatttcctgaaaagctatcctgtgaggcctgacagttatagtacaagcattggataaacattcccatttcagaatggagaaatcagccaacaagaaaggtgctacaggccccatgcaagtttgaaagctggaagggcagtcattagatcttaaagctctaacataatctttgactccatgtcccatatgctgggcataccggtgcagtgggtgggctcccaaggcatggagcagctctgtccctgtggctttgcaggattcatcacccatgactgctctcatgggctcgagttgagtgcctgtggctttgccaggcacagggtgcaagctgctgttggatctaccattcttggatctggaggatggtggccctcttctcacagctccactaggcagtgtgccccattgggaactctgtgtggggaatgtgtattaatctgttctcacactgctaataaagacatacccgagactgggtaatttataaaggaaaggggtttaattgactcacagttccaccgtggggtggggctcacaaccatggcagaaggcaaatgaggggcaaagtcaaatcttatatggcagcagacaagagagcttgtgcagtgcaactcccatttataaaaccatcagatctcagggaacttattcactaccactagaatagtatgagggaaaccactgccacgatttaattatctccacctggccccacctttgacacgtggagattgttacaaatcaaggtgagatttgtgtggggacacagccaaaccatatcagtgtgccaaccttacaattccccttggcattgacctagtagaggttctctgtgaaggctccacccctgcagcagtcttctgcctggacacccagacttgtccatacatcctctgaaatcaaggtggagggtggcaaacctcaagtcttgtgctctgtacaccgcaggcttaacactacatggaagccaccaaggcttttggcttccaccatctggaactgcagcccaagctgtacttgggcccctttgagctgtgggtagaggtggagcagcctggatgtgggaagcagtgtcccaaggctgtgcagggcagcagggccctgggcttggtccaggaaaccattcttccctcctaggccactgggcatataatgggagaggctgccatgaaggtctctaaaatgcctttgaggtctttttcccattgtctttggaattagttcttgggtcctttttagtcaagcaaatttgtctagcaaatggtggctctccacagcctgcttgaattcctctcctgaaaaagctttttctttctttgccacatagccaggctgcaaatttttcaaacttttatgctgtgcttcctgtttaaatataaattccaactttaagtcatttctttgctcccacatttaagttaggctgtcagaagcagccatgccacaacttcaatgctttgctgctgagaaatttcttctgctggccaggtgtggtggcttatgcctgtaatcccagcactttgggaggctgaggtgggcggatcacctgaggtcaggagttcgagaccagcctggtcaacatggtgaaatctcatctctattaaaaatacaaaaattagctgggcatggtggtgggtgcctgtaatccctgctactcaggaggctgaggcatgagaattgcttgaacccgggaggcagaggttgcagtgagccaagatgcaccactgcactccagcctgggtgacagagcgagactcagtctcaaaaaaaaaaaaaaaaaattcttctgtcagacacttagatcatcaccctttagttaaaagttccacagatccctagggcgtggacagaacacagccaagctctttgctaagacacaacaaatgtgacctttgttttagttctcaagaagtttctcacttccatctgagaccttgtcagcctggccttcattgtccatatcactatcagcattttggttgaaactatttaaccagtctctaagaagttccaaactttccctcaccttcctatcttcttctgagccctccaaactcttccaacctatacttgttacccagttgcaaagtcggttccacattttcaggtatctttatggcagtgccctactccttggtaccaattttctgtgttggtccatttttgcattgctagaaagaaatacctgagactgggtaattccttttcctttttctgagacagagtcttgctctgttacccaggctggagtgcagtggtgcaatcttggctcactgcaacttccacttcctgggttcaagtgatcctcctgcctcagcctccggagtagctgggattataggcacacaccatcacaccttgctatttttttttctttttttagtagagatggggtttcattgtgttgatcaggctggtcttgaactcctgacctcaagtgatccacccacctctgcctcccaaagtgctgggattataggtgtgagccactgtgcctggctgagactgggtaatttataagaaaagaaatttaattggctcacggttctgaagactgtacaggaagcatagtggcatctgcttctggggaggcctcaggaagcttccaatcatggtggaaggtgaatggggaggaggcgcatcacatggtgaaatcaagagtgagagacagagtgccacacactcttaaatgaccagatctcatgaaaactcactccctatcacaagaacagcagcaagggaatggtgctaaaccattcaagagaaaaccgcccccatgatccaatcacctcccaccaggccccatctccaacactggggattatagttcaacatgagatttggatggggaccaatatccaaactatgtcaacaattgtgttacttctccatctacttttctcctggtagctggctagtttctcttaacactgattgtaagacctatcctgatttcagaggcatttaaatataaaaaaaattgggacttatttcttgaaaatgttgtacttactagacagtaagacttatttctgaagatacctggtttctaaaagtactactgggaaatataataaatgaggaagtgattaattttgcctggggagtaggtgacatttgaattgggtctgggaggttcagtaggagtttcccaggcagataataggctaaaaggtattccaagcaagggaaacttctattatggtgcttatctcaagatatcctgttaatattgcttgactcctcctggcttgtaaattctttgtggtcattaaccaattttgactcccaaaatgaccatttacctcattattttgccgtttattcatttcatatttactaattttattcatatttatatttgctgacaaaatagtatttccagcagctcattttaaatacagacaagcaagcaagcaaaccccacacaaatccagtgtaatagcactgcctggagaagccactgttaatatattggtgtatatacttcaaggctttatctattcatatgcacatatccatcaatgtatctatctatctagctacatttaaaacaaaatggtatcatatttattagtcataatttgatatattaacttaaccacaatattaaaatattgtactgccagcctgtacattttttgcctgcccagcctcccactgaaggaaattatgcccagctcatagttctctatgcttaattatctgtatctcctgatcatagttgattgaagtaaaggatcagcatccaatctaagggcagcctgcctgtgggtggtcagagatttacccacagggtggaaagctgagctgggtcaatcatatgccactctatgggttatggagttaggcaattgagatgatcctcaatggagctgatgatgtaaggataccatgaccttcagtcaaagccatggcaaggcaagcagaaacaagagttgtgagggaacagaaaaaattaaatggagtaagctggttagcaaagagtggagagtagagccagcctgtggaaaagcagagatgcccagagaatgaaaccatgacttcaagctttcattagtcctgtttttttttgtttagtgtagttttgtttttggtgcagttccagtccatataggtctgtataagaaaggcctcccttccagccttttttcctctagaagtaaaactgtgcatgtctgtttcctgtagccagtcaagcctgaccagaccacagatcatcactgttcatggctatatggcattctattgtgtatagctgccatcactgatttaaacacctactgatggacatttgagtaatttccaaggagcatcttcatggataacttttgcacatttaataaaagcacgatatccttatgatacattccaagaagtgaagttttttggttgaagaatagatgcataatgataagctggtctttagaaagactatattaatttattgcctactaacattgcataagagtggttgctttttcacccccttgccaataatatcaattaaaaagacaaaccaaaatgttgctacatatgataggcaagaagtgatatgtggcatgttatcttttctattttttttttttttggtgatgggtctcactctgtctacctgggcaggagcacagtggcgggatcacagctcactgcagcctcaactcccaggctcaagcgatcctcccacctcagccttttgggtagcatgccaccacgctgggctaattttttgtattttctgtagagacggggtttttcattttgcccaggctggtcttgaactcctggcctcaagcaatcctctctcctctgcttcccaaagtgctggggggtataggtgtgagccgttgtgcctggccagcatgttattatcttaatgtctatttctctgaatcttgagtttattgactaggaattgggctttgtcattagacaggcctgggtttgagttccagctctgcctcttgctgtgtggcttcaggtaagtaacccagttctccattttcccaagtgtaaaatggacataatgggattattacaaggatcagctgagaaaataaatgtgcaacacttagtatagtaaggtaccagtgcagttggtaacttaacatctctgtggctttcacctcagacaaactttgtaattaagtaaagaaagcctttatggaatgaacaattggattaatatgttggagttaagaagaaatatttcggctgggcatggtggctcatgcctataaccccagcacattgggaggccaaggtgggcagatcacttgaggtcaagagttcgagaccagcctggccaacatggcaaaacctcacctccagtaaaaatacaaaaattagccgggtgtggtcgtgtgcgcctgtaagcccagctactcaggaggctgaggcaggataatcacttgaacttgggaggctgaggttgcagtgagccgaaatcacgccactgcactccagcctgggtgacagagtgaaactctgtctcaaaaaaaaaaaaaaaaaaagaagaagaagaagaaatatttcacattttatgtattcgcaatgtttaagaaaatttggccgacttgaatgacagcttttttgtaaatcattttaaatgtgtaattgagttagttttagacttaggtttttgagttgaaagcttactaagtttacacatggaatcaggccatctaagagaatgttagctttgttatgcttgtatgtttatttataggaattactaagttttgaaaaagttttaaacaattgaatgaattaaaaagaaaatctaggccgggcacagtggttcacgcctgtaatccaagcagtttgggaggcagaggtgggtggatcacctgaggtcaggagttcaagaccagcctgggcaacatggtgaaatcccgtctctactaaaaatacaaaaattagctgggcgcggtggtgcgtgcctgtaatcccagctactcaggaggctgaggcaggagaatcgcttgagcccaggaggcagaggttgcaatgagccaagattgtgccattacactccagcctgtgcgacagagtgagactccgtctcaaaaaaaaaaaaaagttttgaaaaagttttatacgattgaatgaactaaaaagaaaatctaggccaggtgcggtggctcatgcctgtaatcttagcactttgggaggccgaggccagtggatcacaaggtcaggagtttgagaccagcctggccaatatagtgaaaccccatctctaataaaaaaatatatatatatataaaattagccaggtgtggtggcgggtgcctgtaattccagccacttgggaggctgaggcagaagaatcccttgaacccgggaggcggaggttgcagtgagctgagattgcaccattgcactccagcctgggtgacaagagtgaaactccatctcaaaagaaaaaaaaaaagaaaatgtaataggaaatctaatatagacaatataataggcacaatttattctttattattattttttatttttatttatttatttttttgagatggagtctcgctctattgcctaggctagagtgcagaggcatgatcttggctcactgcaagctccgcctccagggttcacgccattctcctgcctcagcctcccgagtagctggaatacaggtgcccgccaccatgcccggctaattttttttttttttgtgtttttaatagagctggggtttcaccgtgttagcctggatggtctcaatatcctgacctcgtgattcgcccacctcggcctccgaaagtgctaggattacaggcgtgagccaccgtgcccggcaattattattattttttaaaagacagtctcgctccgtcaaccaggctggattgcaggagcacaatctcggctcactgcaacctctgcctcctgggttcaagtgattctcctgccttagcctcccgagtagctgggactacaggcgtgtgtcaccatactaagctaatttttttgtattttagtagagacgggggtttcaccatgttggccaggctgctctcgaactcctgacctaaggtgatccacccaccttgacctcccaaagtgctcggattacaggtgtgagccactgtgcctgccctagtaggcataattttaaatatttgaagatgttgaattaactgagtgagacttaaaaaaaaattttcaggaaatttcagaatgctctatgtcctcgttgccattgcggctgcctttctcaagaatgcctggcctaaggagcgggtgctggtcctgttcctcaccatcgggggcctagctataaatctgaccccagtctgcccctataccatgtactccaccaggatcaactaggccacgccccacaacaacccagtgcccctccgagatgatgggaacatgctggacatgcccagccacccccaaggcccaagcatggagtggttgaagaaactgcaagcacttccattgacatggagaagaccatgtcccctgtggcccccaataaaaatgtgacccccccgcctccgaaataaataaatcattcagtttctgaaaagtgtttggtaaaatgtgctagacttataaatagaataatacaatttgtaaagtgaacttaaaagcttaagaatgaaataactttttactttgtaggcttaataaatgaaacccttgcccacttttctacaggggtgttttgttcttacaggttttcaagtatctttaatagtctgaaggaagagtgaatacattgaaaatagctggagcaaaacatctggagtcaggctatgatttggcatgctaaatcatgctgaacttggcccattatcttgaagggaggaatagaaaaaaaaatttaaaaagagaaacacaattgcatttgcactttagagagaacaccctgataactgtgaggatctagttggcagaagggcgactacagtgtaatcacaacagggatggagacaaaagtagacatctcagaaataaacacagattggatgtagggtgcgaggcaaggagcctggggtgttcccactgggaattgagtacttctgtgaatagagaatatagcaggagcagggtcagtatttgacacgtgggatttgaagtgtctgccctatacacaggtgaaagtgttcattagctgaaaatactgagggacttccagacgatctggtctggtgatacatatcgaggggtcctcagcagttataggcgagtgtagaaaagattactgagtaggcaaagaataaacggaagagggccgggcgcggtggctcacacctgtaatctcagcactttgggaagcagaagcgggtggattacctgaggtcaggagttcgagaccagcctgatcaacatggtgaaaccctgcctctactaaaaatacaaaaaaagtagttgggcgtggtggcgggcacctataatcccagctacttgggaggctgaggcgggagagtcgcttgaacccgggaggcggaggttgcagtgagccgagatcgcgccactgcactccagcctgaacgactgagcaaaactccgtctcaaaaaaaaaaaaaaaaaaaaaatgccgggcgcggtggctcacgcctgtaatcccagcactgtgggaggccgaggcgggtggatcacgaggtcaggagatcgagaccatcctggctaacacggtgaaaccccgtctctactaaaaatacaaaaacttagccgggcgcggtggcgggtgcctgtagactcagctactcgggaggctgaggcaggagaatggcgcgaacccgggaggcggagcttgcagtgagcccggatcgcgccactgcactccagcctgggcgacagagcgagactccgtctcaaaaaaaaaagaaaataaaaaaaaagaaagaaagaaaagaaaaaagaataaacagaagagggctgcggacagaataccgttgaataccaatatctgaagggcaagccacaaggtgcagggggcagaggcatccctgatacgggaaaagagttattttaaaaagaacttgcaaagaacaatgtcaagggatccaaaggtagggaatttggacagagttcggctttagcatccgcatctcaaatacctgggtacctgggtaatctggtgactgctgccgaatctaagaggactgaggccaggttgccaaactgcggagagtggggttggagggctttcatggcagtttggggcctgcttgtgtccaacaagacaacctgggtcacctcaaagggtgtcttctccaaatattggtgcagaggttagctgggccggcaagagaagggagatgacccactattttgatttcaggcagcagacaccggcagcctttcggttagagttgcggatagggcagtggccttgggggcggggctataaacctgggcgggcattcccggcagggcaagctcagcgtgagcccgattggaggatgggctctaccttcttccttccgcctacggagaccatagcgggatgcagggcggggccgggctgagggggcggagttaggggcggggcacggtgactctggccccgcctctttccggccgctcagggcggtgtcgctggggcggtgccgctggggcggggcctgcggggtggggctgacggcacggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctgtgagtgcggggctccgcggcgcgggggcttcgggctgggctaattgcagacgaggcgcgattttcctgggggctcggccgggcgggtggggcagggcggctgccggcagctcggacccggaagagccgtcccggtggggcggcgggcggcgggcggggaggcccctggttcgcgccccctcggggtccgaggcggcggagaggacccccgaggcctcccgccttagctggggccgcggtagggggagccccacccagcgcctctcgccgcccaggctcggccgagattggggaagacggcctagagtgaggtggcaggatgaccgcgcagggcgtgtcccggggattgggggtctgggtacgcgggctctgcccgtttcgtggaaaggcgctgccctagtgttgcctgcggggtagacccaagggatagaccagggtccagacctgtccggtcccaggctagctacgaggtgccgtcctgggcaagtcacttcagttttctcgggcttagttccctcctcaagatttcaaaagtaaaatagtaataaagaaaaaaaaaagaagcagaaaatcctctgacttcctcattttctgttgtcggccctggacgtcattgaactgcaggcaggattggctaaaggaggaccctttgggattttgaggttttcggttttattttatattgtgggaataatgttcttttttaaaggatcaacatttcacgcatcaacagttatacgtgaggtattgtgccacgtttgtgaaattaaagatgagtaagatcaggccctgtctccaaagagcgttttaatcagagagtcaggtgtgcaagctaatgattataaggtgcaataatgataaaagatgctgaacttactagccatacagagtaatgtaggtaaggagaaggggcctggggaagacagtatgagcacgggaggtgacttttttttttttttttttggagacagggggtcttgctctggtcgcccagcctggagttcagtggtgcaatctcagctcactgcaaactccacctcccaggttcaagcgattctcctgcagtctcccgagtacaggcgtcggccaccacactggctaatttttgtatttttagtagagacagggtttcactgtgttggtcaggctggtctcaaactcctgatctcaaatgatccccacgcctcgacctcccaaagtgtgagccactgcacctggcctgaaggtgacatttgaacagagccttgaagaatgctgtgtagaaagtttgacaggtggccaggcatagtgactcctgcgtgtaatcccagcactttgggagtccgaggtgagaggatagtttgaggccttgagtttgagaccagcctgggcagcacagtgagactccatctcttaaaaaaaaaaaaaaaaattagccaggcgtggtggcccatgcctgtggtcccagctgcttggggctgaggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgttgggaactgagtgatgtagactgcacagtggtgggaggaagggaagaggagagtttccaaaaatagttgggaccagactgggaaaggccttgaatgccttcccaaggagttaggaatttattccacacctggtgcccatgaaggaagcagattgcttcaaggttaagctcaggctttggagacagactctccaggtttggattcaggccctgtcacttatttgccatggggctgagttcacccagcctcagtttcttcgtctgtaaaataggagtgataatcacaggattgttgtggggtttcaatgagagaatgcgtgtaaaatgcttcgtacaattactgccacttatgtctcaataactgctggctttggtcattaataaaagagggaaacaatattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtcattgtagtacacctggctggctacacactcattagttatcctgactttctaggtgagtggcaggaaattgattctgtggcaatcttttatcactcaggaaggctacagatcctggtgtttacattctttcttttatgttgtagctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaacaagtgtgtgtgtatgtgtgtattttaattctgaaaatcttaaaatgctacaagaaagtccagagaacagtacaacaaacatcattgtattccagaactaacaaatgttaacatttgagatatttccctttcctctaaaaacaaaacaaaacaaaaccaacatcgctacatttaaagtcttttttgtgcccctctggtcccattcttccttctcctggggcaaacactaacctgtattttgcatgccctcttgtgtctaggcttcttttctgagcttaaaacttccaggaaactggagcttgggtttcagtgatgacttaagtgaggaggataacacttgtctttctaaataatagaagatgacatagcaaggcatgctatatcactagaaaagggggcattttctcatatgaagtttataagaaaacaaaaactgtaagatctctgccatttaaattgtggatttcaaggtttggaaggtcaaagaatttggaagctgcagctgttctgagagaccatcttgtgctctgtggagctttggtgattccactgaggtgacctgggggtgagagggaagagcttcaacacaccttccttcccccatccaaagtagctctgcttttgttttactgttgaatttcttgaataaaattcacttgttacagagggtgttttggctaacacctcccctcccccaaacactaccaataactagttcaactgctaatctagttcaaccatctcatttaatgaagaaactgaagcctgagttttttggtctacttgtagttttcttgattgaagaatgtttctatctttttttttttttttttgtacagtctcgctctgttgcccaggctggagggcagtggcgcaatcttggctcattgcaacctccacctcccgggttcaagcgattctcctgcctcagcctcctgagtagctggaattacaggcatccgccactacgcctggctaatttttgtatctttagtagagactgggtttcaccataatggccaggctggtctcaaactcctgacctcaggtgatccgcccgtctcagcctcccaaagtgctggaattacaaacgtgagctgctgtgcctggcctcatcatttttttaactatggttgttaaccaggtgtgtgcattagaatcacctggggaacttaaaaaaaaaaaaaaatacacctatctgggccctaccatagagattgtggttcagtaggtcggggtgggagatccagacacatagtagtcccttggtatctgtgggggtttggttccaggacacctgcagatatcagaatccacagttgctcaacttccttatataaaatggcatagtatttgcatataaccttagcacattgcataatatatacttgaaaacatctctagattacttatcatacctctagattactctagatatatctctagattacttatcatacctgatccaatgtaaatgctacataaatagttgttacactgtattgttttatttatatctttctttatttttttctgactgtttttgatccatagtttgttgaatccatggatgcagaacccatggataaggagggccgactgtattttaaatgtctctagtgattccgatgctccttccttggcccccactcctccccctgttgagaaacaagatttaaaactctgccttatgctgggatatcatgacctcagtagaatgttacacttcatcctatttcttcatcaggttctgcattagccaggcattttattttcagctactctagagcgtctttttttctgtcaggtgtttttttccagtataggaaagtagcccatttcctttaaagaccacccagcaggcatgatcccctgaggtgtttttttgttgagtgcttttgcatacttaaggagtaactgacctggcccggtggctcacgcctgtaatcccagcactttggaaagctgaggtgggcggatcacctggcggtcgggagttcgagaccagcctgaccaacatggagaaacccccgtctctactaaaaatacaaaattagtcgggcgtggtggcgggtgcctgtaatcccagctactcgggaggctgaggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctagcacaccctgcccattggcctggcatcatggaaaggtgcctggtctattttatggaggcaatcataaaactgggtgtggtgatttttgttgttgtttaaggctttgattttaaaaaatcaaggttggaagcacctatttagattgtaaactagagaggacaaaggaaagaagcctgggaatgttatggtgagaaaagaggactagaatccctgtcagccacctatgtggctgctgccacccctaaaaagtgttgtgagtgcaccaaggacaaatggcatgctcttcgttattagtgagctattaacctcttccagttctttctcctaccttggtgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtgggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggctaaggagcggggttttttttgtttttttgtttttttttgaaacggagtctcgctctgtcgcccgggccagagtgcaatgacgctatctcggctcactgcaagctccgcctcccaggttaacgccattctcctggctcagcctcccgagtagctgggactacaggcgcccaccaccacgcctggctaattttttgtatttttagtagagacggggtttcaccgtgttagccaggatagtcttgatctcctgacctcgtgatccgcccgccttggcctcccacagtgctgggattacaggcgtgagccactgcgcccggccggctaaagagcagttgtataggagcaatgaataccgtttcactcagttgaaggaggtaacatttaaatatgtgaggtatgttcagtgcttaggtcttggacaggaggaagtaacagatcagaataaggttcaggtgaaaagaaccaagaagagaacgtgtcaggcaggacagaacagggaattctgcaagtgagaagaaagtacgattagtactggaaatggaagaaaattcagctaggttaaaggtcacaggaagaaagttaattccagcattctctgagtttcagacaattcctggtgtgcgctttcaagtctgtcatgggccacctttctgctgctgagtgcccgtaccctagctcaaggaatagggcacacccctcttgtagaagggaaggtaggaacgctggctggttggagactgtcagcaactccacggtgataagtcgagcttagcactaagtagaagtatgtcactttctgtaatttagaggaattgaaaaggtatcttggaaagaaattagttcttgggaacaaagtcttttttgtgcatatgtctttactgttggcatagagcattttctgggatgggctcttcagatctcctctccctgtaagtgatttcagaattccatgaatgttgggatatgtccaggctggcaccctgggatcatgaaaatagaagttaagacatttaagaagcaagaaaacaaaatgggtaggtgaggtgactaggaagaatatcatgcccagcacttctagaattctcaaaatgaggagcatcacttaaattttgagggggatcatttttaggatggtgacccaagctctctttgtacagatgagaagtctagttatctcatgagacccagtgtgactaaaggaccatagcatgtagctgcgtaatggcacggtggcactaggagctgatccattcatttatttataattaccaaggggaagtatggggtgagatttattcttaactcttaaaatggtgacatacactattttaagaataaacctccattcttttttcggatattaatttagtgcaacggccttggacaggctccaccataagaagtgggttgcatttaaaagtgtatttattaaaagtggttgaagctgagtgcttttctgtattgtaacactgttgcaaatggggagtattcattcctaatgtggctgccgaaagctttttaccctaccatgtagctgaaaatttagcaaaaaaaattttttttttttttggagacggagtctcgctctgttgcccaggctggagtgcagtggtgcgatctgggctcaccacaacctctgcctcccgggttcaaacgattctccttcctcaccctcccgagtagctgggattacaggtgcccactgccatgcctggctaatttttgtatttttagtagagatggggtttgaccatgttggccaggctggtctccaactcctgacctcaagtgatccacccgcctcggcccccgcaaagtgctgggattataggcgtgagccactgcacccagcctagcaaaatttaaaattaagaaatgtaaagagttgaactagttagtacccattattattaagaaaagtcatgtggctctatattctcatagtacgaataattaagtaaaatagaaattcaaaagtatgaataaaatttctttgaaaatcttgaatgttgagatatcttgccacagtgaaaagaatcagactttctgttttggcaggtgtgagttctgattctggttttgcaagttgcttaacgtcagggagtgagcccaaatttgtcctttgcagaatgggaacgctatgcatcttacagagctgctgtgatggttaattgcttggcacagtgaaatacagtaggcactcaacaaacttttttttttttttttttttttttgagacggagtcttgctctgtcgcccaggctggagtgcagtggtacaatcttggctcactgcaacctccgcctcccaggttctcaccattctcctgcctcagcctcccgagtagctgggactacaggcgcctgccaccacacctggctaattttttacatttttagtagagatggggtttcactgtgttagccaggatggtctcgatctcctgacctcgtgatccacctgcctcggcctcccaaagtgctgggattacaggcgtgagccaccacgcccggcctgaactcaataaacttttatccaagcacctggataaaggatatcctgaattttttcttttctttttttttttcttttttttttttgagatggagtctcactcttgttgcccaggctggagtgcagtggcactatgttggctcactgtaacctctgccttctgggttcaagcgattctcctgcctcagcctcccaagtagctgggattacaggtgcctaccaccatacccagctaatttttgtattttttagtggagacgggggtttcaccatgttggccaggctggtctcaaactcctgacctcaggtgatccacccgccttggcctcctacagtgctgggattacagacatgagccactgtgcccggcctcctgaattttcacattaaatctgcaaaaggaaaagcagatttaatgtgaagatgacaggaattttctgggcactttcaaggtcctaaggttggtagccctagttttttcacttcagaccttagcttttatctgaaggaaaacaccagaaacagaagatacttctagggagtggaatgggggtagagggtgtgagatttcctttttacttaatactgtactatatatttaaaatgctttttacagtgataattttataataaaggaaaagaagggattaagtaaaaggaaaaactgtgtatataatttttagatataatcacaaattcagatttttaagttactacacagatgttcctcgatttaggagggggttatatcccaatattgtaagtcaaaatgcatttaatacacctaacctactgagtatcatagcccagtccaccttaattgtgctgagaatactgatgttagcttacagttggacaaaattatctagcacaaagcctatattacaataaagtattaagtatcttggctgggcgcggtggctcacacctgtaatctcagcactttgggaggccaaggcaggtggatcacttgatgccaggagttcgagactagcctggccaacatggtgaaacctcatctgtactaaaaatacaaaaaacattagttgggtatggtggcgtgtgcttgtaatcccagctactctggaagctgaggcacaagaatcactggaactgggaggtggaggttgcagtgagctgagatcacgccactgtactgcagcctgggtgatagaaccagacattgtctcaaaaaaaaaaaaaaaaaaaaagtgaatataggaaatcttccttgaaaaaacaaagatactcctacctcagcttctcaagtacctgggactataggcccacttcacctcacctaactaattaaaaaaaatttttttttttgtagagatggggtttctctatgttgccaggctggtcttcatctcctggggctcaggctatccttcgctaaagtgctgggatacaggcgtgagcagccacacctggcctgtattgtcttaatttactattttcagtggccatctaatgttcataatttatttaggtttattcctgtttaaagttctattgctttgattgctggagagtttaaacattttcttacatatttgtttatcagtattattttcttatgcaaattttctgtttttgttatgtgcctggcttctagggtcatgatgttaacttttgtgagctcttttataacatggacttgactttctctcgtatttgctacaaacattttcccttgatgtttcattgtatttgttttcttcattgtagttttaaattttattgagtttaaatgtcagtctttcgatttgtaatttcttctatcaactcgaagtctagatagtttaatttctctaaaaccttgccaaaattttcagtttaataatcgattggcttactttttatatatttgtagagatggggtcttgtaatgttgattgtaaggggaacttatcccgaacttctggccttaggtgatcctcctgcctcagcctcccaaagtgatggaattacaggcctctaatatcctttaaaaaccagctgtttattacctattagcaattcatgtctgttttgtcaaatattatgtatatatatatttctagttctggacttttaaattatggtgaaccatatttcatttttttgagaaaaatatatatgactttgttatacttcttatcattgagaaacaacatctgaagctagcttaattttaactctatgacaagtaacttgatttttttttccttttttcgtgacttgaaatttgtagaattgttgttccttgaggtataaacatttccccagttaacatgttagggttgctattggcttagcaattttgcctgcaatgtggagactcttcttggtttataatgtctcttgtttgtttattttagctttaggaaattgtccattatgcctgtggtgattagttagatctgtgtagtctattttatggctcttcttcattttgtttacgttaaataagcgttctaggtatgtgtctcacatacatcttttgttgcactgacttgattttctacagtcttgatattttttccttggttctgttaatggtagttgctttgtcctattgtagtttatatttttaattaattccttttccgtctccattcttgttaatagcttaaatgatctctttttagttcatgaagaagagtgtggcacaaaagatcctttcaaggtgaaaaaaaggagcaggtagccaagatagttgggttacatagtttaccacttccctttataatccgtaggtgttgaaatagatgtggccatgaaaaaccagtgttaatcgggcagctgagtgtatggattgtccaccagtcaaggttggggaaaaaatctggctgggctaagtgtggcccgttagtttgacctcatttggcatgtatttcttctggtcttacaggtcagagcaactgtttttatatattttaatgtccctaatgacaaaatagtaaaaatacatttgaggacccaagttggcatgttctaggaatttcattttccggcttagtgtggtgacctgcctctgattgctgtacaattccttctgcttcacagtgtcacatctggggataccagttggtagtggaacctgttttggacatttttaagccttgtggtatctgatggactcttggttgtttctagctggtgctaaataaaccccttgacaagaagtatttgtgtaagaaagcgctggtaggcaaagtgagaacatccggaagtgattcatattactgtggttgtttgcttaactcaggacttggttgcctagagaccatatcgttgagttagccgagtgaagtgccagtggaacctggagggcctgtggcctaccggatcaaatcagggctctgctccttaatttttctcctgaagtctcctagcaatctgattgatctctgtggtttgacagtgcgtgaattaaaaaaatcttaaacatattaatgtttaagaaagatctggttaatggtttattttgaagagtaagagtttacttgctgaagtttgaatgttgggttaaaattttttaaaaaaatagttgtatgttgggaagaattagttatttcaataaggcattttattctagaaacctcagtactttaaggcagctaaaggaaagccaaaataatcccccaaaacaaaaaaccaaaaacctgcaatttgcaaggcagtcataatctaaaatattttctgtctgtcccaaagtcagtgtattccccttgcctctccccctcttcctcattgtcatgattagtaccgtttattgcatactttctacatgcaaggcactgtgctaagcactttatatgctttatctaattagctattcttgaagccctgtgaggtgcttattatctacatttaacagataagaaagcaaagctcagagaggttaactcattcatctaataagtggttgatccagatttcaggtttggcaagaactctgaagtcctttctcttaactgccatgttagtctgctgctgctatacttctggttctaaaaataatgacaacagtagtaactactgttaattaagcagaatgatgatgaaatttacatattacattattgtgagataggcattatttttattttaaagagggaaaaaaatagagttgataacacttttcccaaggtcatatattggaattcaagcccaggtttgtgacaccaaagctggtgctcttaacttctgcagatgctgaagtggcaacatttaagtctaacctctttaactggtgcccagagacattaagtaacttgtgtagttttcaagtcagtgagggaactccatcaatttcctgccacttattttggagtctcttccacctgccacctgagggaaagtctccagttgtcttatgtatttttgtgtctaactagcttgttggacccttcctaattgcttcccttcttcataacctggtatctgctttgaattcagcttagaaaggtgttccttcctaccactttcttgtttgttaaagagttacctcatacagacaggagtggcaaattggattggaaattgctttggatcatttggcaagaactgtatttttggggttgtgggaggaggagaggcctgtctaaaagctctatttcttctttactcagaataccttcctgttgactcattggaaatcataacaaaaagcagaaggaatattggagaggcagctgccagcctagggcttggcttctgttggggcagctgtttggggatttagacacactgggctctaagaactgtgaggtttctgcagcagaaggaaatagtattactctgataggtatttattcataaggttaaaaagtgtcagactattgcttgggattattgatgagcaacataagaaactaaaaatattttctcaaatagaattaactggtgatcctaaaaacagaatgaattgaggaatacaagagggagtgggggcaaaattagaaaaggaaaagttgaaaagaagagaaaaaaaacttacaatcattaaaaataggaaaaagataacatttaaatagaaaaagtctcacagatatgcatgcagtaggcattaatcagcaggtcattttactgtaagtaacatacatctcagatgacctttaaaacagctaaaagtaaacaaaatttgtcttttatttaaatgactattataacaaaatgtttttttgggctgggccctgtgattcacaccagtaatcccaacacttacggaggccgaggagggaggatagcatcaggccaggagttcatgaccagcctgggcaacatattaagaccctgtctctacaaaatataagaaataaaaaaaagccaaacgtggtggcacacacctgtagttccagctactcgggaggctgaggtggaaggatcacttgagcccaagagttcgaggctgcagtgagctacgatcacactgctgcacaaaaatgtgtttcttccctgaagacatgctatgtcattagtttgggcaataccttttcataattgatagtttaaaaaggtagtgtttgacaatggcttgacttttggggttttccttaaaaatttgagaatccccataggaatgttttttagatagatttggtcttaatttaaaatttttaaatttaaaacatttttttcttagaaataggtaatacacagacgtgatacataattcagagactatgcaagtatataacactgaaaaaaagtctatatccttagtcttctttctctagctattcagttattttccccacatggaactgctatcatgattgtgtctctttccggagatattctgtgcatgtaaatacaaattactttgatttgtttagaagtggttgcacactgtacattttgctttacatctttttgttgttgttttttgagatggagtcttgctctgttgcccaggctggagtgcagtggtgtgatctcggctcattacaacctccacctccagggttcaagcgattgtcccgcctcagcctcccaagtagatgggactacaggcaatccgccatcaggcctggctaatttttgtatttttagtagagacagggtttcaccatgttggccaggctggtcttgaactcctgaccttaggttatctgcccgccttggcctccctaagtgttgggcttacagacatgagccaccgttttgctttgcatcttaaaattcattccatatgagtgaatgtggaatgaagtgcctctttttttccttcacagttttagttttcggttttgaagttaacctgtcaacggacattttctcctcagcttttgctgttataaaaagtcactttgtaggtatgccattgtgcatgtatgagtattcttgcaggataaatttctaaaagtgtaatttctgggtcaaagggaatatgcatatttagttctcaaaaatattgccaatttgctctcgtaagaggttgtaccagtttgcacatctgcctgtcaataatgtacatataagaaggctgtttccgctttaattttaccaacccagagtattacagattttttacatttgccagtttcataggtgaaaatggtatttcattgtagctattttggattatctaattatgagtgaagatgagcatctttacatgtgtttaaaagccatttgtatgttcttttctgtgaactttttcggtagaatcctttgctcatttttctattggattattcatctttttcttattcattgtggtaagagctctttatatattgaggaaattggctcgttgtacaccgtgggtgttataaatattcattccactttgtcctttaattttttttttttgagaaagtctcattctgttgcccagcctggcgtgcagtggcccgatcttggccaggttcaagcgattcttgtgcctcatcctcccgaggaactgggattacaggcgcgtatcaccacactcagctaatttttgtatttttttagtagagacagggttttgccatgttggccaggctggtcttgaactcctgatctcgggtgatccacctgcctcgacctcccaaagtgctgggattacagccaagagccacctcacctggccattgtcctttaaattttgactttgtatttcaaataaagttttaaaacatatttgaacttactaatattttacttttagtttttgaattttttgcatgatttttaaagagtcttatctatactgagattatataaaaacattctcccatgttttcctctagtatgtttaggatgtaaagtgttttaatatttaactctttgatccatttggaatttattttggtgtgaggagtaagatagatcctgcttttttgacttttgaatcgtattttacattttgagtcttagcagtgtcttaggaaatgtgctctggagggtgtcttgtgctctagtttatgaactgatatcttaatttttttcagaacaaggcagcttcaactgttgagctttttgaaacatatggcttaactatcattttagggaatttggttaggattttccagagtgctttcaagcaagttatattgtaatgctaaacagattaatatcgtgtagtaaagttggcgttgagaaaacaggttttgaattaacagctttgacataaagactgtgaagagattactagacttgccaaactaacataatttattctttgtgtaaaggagagtgcaaatttggagtttgaaaaactgtgtggctgactttctagatcagtattttttgaggtatattgtgctgtgacattaaagaaagggtttagtggtgaaataagcttcagaaatactgagttaaaccaagccaaatattattcaagtggcaaattatttggaatctttgtcatagacttgtaaattctgagtctccaaggcaaaggatagtgtatgcaatattcctcaaacctactttatcaatagtgttccaggttttttttttttttctggtttgcgaacacttttttttctatcagttacggatttgagggactattttttctttcttttactttattttttatttttggactctaagactttcttcagagactatttcaaataagaatttgggagatgttcatggtcacttctcagctattttgtgttttatgatagttagtttacattctccgttgagttatcctgttcttggcttatagagcttaaattaaagccataattgtactaattggataggtataattgctcagtgatctttaaggcattgcaaaggacgggagtgtggtttttaaaaatgaggggtgcaaatgtactaattattaaaaaggaaaagataaatatgacaaattctggtctagtaaactagtttctggccaaacattggaccagaaaaattccagagcacattgtcagatgcataacttatgaacacttagcgagaaaagtgatgcttgggagccaacatgggctccctaaaaaaagccctgtcacattaacatcatttccttttggacagggtcaccagattggtgaatcagagaaaaacacacgcctggcaattttttgtatttttagtagagacggggtttcaccgtgttaaccaggatagtcttgatctcctgacctggtgatccacccgcctcagcctcccagtgctgggattagaggcgtgagccaccgtgcccggccggggtttgtttttggttgatgaaagtgttctggaattagatagtgatgacggttgtacaacattgtgaatattctaaaagcaactgaattgtatattttaaatgagtttacgttacgaatcgtatctcagcaaaaagagctgcagatttttagttcagagaaagcacttttagggcatgttatttgtaaacatttttattgggacttactagggcgtcagtgatgtgtcagtgaagttaggattttacttgtttctagagagatagttaatatattgtaaggcacattttgctttcaatgtaccgtgaatctaataatgaaattcaatagtaataagtgtgatgtcctacattggagttcaaaaagtgtataggataagggagagaagtagcgttagtgggaataacgttggtgggaaacgaaaacaaaatgaaagaaacctgagaagttcattaactcattagtagatatatggtatatgcagccaaggaaaagatggttccactgtcctctggactaatcagaggcttcctgaaattggtgtttagttctggaggccatactttaagatggatctcgtagtctagagcaaggatgttagatttgtggtaggttattttacacccacagcaagcactgctgatagatcagaatccttttcaacgtagaagctgaggaaccactcccaatcagtgggtgttggttgtccattagttgagacttagttgttgctctgggatgagagcgtgttcgatgagtatgaccaggatgataaagggtctaccaattatgatctatgaagaataattgggaatactgaggctatataaaatggaaacaagatttagaagaaatataaaatcagaatctcagaagctcaacctttcatctagtttaggaattcagtcaactgttatattaacattttacctactttactaaaaaattcctgagagatgggaggggagttcattttgtcagatgtggtgccaggggaacagaactagacaatggaaatctgcttaataggaggatagtttcttatataacaataagaaatttccaaacggtgtctgagctgctttgggaaaacccgtgttgcagattttcaggtttagactgtgtaacagtttaatggaagattgttatgttctaacctaagtattttctcgttatttaaaaacaatttttatttcatttcctgtgttattaaaaactatttttattttgaatgacttgatactattccattgctcattttttctaacatggctaagaagttgggaaaattcctccaataaaataattactttaaagcaagtaaaacacgtttttagctcctccattgttcaggacactctgggagaactgaagaagatgcgaaagtataaaacagtcctgcccttaggagcttacggattaattgaagacagggcataaacatttgaaaagttacccaacatcagagaatgagaggtctcagtgtcacaaggcaatatgtaattgctgaggaaatgatgcaaatagttaatgtgtgagagtttagacagggaaagattattttatggctgggtttttcaggataagctgacattgtatggtcaggcgtttccctttcaagggaaagcataacactatgtatacttgtcttgttctctgtgctcctttagagttgaagctctttccacttcctggtacccaatggcacctctcaccacagtgctttttacaaagtaggtgcttggggatattgttaagttgaatgagtacagagttgtgtggtatgtgggggttgtggtaggaaaaagaatttcagtgttatggtgataagagcttggggtaattttctgttttggtttttgtttttcttttattatttggttataattgagaccaggagtaatacggtccctaagcaagagagaaagagcagtgtgtgtctttcagtagagtctttctaatttattcaaagataaattagaaaaggattctacccttatgtacataaataactattaggcgataaagagatataaagtgccataagaaagtttagaggaagtttggaacgagaagagattatttctgatggtaggtcatgaaaaggttcgtggaggagaggtgacttttgaaggtaacatttgaattggcagggatgggtggggctgatcacctaaaagttatactaaaccttgtattctttgtgggcatccctgtctctaccttcctgcatcgtggcttgatgacatctattttctctcaaaacttcttcacattttggccctaacaaatttaccccatctcatttaacatgctatcacttaaaaaattaattaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacgtatttttctcctaacacttaaccttctatgtgtgatctagatcctatcccttcttgtcttctagggttcttattccaatattattttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttcaagcgattctcctgcctcagcctcctgagtagctgagattatgggtgcccgccacaacagccagctaatttttgtatttttagtagagatggggtcttaccatgttggccaggctggtctcgaactcctgacctcaaatgatccacccgccttggcctcccaaagtgctgggattacagacgtgagccactgcgccaggccttaatttttacatttttttgtagaaacgggtttcactgggttgcccagcctggcctcgaacttacgaactcaagtgttctactcaccttggcttcccaaaatgctgggattgcaagtgtgagccactgtgccctgcccctatattcacttccttaacttaactcatttggatgtaattcctgtgccttccttttccccattgaaatttctcttgcttagttccaccaacagtgtaaaagtgttcctatttctccacatcctctccagcacctgttgtttcctgactttttaatgagcgacattctaactggtgtgagatggcatctcattgtggttttgatttgcatttctctgatgaccagtgatgatgagcattttttcatgtgtctgttggctgcataaatgtcttcttttgagaagtgtctgttcatatcctttgcccactttttgatagggttgtttgtttttttcttgtaaatttatttgagttctttgtaggttctggatattagccctttgtcagatgagcagattgcaaaaattttctcccattctgtaggttgcctgttcactgtgatggtagtttcttttgctgtgcagaagctctagtttaattagatcccatttctcaattttggcttttgttgccgttgcttttggtgttttagacatgaagtccttgcccatgcctatgtcctgaatggtatttcctagttcaaccattgtggaagacagtgtggcaattcctcaaggatctagaactagaaataccatttgacccagccatcccattactgggtatgtacccaaaggattataaatcatgctgctataaagacacatgcgcacgtatgtttactgcggcactattcatgatagcaaacacttggaaccaacccaaatgtccatcagtgatagactggattaagaaaatgtggcacatatacaccatggaatactatgaagccataaaaaaggatgagttcatgtcctttgtagggacatggatgaagctggaaactatcattctcagcaaactatcacaaggacagaaaaccaaacaccgcatgttctcactcataggtgggaattgaacaatgaaaacacatggacacagggtggggaacatcacacactggggcctgttgtggggtagggggaggggagaggggggagggacagcattaggagatatacctaatgctaaatgatgagttaatgggtgcagcacaccaacatggcacgtgtatacatatgtaacaaacctgcatgttgtgcacatgtaccctagaacttaaagtataataaaaaaaaaaaaaaagaaaaaacattcccaagatcccctcaaaaaaaagaaaaagaaaaagaaatttctcttgctcatatcaccaatggcctaattgctatgtcccatggaaatttttctagtacttaatctctgcagcatatgtcactctttcctgttcaattcatggagttttcttccttttaattgggtatcttttttatgctttttgaatttcgaactgtgtattgaagtattgacctgtgtaaaaaatatattgcctatctaagaaaatcagttagcattcctctgggaaactcacttggccatccatccttaccccaggtctaagttagatgttcctctctcatgtatctttattataacttttctctttcctaatgcactgttagccttagaaggcaagtactacgttctttctttctttcttttcttttcttttctttttttttggagacagggtctcactctgttacccaggctggaatgcagtggtgtgatctgggctcactgcagccacaacacccccaggctcagatgatcctccttgtctcagcctcccaaagtgctgggattataggcgtgagccacctcacctggcagtactgtgttcttaatgtatatcatagttaacccccactcccttattttcttactaaataataggtgtgaaaattaaatttttgacatatatggctctagcagaggattgcttttacagagaaataggtgcctgtcttctactttgtagaggactcttacctgttgttttcttctcaagagctgctcacaggttagtaatgattaggctgtagagctgctcacaggttagtaatgattaagctgtagcttctgagacttagctatcatctagatttaactcagttttggaatttcatttcatttcatttaagattaaaaggtctttcatgctccatggtaagtggtaaactagggatggatggatagatagacagctgaccatggtaatgtttcaccagactctggatctgaagacttgatcaaggagtaagtaatctattagccgagacttaaacaaacgaaaaactttattggagtttaatacacatcccacaaaatccacctgtttttttaatgtacaattcaataatatttagtaaatttgctgagttgtgcaacccatcactatgatctagtttccatttctccaataagaccagggactctattaaaataaaacaattagacatgtaattttgacaagtagacttgacctattctatctgattatgctaagaatgaagtgatttgctcaggggtctgtattagatataaatacacacagaagttaaatatataacttgaagcaaaaacatttccctgtttttcacttattcctatagcttttcagattggcctaatttatactcaggtttcctttaaaacagatactatcaagatttctcattttgcttgtatggtttgaaaaacaagccttttttgttccttggctggattactgcaatactttctttagtgtctcctcacttctctctagccctttctcctacaactgctcagaatggtcttttgaattaaatcttattctttaattcctgtgtaaatccttccaagggtctgcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttccttagggtatttatggaacttaaagcaggagcttaagggtagtttggaccatattagccaataggtcatgataaatgattacatttttagacgtaatgtcagcaagggttgcacagggagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaaaaaaataaaaagacactttcccaggacatgtcaccatctcagactaactccttctccgttccccctagtttttcctcttcctttcttacacttctagaaaaagaagttggctgggtgcagtgactcatgcctgtaatcccagtactttgggagatggagaagggggcggggagggagttgggggttggaagtcaagaatctcttgagttcaggagttccataccagcctggacaacatagtgaaaccttgtctccattataaaaaaagtaataataataaaataaaaattagaaaaagaagcctacatttgctgcctctccttcctacttttagttacttttctagttattttaaatggactcctgtgtcaccactccactaagactccccttacaggagccaaagatgaccttgcttgtgtgccacattcttttctcttcaccacccgcctctctgcagcattgaaagctggtgacctctaccagtttgctgattttttccttccgtgattgccattgtgtgattctctcctggttcttaacttgatcacagacgctatctttgtctctttcacctcttaagtgttggtgttctctgaggcacagtgcttcagcttttacatttttctccacagcctctttctctgtgggcttatctactcttgtggtgccattttccagatttaggtcttcagcaacaggtctccctcctgagacctgtgtttccaactgcctacaagatgccactgtctggacgtcccgttgacatttcaagctgaacatgtttcaaccgtgaattgctcatcctctccggcttttgtgggtgtccccattcttgtttaatggcatcatcttttatgtagtcatccatgccgcaagtcaccaaatcatcttttaaaaaataagaaaaaaaccttctcttttcgttttatagaagtgtttgtaagtttgctgtagatggtatatggtgccggattttctcctagaattgtgtgtcagaatgtggggcttctcgacacactggacaacaatgttattttaaaaaatctttgctagtctgatagctgaagatggtgatattgttactttactttgtatttctttggttagtagtaagattgagaaattttcttataaattactggctatatgtatattttatgaatttttaaatttgtgtttctagcatatttttctagggaaatgtttgccattttatttcaagtgtttaaaatgtatatacatgtaaagattatggaatattgttagctctttgttatatgttgtgattttttttcctccagtaacctttcctgttaaagttttatttagttttttaaaaatggccttacagaagtttaaatactagccaatttatcttttcctttctgatttctgcttctgtagtagtgtttgtaaacttctttctcattttaagagtatataactattttttcttttttaaaaaattctctaatccatttggtgtttaatgttagttgtgaaccgtgaggtctggagctaactgcttccccaccctccatgccccctgccttttcagtcatctgtgagatttcacatctttcccactgcccttctaatccccgtgcctcatctaacagattgtcaaatggggtcaattctacctttgtaattgttaatcattctctttccaccattgtcccagttaaagactgtattaccactcacctggattaccgaaatgtttgcctgatatttctcccttgaatctgtcgtccatgctgctgtccaagttctccttctaagtctacttgaaaacctcccatggctcccattcctgcaggttagattactaatccagatacttttacacctacttctctaccacagtgacttaccgttccctgaatgtgccatttgttttcagcctttttttttgtcctttgtattatgctgttccttttttgttttttaatttttttatttattatactttaagttccagggtacatgtgcacaacgtgcaggtttgttacataatgtatacaggtgccatgttgatgtgctgcacccattaactcgtcatttacattaggtatgtctcctaatgctatccctcccgcctccccctaccccacaacaggccccagtgtgtgatgttcccatgtccctacaaaggacatgaactcatccttttttatggcttcatagtattccatggtgtatatgtgccacattttcttaatccattctatcattgatggacatttgggttggttccaagtctttgctattgtgaatggtgctgcagtaaacatacgtgcgcatgtgtctttatagcagcatgatttataatcctttgggtacatacccagtaatgggatggctgggtcaaatggtatttctagttctagatccttgaggaactgccacactgtcttccccaatggttgaagcagtttacagtccctccagcagtgtaaaagtgttcctatttctccacatcctctccagcacctgttgtttcctgactttttttttttttttttgagacggagtcttgctctgttgcccaggctggagtgcagtggcacaatcttggctcactgcaggcttcacctcccgtgttcacgccattctcctgcctcagcctcccgagtagctgggattacaggtgcccgccaccacgcccagctaattttttgtatttttagtagagatgggagttctccgtgttagccaggatggtctcgatctcctgacctcatgatccacctgccttggcctcccaaagtgctgggattacagacgtgagccgctgtgcccagcctgtttcttaactttttaatgatcactattctaactggtgtgagatggtatctcgttgtggttttgatttgcatttctctgatggccagtgatgaccattttttcatgtgtctgttggctgcataaatgtcttcttttgcaaagtgtctgttcatatccttcccctactttgtgatggggttgtttgtttcttttaaatttgtttgagttctttgtagattctggatattagccctttgtcagataagtatattgcaaaaattttctcccattctgtaggttgcctgttcactctgatggtagtttcttttgctgtgcagaagctctttcgtttaattagatcccatttgtcaattttggcttttgttgccattgcttttggtgtttcagacatgaagtccttgcccatgtctatgtcctgaatggtattgcctaggttttcttctagggtttttatggttttaggtctaacatttaagtctttaatccatctcgaattaatttttgtataacgtgtaaggaagggatccagtttcagctttctacatatggctagccagttttcccagcaccatttattaaatagggaatcgtttccccatttcttgttttggtcaggtttgtcaaagatcagatggttgtggatatgtggtattatttctgagggctctgttctgttccattggtctatatctctgttttggtaccagtaccataccatgctgttttggttattgtagccttgtagtatagtttgaagtcaggtagcatgatgcttccagctttgttcttttggcttaggattgtcttggcaatgcgggctctttttgggttccatatgaactttaaagtagttttttccaattctgtgaagaaagtcattggtagcttgatggggatggcattaaatctataaattaccttgctcagtatggccattttcacgatattgattcttcctatccatgagcatggaatgttcttccatttgtttgtatcctcttttatttcattgagcagtggtttgtagttctccttgaagaggtccttcacatcccttgtaagttggattcctaagtatttttatgctgttcctttatgttacatgtctccttttcccatttttcactattggaaatagaatttatttgagcaaagcctagttcagatatcatctcctattgtagctagctgttaaagcataactgttaccagagagtaattcccttgaaggtgctgactggtattcagcacaacgttataccactgataagtgttccacacagtagtcagttcgaaatgtttcctgaatgaatacgtgggtgtcagaatagacacctttttttttttgaggaattgacttaaaatacttaggaaaaaaactttaaaaaatagaataaatatgaaaaggtataagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatcccaggaggttgaggccacagtgagccgtgtgattgggccactgaactccagactgggtggcagagcgagacactgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaactgttgttattgttgaaggaggaagtatcctgtagcaattaagagtatcagcttcatactggttcgtggctcacgcctgtaatcccagcactttgggagggtaaggcaggtggatggcttgagcccaggagtttggaccaccctgggtaacatggtgaaaccctttctctacaaaaaaaggcaaaaattagccgggtgttgtggcacatgcttgtgaccccagcttcttgagaggctaggtaggaggatccagaggatcgcttgaaccctgaaagtcaaggctgcagtgagccatgatcacaccactacatagactctgtctcaaaaaagaaaaaaaaaaaaaaaagccagagtatgggcttcagaatcacaccaacttgggttcaagtgagagtttacttgccagataatcttggaatatactttttggaacccacagtttatctgtaaaataattacaataatacttcagaggttgttgcaaagattgagataataatgcatgtaaagtatttggcttcatgtctgccacatggtgtgaagattattttttaagtgtcatttatattgaaaatgagtcattctatgttacttctttcctgtttagtacttgtgtttcagatctgacatcacctttttaaaaattttgcatttgagtgagatttgctaaagcagttctggggttaaacttgaagagaaaatattgaatatttatatttaatatcccatgtgagaggagagattaagaaccctgttgtctgcttgttacatctcttgtgaaaaacataaaaaatataagagttttgttactgaactctacttgtggttttggtcgagtctatcatgaaggtatgttgtggagattagtgcaaataatgatttaaatatggaattataaagtttagcagctctatattcggggaaaaacgagtctctgttgattgaaaaagcataataaaataatttattctgaggctttgtggttatgcagtgtcagaatgaaaaagatgatactcctgttccatttcaggctggtcagaccatacctggaacacagtgttcagttggagaaagttcagagatgagcaaaagacgtgagggggcagagatgatgtctaacactgctaatataatacctggtaacgttttgagtacttactctgtgccaggcactgttcttagtattttatatgtactatcatctctttaatcctcataaacattctgtgggtaggtgctattattattctgtttttatgactagtgcttgaaggagctggaatcattttacttatggaattgtcagcatgtgactcatcatgaggggataggaggaaaggcacaaatatttttttcaatacccagccaagcactgtgctagctctatttcacttgcaatcttatttaatcctcaatgacaaaccttggaagatcctgttagccttttttaacaaatgaaagaactggtcaagtggcttgctgtctttctcggtaagtgcgagagacaggacatggaaccagatctttccaagtccatggccagtgctactcacattatgcttttatttttacgttctcttgctccaggaggcagcttagggtgccagtagagaattgatgccggcttagcaaaaaccttctgactactggagtccagaaatgaactaggttaccttgaatgtttgattctctgtcagtattcaggctcagcctgcttcctgatttggctgagatgttttgggaacatcaaattggggatggagtagaacatgtgaggggagtggaggaattgagatgggctgaaagatctttaatgagccttccatccttgagattctatgattattgctaggacagggttaaatatgagaattggtgaaaagttgtgttggccagtgatttttcttttgtgcatagattgattgattttgagacaagagtttcactgtcgcccaggctgggaatgcagtggtatgatcactgctcactgcatcctcaaactctcagactcaggcaaccctcccacctcagccatagttttatttttaaatgtctttataggccgggcacagtggctcacgcctataatcccagcactttgggaggccaaggtgggcggatcacttgaggtcaggagttcaaggccagcccggccaacatggcgaaaccccgtctctactaagatgtacaaaaactagccgggtgtgctgatcccagctacccagaggagacgggagaattgcttgaacccggaagccagaggttgcaatgagctgagatcgtgccattgcactctagcctgggcgacaaagcgagactccatctcaaagaaaaattttttttaataaagtcttcataaagctaaatttataaaaaagctagaggctgggcgtggtggctcatgcctataatcccagcactttgggaggccgaggctggtggatcacctgaggtcaggagttcaggaccaacctggccaacatggtgaaaccccatctctactaaaaatataaaaattagccggttgtggtggcacaagcctgtaatcccagccacttgggaggctgaggcaggagaattgcttgaacttgggagacggaggttgcagtgagctgacatcatgccactgcacttcagcctgggcaacagagcgagactccgtttcaaaaaaaaaaaaaaagctagagatatggtttagcagctctatatttggggaaaaaaggagtctctgttgattgaaaaagtgtaataaaataatttaagctgaggctttgtggttatggagtgtcataatgaagaaggtgatagtcctgttccatttcaggctggtcagaccatacttggaacacagtattcagtaggagaatgaattcagccaggtttgtttgtttgtcttttaagacagagacttgctctgctgttgcccaggctggagtgcagtgatgcaatctcagctcatgcctcagttttccaagtagtggctgggattgcaggcatactccaccacacttggctaatttttgtattttttgtagagacggggtctcaccctgttggccaggtttttctccaattcctgacctcaagtgatccacccgcgttggcctcccaaagtgctgggattacaggcgtgaaccactgcaccggttctaaatatttaagttttataagaaaggttttgtgtctaagttgagaatcactggtggatttagttaagctaaaatacctttaattattaaaaagtaggcagaatgtggagagataccagcctttttccttcttggtatttctgcgatttttccctttttagacagcctgtggagctcaaccccttttggcttttcaggtgatatagtgagagcaagagtgatactgtgaggaggattctaaacctagcaatcagtcttgttattccatctttgccactagctattggatgaccttggatcagcctcattcttatttgtaaatgggaggaagtgcaaatagattattagcctctgagcaggcttgtggccagttagattctttttcaatgtttatatttttaattttggagttgtacttctaaggacctttactaaggaattaattctaaataaagaagaacaccgtgcacaaagatattccttgcactattatttaatggttgaaaacatttagaaatgacataaatgtctaagataggtgacttattaaggacttggttaaatttttatgtaaacttaaagtcttcagaaactatataataacatggaaaatataaacatttcagaaatgtttaataattgtctcattcatatatatatatatatgtatatatatatatgtatatgtatatatatatatgtatatatatatatatatataatttttgagacagagtttgtatatataatttttgagacagagttttgctctgttgcccaggttggagtatggtggcacgatcataactcactgcagccttgacctcctgggctcaaacggtcctcctgctgcagcctctcaagtagctaggactacaggcatgtgccaccacgcctggctaatttttaaattttttgtagagacagggtctggctgtgttgccaggctggtcctgaactcttgggctcaagcaatcctcctgccttggcctcccaaagtgctgggattacaggcgtgagctactgtgcctggccatttttagatatatattatattaaaaacaaacaaagggattttccctagaagtgcatttgcttcctggctctcaggttttctgattctgtgatttagtagaagaaggggaaatctcatgtgagctgtagagaaagactgaaagaagtgtttgttgtgtcatcttggaattcgagtagaatccaaacttctgctaacattaaaaatgttaacatggcactttacttttcaaagcagtttggtcctgatttgttcgtttgtgacagggtttcactttgtcaccccagttagagtgcagtgccaccatctcaactcactgcagcttctacctcccaggttaaagtgatcctcctgtcttagcctcccaagtatctgagactataggtgcacaccaccacactggcaaatttttgtatttttagtagagatggggtttcgccatgttgtccaggctggtctggaactcctgacctcaagtgttcggcctgccttggcctcccaaagtgctgggattacaggtgtgagccactgcatcctacctagtcctgatttattttataaacaaaccaggtgatactccattgtgaaatagctcagattggtgggcaagccacatatgtggtgaggtgacttggaaggcagcttcaggtttgagcagttgtttagaaacaatgtattttgcctccctgtttattctagctcattctttctgtttaataactttcaccaaatcacagttggcctttcttctctgacctgacacctgtgttatataaagagcattctacccagctataggaaacatctaagtcaggactgttttatagcagttggactagggaaaggaaatataaagaatgctgggagatgttaccatgggctctccttttatttttgtctagaaatctcagaaaagaggaaaacctaaatacctctggtaactggctctgattcaaggcaaaagtatctactgtgctctttatccgtagttttccctgtgtgtttacttcattttaaaaagaaaaataagtaactttttttttttttggtactgttacgtgcttgagggccatttttggcttaggctgaggttgttaggttttcactgttaatgagaacccaagttagattgtcccctgagagctggagttgccagtagttgtttgccagaatgattttatcaacatcctttttagcagtaaaaagatgagatgtgtccttgaactacactattttccgtaccgacaactgccaatcttttccacattgccctttgcatctttaggctgaatagaggtatagtttagatttttgtagccatttcaaattggtatctcatttattatgacaactcttctggaaaactcatttgtttcatttttcccctttctgacaatttaagttctactatttgaaagaaagaaaagacagcagagaagcttatcatcgagtataggaaacaaccagaaaattatctggcccattcatatacccatcaggcttcatgtgttagagagtacgctgcctaatttaaaggtagagtagatttaaaagcaagactgagctgggaacggtggcttacgcctgtaatcccagcactttggaaggccgaggtgggtggatcacctgaggtcaggagttcaagaccagcctgaccaatatggtgaaaccccatctctactaaaaataccaaaaaattagccaggtgtggtggcacaggcctgtaatcccagcaactcgggaggctgaggcaggagaattgcttgaacccaggaggcagaggttgtagtgagctgagattgtaccattgcactccagcctgggcaacagagtgagactccaacttaaaaaaaaaaaaattgagtgaaataattttaaattaggagttttaaatctagggttcctagagtcaatgaagtctctgaaattacatgtaaaatttaagtatatgtatatttttccaggggaaggttctatagctttccttcgatattcacaggattctgtggctcagtggttgaaaactgttgccatggtccgggtccagtggctcacacctgtaatcccagcactttgggaggctgaggtgggcggatcacttgaggtcaggagtttgagaccagcctggtcaatatgacgaagccccgtctctactaaaaatacaaaaattagctgggcatggtggtgcatgcctggagtcccagctactcaggaagctgaggcaggagaattgcttgaacccgggaggcggaggttgcagtgagctgagatcatgccactgcactccaggctgggcaatagagtgagactttgtctcaaaagaaaaaagaagaaaaggaaaaaaaaaccattgccataaatgatctttagttacctatgtttccgttggtagaaaatacatgtaactaaactttcctttgttttatcttaggctttcttgaaatgtactaagagatatttgaaggggaaaatacagttttctttttttctttgttttattctttttctttttggaaaatagttttcttttcctatcctttttacaacctcctccctgcctccaaaaatctgagaattcattatttactgcttccataggagtttcttttaatattttagctgaaataattgagtctgttttgataacccccaagcaaccttaaaacttggacctagaaattcactgtggattctgagttctgcaactggaagagaatgtcagcaacaaattaaagcttctgaacagttgaaatggtggcttcagttaccaatggcttttcttaggatttgttaaagagcaacttaaggactgagggaaagggtctgaggttctgggagcagtcaggatctggggagccagctggctgtgttgctgcagcagaggaaagtggggtggagaagaaagtggcatttatgctcaggaattttcctaagttccccgcctctgagatctgactgggccaggcagggaaaggatgtgtgtggaactgattgtaaaagagtgctattatgttcagtttaagcttctccaaggagaatggaaataaagcttaaaatctctaaggaaaagttctgaccttccctttctttttttgcatcctctctcctttggtgcaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggtgagtccttccttgctttgtgcttagatttctgtcaacttgagaaagttagcatgttttattttgtgtaagagttattgagaagtctgtgtaaggtgtgtttgttgcaacaaattatagcctttaaaatgcctggcagaatggagaaatttgtgcaaaggcaatatgtactaggcaaatattattacatctcttttagaatttatctggaaagcccgcctcccccctaccctgtccccccacaaaaaaatatgtactaggaaaagaactttagctgtctttgtttctggtagaattcttatgatgttatatatctagaaattttcctagttgtagatgaattttttaattctttagaaggtagaagaaataactaggggaattaccactttaaatctagttttggggccgggcgcggtggctcacgccggtaatcccagtactttgggaggctgaggtgggcggatcacaaggtcaggagttcgagaccagcctgaccaacatggtgaaaccccgtctctaccaaaaatacaaaaattagccgggcgtggtggtgcatgcctgtaatcccagctactcaggaggctgaggcaggagaatcgcttgaacccgggaggcagaggttgcagtgagccgagatcatgacactgcactccagccctgggtgtcagagtgagactccatctcaaaaaaaaaaaaaaaaagaaagcctaattttaggctgggcacactgattctcacctgtaatcccagtacttggaaggccaaggtggtaggatcacttaagaccaggagtttgagagtagcctgggcaatataatgagaccctgtcttacaaaaaaaaaaattagccagacatggtcacacatgctgtagtcctggctacttgggagactgaggcaagaggattgcttgagcctaggaggttgaggctgtagggagttagtattgcgccactgcactcccacctgtctcttaaaaaaagaaatgaattttaagcactgagatttgttggcaaattgaatgcaaaagtaacttcatgaaaaaacatcaccctgcgttgctggagttcaaggtacaatgggaaagtgattcagtttcagaaaattgagataagtgagagggtttgattcctgtatctcaaggtgctataaaaaagaagactgactgcttaattaagttggaatgttgggccaggcccagtagttcatgcctgtaatcccagcactttgggaggttgaggcgggcggatcacttgaggtcaggagttcaagacaaacccggccaacttggtgaaaccccatctctactaaaaatataaaaattagccaggcttggtggcgcacacctgtaatcccagccactcaggaggctgaggcaggagaatcacttgaacccaggaggcgggggttacagtgagctgagatagcaccactgcactccagcctgggcaacagagcaagactctgtctcccaaaaaaaaaatggggatgttgacaaggaccaaattttcttgtctacagaggttacctgtgaatccttatttgaaaaatgatgactatgaaagatagtggagaattgcattaccaagaccaaatgtaagggtggtcagctgtaataactgggcccaaactcagaatgagtaaggctacaatgtcaaagagataatttttatgttttatgtttaaattcaagggaaaacaaggaacggtataggtactcagccaaaattaacatcataaacagaaactttccttaaacaaaaagacttatatgttcagtgggttttttttgttgttggttggttggttggtttttgttttgagacagggacttgctgtgtcacccaggctagagtgcagtaatgccatcatggctcactgcagccctgacctccctaggctcaagcaatcctcccacctcagcctccctagtagttgggactatgggagcatgctactacaccaggctaatttaaacaaattttagtgtagagatgggggtctcactatgttgcccaggttggtctccaactcctgggcttaagttatcctcccaccttggcctctcaaagtgccaggattacaggcatgagccactgtgcccagccctttgctcagttttgaatacacagttattctgaagacaactctggagctattctgtaggcagaatgggaagatagtgtaaaaggagagcggagactctgcagcaacaataaaaaaaaaatggctgggaggagtggctcatgcctgtaatcccagcactttgggaggctgaggtgggagccctcacttgagtctaggagtttgagatcagcctgggcaacaaggtgaaacctccgctctacaaaaaatagaaaaacaattagatgggcatggtgacatgcactcgtagtcccagctactcaggaggcaaaggtgagaatatcgcttgagcccaggaggtgaggctgcagtgagccgattgtgccagtgagccgattgtgccagtgcactgcagcctggacaacaaagtggagccctgtttcaaaaaaaagcagacattgaagtttagaggggatatctgtatatatagaatgaaagccctgattgattttttttaagacagagtctcattctgtcgcctaggctggagtgcagtggtgccgtcttggctctcactgcaacctctgcctcccaggttcaacgattctcctgcctcagcctcccgagtagctgggattacaggtgtgcaccaccacacctggctaatttttgtatttttagtagagatgggatttcaccatgttggccaggctgatctcaaactcctgacctcaggtgatctgtccacctcggcctgccaatgtgctgggattacaggaatgagccaccgtcccagcgtggtatttttatacagcattttgtgaacatctatgtattcagacaccatactaatttgttcatgtgcattatctcacttagtttttatacatacaaagcagctgttctagatggtaaaactctgtccctaaaggatgaagtggcttttccagtgtcaccagtagattactaagccagtaattgaatccaagataatttaactccaaagaccacatgttctgttgagcacactatacacaagaaggctctccaggtagttgctaagtgagaggagctgagatgtggatttggctttttggtattggaatgtgagcataatgacatcaaaattaaggaaaatttgtcaaatctcttgaggaaacttttgcgaagagagtttttatttaatatttgcttcaatacagccaataatacctaattttcttttttttttctaggcgactggcctccactttagacacactgataatgtgattcagtggttgaatgccatggatgagattggattgcctaaggtaacttacctgagataatagtttaggctttgttccagctgttgtggcataaccctcaaacaacctgttctcattctacctgtaaaattattctcagaatctttggtgtttttttaaatactaaaagatgtctttctttttgacttaggaaatagttttgttctttttcttttataatcctcatacctgtttcatcttaccctagagaaattccctgtgatgatatctacttttactacatcaaattgtagacttacattttactatttttccttagatagaattcacatgctgtgagattcaccattttaaagaataccaaatcagtggtttttatttattcacaaagttgttaacattaaaatttgacctttggaaatataaggaaatattttagaaatctgtagggagtatgaagggtcattttttattttaaattgtagaggtggtagaatgacgtttacttcctggatctgtttttggtcatggctgcagttttgtttggagtgtacatcttctgggtgttctgctcaggagtttatttagtgttgctttcagtgaaattgccatcccagtcctgtctgaatctataactgccacactgtatggtcactcttagagacatgaatggattgattgatttcattctttcttttgttctcatttttttctgtttatatcctttgacgtaagaattccgcttctgggaagttatccgaagtaaataatcagaaagcaccaaaaaaatgtatacagaaggattttttagcattgattatgatagaaaaaattgatagcaaagtacatgtttctttacaaggggtattaattgtgttacagccaaatactagtgccatttaaaaggatatcaacccaagtaaagggcctttgatgtattaagtggggaaaaacggttgaaggttataggagtttgtgttctagctaagatcagatcactatttttgtgtaaaaataaagtgagtgttcttgggaaaaatttgtaaggagataaaatggttttcatttctgtgtgatgggattaagggtggtttttattttccttgtactttcctgtagagttcaaatttttgtaaccaaaggaaaatttattttaaaaaagtgaggtgtagggtatcagaaggtggctaaaaccattttatattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatacaatatataattacatattgtaatatataatcatatatacaatatattatatattatatatacacaatatattacaacatgtaattatatattacgtatatagtatattgatatgtatacaatatacaacagatatgcattgttgcatacatacctgtggaattgtgttaaatcagaactgagtctttgcagaagactagcttttctcctctttttttcagagaaagttctgaagttctcttccttgccactggtatgtttgagaattaggccccacaattgttaggaaatgcagtacgtcaagttcttacagctacgtggcctgtctgtgcacctgtaatttcctttccctgttttttaatatagtataaaatactgtgctatatagtgtaaaatattacactgtgcacctgtaacttcctgtttctgttttttatatagtatattgccagtgggcaatgacaataacctcatttgaatgttactaagagctttgttaatatttgcaattgctagtagtgttgttactacgagatgcttttttaatgatgtaattttgttaccttttttggtttactaacagtagtatattgtcctggactacaattgcaacaaacacagaatgtattaaaggctttcaggaacaacttgataatcatggctgtaagccttgaattgtccaccctacgtttaggcccagaagacttctgagtaataagaactaatgataacctaaaaatgtattgttgttcttaatataatgtataatacgtaattgacaatacgtatatggtgtttattgggatgtcttttctaatctctttatatggtacatgctggcctattatagaaaattcatgcagtcattttttggttcttatcctttttgactctttattataattggtactgttggctgccttttccctgagatatttcttagtttgatttttaaaattgtttttaatctgctcaactagtcctgttttctttaattattctaccttccatgtcctagtgatggacatactttaagatgcaatccttgttagatacattttcccattttcatggtttcatttattctcaagacttgctgacataagataaacacggtatcttcagttggctgctggacatttctccttggatagctttctgtcacctagaatttttcatatctaaaactaaatctaccttttccccaactgaacttcccttcctctataataaatggtaccatgtcatcattttcccagtcatccagtctcaaaaccttggagataccttgaacttctaaatctggtcattccctaagccttctccatttatttgaaatatctcttttatccatctactgttacaacagcctcccagcatacctccccagctcccatctcccattattcaacatatgctgtgtcctgtctccagtcagatctccccagggctctatttttatccttagctccaaagctaggctacttctttatgtcctgcttatcaagttcagacttgtctgactttcaagttgcttataataatctgattttatcctacctatccaaccttatttttctgttattttctagaacgtattctgtagattttaaaaaacaatagggtatattgccttactgtctcacaaacacatcatgattatttttgctttatttattctggctatttctcttatttggaaggccttttgctctctatcatgattcactcatttctttagtttatgatttcacagtcttaatataggcctttattgcttatccaaattcttctcacctcattattcagtcttttgcttctccgaaccactgtcaccccttatttccctaaattacagattgaattgtatggtgccacatgactgtgagaataggccttgaagttcaaggctattcccagtctaaatctactctgttcctatcctacctcattcactaactcatcgaatgtagagcttccatgaccctggctctgggcttgatatcaaagatatggcagttaataaataacatagatctagccctgccttcgtgtggcttatagtctgttggagtagccaaacagataaacacaaatgatcgattttggtaagtgctaccgtggaaaagtacttgtcttccaaattccctcatacatgctctattctagctacttcatctgtgtagcttcccatttctcctaagcattaaacacattttaatattttatagtttttttcaatgtctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttaggtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatacaaaaaattagctgggcatggtggcgggtgcctgtaatcccagctactcgggaggctgaggcaggagaattgcttgaacccggaaggcagaggttgcagtgagccaagattgcaccattgcactccagcctgggcaacaagaacgaaactccatctaaaaaaaaataataataatcataataataataataatttttgtaccaacacaaacatgatagtaagaaatgatacaaaatatatttttttcccataatgtcatggtaaatttggaatgtgacttaattttcaggtccccagaacactaaattaaataggaaggaaaagatgcaagtctggaaggatggtgggatggcatattagtagatgcttatacaggttgaatatcccttctctgaaatgcttgggaccagaagtgttttggattttgaagtatttgcattatacttaccagttgagcatgccaaatctgaaatgcagaatgctccaattatagcattgagggtcatgttggtgcttaaaaatttttagattttggagcattttggattttggattttcagatttggtatactcaacctgtggtacagtagtgtagtattttagcagatttacttgatggccacaggactaaagaagaagatggcagagcaagtgggacatgagtgagatatttgcttgggctgcacttcttatatggcatcctctatgtgtgcttgctaagtgttaattacattggagtaggtatataatactgatctataagaagactattgtctccagtttcttgagcaaacatgtactagatctgtggtatcattggaatcagtgtgaaacatatgaaagaatgaatatagctgagaacttgtggatctcgtgttgagaatgtagcaatttcaaatatgtgtctgaggctgggtaggtacagtggctctcacctgtaatcccagtgctttgggagaccaaggtgggaggattgcttgaagccaggagttagagaccatcctgggcaacgtagcgagaccccatttctacaagaaataaaaaattagctaggcatggtggcattcacctgtagtcctagctactctggaggctgaggtgggaggatcacttaagccgaggagtttgagactgcagtgagctatgattgtgctactgcacttcagcctggatgacagagcgagactctgtctctaaaaaacaaaacaaaacattaccaaatatgtgtgtctgagtccagatcagattaattctgagtattttgtttggcttagtgttgcatgagatttgtccatgttgataatcttgtgaaggccttacctgcaatggatatctgaacgtggaagcagaattcctctctgctagttgtgtagccactactctgcagtgtaacctgggttccaggccctcaaattctctgtagtagagcctaaagaattaactatgccttcctagtggtagagtcagaatgagaaagagaggaagtctgctattgttttccatttctcttgaatatgtagtctgtgcttagaaagtatatatagagcagtgtgtttcgtgatttatggtttcttttttatggtgtttttcctgaagggtggattggcaacatttgataatatgtaggaagtatttataattgctgaaagtgccttcttttaccacaaaacacagccatgttcaaagcaggttcctcaccttgctatattggataaggctccatctccctttggatcaacagtgacagaaaaatactacctctctgtctcctccctgcttgcctttttttttttttttcctctaaagtcttgattggcattattccagagatagtcactgtactttaatcatactaaattacttttgtagataacattccactctcagataagaccccagttttccattctcaaaatacttgtatactaagtttggtgtaagctcatttgtctccttagtatgattatgtttgtgtgtttctctgcagaaagtaatggattggattgaggatgctgccccagggcttgctggggatactttatgataccatatacactgtaaatagaaatacactttctaatatctgagaaattcaatattcagacatatctggctccaagaatttggataagggactgtggacctgtagtagattctgtttcctaatcacctgctgtgtttcagggtctttattaataatctttgagattggcatagtgacttctaggttactcaccattcacagaaaagataattagaatccagatagattaacatagcttccttctgcccattgctacaaagtacagcttaagtaggaaataagaaaaataaatctaagtgcagttacaggctgacgcattatagtgcctaacagtatatttgtagaagtaggcatgggagagcaggagcaaagattggaaagtgctgttcaccattagggtttataagtttcagtgtgaagctaagtacttttgattgtgggtaagaggacttaactggccgttttgaatcctttcatagctccagtgtctccataaaatactcgtaataattaaagagagttaaaagaaagatggtgcccatgtctactttttatattagccagtgatacggttgtagcacctttaatttaccactgaaagacattaaaagctaagtcagtgttcctggtactgtgaaagcaactgtattagtccgttcttgtactgctataaagaaatacctgagactgggtaattcataaagaaaagaggtttaactggcttaaggttccacagcctgtacaagaagcatggctggggagacctcctcaggaaacttacaatcatggtagaagacaaagaggaagcagtcacgtctcacgtggcaggaacaagaggaagagagaggtggggaggtgcttacatacttttaaaaaaccaaatctagcgataactcactcactgttaggagaacagcaccaagggggaaacctgcccccattgatccaatcacctctcaccaggcccccacctggggattacaatttgacatgagatttggacagggacacagacccaaaccatatcagcaacattcttgaactttcttaaaatttcttgttcgctatttccaagtaggaataaatgagaaagaaattcttggagaaaaatattctcttaattaagaatgcagatgtgatgtattagtgagaaaaatatataaaaaatatataaaaatgtataaaaatatatagaaagttattagttattttgctttggaatttcttttttaaagaggcagggtcttactcttttgcctaggctggaacgcagaggtgtgatcttgactcattgtaacaacctcccaggcacaagctatcctcctgccttagcctcccaaatggctaggactacaggcatgcaccaccatacctggctaattaagaaattttttttgtagagacaagtcttgctatgttgctcaagctgttttgaattcctgacctcaagctatcctcctgcctctctttctcaaagtactggaattacaggtgtgagccactacacccagtctggagaattttttgaatacatttaaaatcttctgagacaggcgctttatatatccatcttgagtcttttacctgaaagaaaagcatttaatcatatacacatgacttatacttgcacttctctgagaaaatgtttagcttctgtggatgtataaattctagtgtgttttgagaatacttgatttttgtttttctattatacatttgggtttattatatacaatttaaattttgatcagttctgtgattgcagtgtacatgatgcgtgtttgtatttagatgatattgaggtttatagattatttacaaaaactgtataccactttaagtttctatgatttatttcttatatatttcttatttccctgcttactttaaactgtcaatatcttgcttttgtcagtatctgtaaagtacccttctgatctcttctaatttattgattctgatcagttagggctttagaatccacttaataacacaggcttatggacattaatttatccgtccatccatctgtcaaatattgattaatgtttattaatatatgctaggctctgggtaaacattagtgaatgagccctgtattgtccctgctttcatgaagcttagagtctagttgatttttttttaagtttaaaaagtaaaaataattttcaccaacctgataattaaaaagtaaaaatatatgaaatattctttatctaaaactgttaaattacctggattaaacttttccatcagtaatatgaattcagtttaagtaagatttgccatctgaatcatttttatgaagcttttctaaaatgtcttattatttaaaacttattgattacaggaaggcaaacaaatgaagagacacttcacattatattaacattaatgttaacatcttttttttttttgaaacggaatctcacactgttgcccaggctggagtacagtggtgtgatctcggctcactgcagcctttgcctcccaggttcaagcaattctcctgcctcagcctcctgaatagctgggattacaggcacatgccaccacgcctggctaatttttgtatttttagtagagacagggttttgtcatgttggccaggctggtctcaagctcctgatgtcaggtgatccgcccacctcagcctcccaaagtgctgggattacaggcatgagccactgtgcctggccattaacatctaattatgcattgagtttgtgccagaaccgggactttaatttgtgcctactgatttctcccagtccagtgctctttgcattgtgttatgtgactttttaggacaatgttgtcatgtaaactaaaaaaaaaaaactgaggtaaatagcgtattgtaactacaaaggagactgtcgtaggtactgggagtctcagtgttcagaatacttctattttatacttcatgctgattttcgccttttaagggtggcagctaggcacagctgggaggcctaaccttttgcatattgtatcttctagtttgtacctgttcaagctaggcctggcccctcagattcaagacctatatggaaaggttgacttcacaggtaaggagttagatacttggcaggaaatgcttgaattatgtggaaatagcctggagagccagcagtaccaattttgaagacctagggctttaaaaatacactggcagtggaggtgaaaaaaatacgaataacttgcttctctaatgtggggtaaagaacactaaacttgaaatttcaagctctgttctctcacttaataatgtgaacatgattagtgagtctcagttttcttatatgtaaattggggataacattaacatatataaaacataataatgttaacacataacactaaatgttcgggtatgttgaaaaaagctttataactatctttccctttccattccagcaagcatctgttgtgggcaaagcaagagggagagtggggagtgagatgacacaaagatgccaatttagtaattttaaaatttaagcttatttgggtgggtgtttctatgtgtatttgctatagccagatgcttgaagagatgaggggttggggagaaaaagggcagtggtaatactgtttaagggtaagatagattcaagtctttcaaagtggtgattattttgtaggcttgaaagtttaaaaattggtaagaaagtttttgtccatgatattttttccttccagggaagttattcaccagacctggggaaaggaccagaccttacatgttttctttatcatttggctttctgccttagaaatgaaattgttgaatagcagctaatgattgtaaagactgagataactgacttagtttgtgattcacttattgttgagctcacgttaaagctgttccatttataagttcattgtaggaaatgccataagtagcaattttgaaaaactatttcctgtaggaccttctcactttatagttatttttgatgcccttgataataataacgtttgactacattttatatactagttactgtgttaagtgctttccatacattgtatctttatatccttataaaaccctaaaaggtaaatgccattttatcccattgcatagttgaggaatatgtttccttctcttggttatggaagggtgcttagcttgattgactgattattaattccctcctgtagaagaagaaatcaacaacatgaagactgagttggagaagtatggcatccagatgcctgcctttagcaagattgggggcatcttggctaatgaactgtcagtggatgaagccgcatgtaagaagagagaaattttgtgggttcaactgggattgttgccactatttccaataattaattctatagtgatgatctaggacattatgaatcttgccagcaagtttaagtccacagatgtagttgtaaacacatagtcttccatgctgttattatttggaaatacatgattaattctgattaaagtgaaagcatttagaaaggaagtcctggctgggcgtggtggctcacgcctgtaatcccagcacttcgggaggccaaggcgggtggatcacctgaggtcaggagttcaagaccagcctggccatggtgaaaccccgtctctactaaaaatacaaaaatttagccgggcatggtggtgtgcacctgtaatcccagctactcgggaggctgaggcaggagaatcacttgaacccaagaggcagaggttgcagtgagccgagatcatgccattgcactccagactgggcaacaagagtgaaactctgtctcaaaaaaaaaaagaaaaaaaaagaaaggaagtcctacatttccgtggctcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagattctctggggtaaaatgtttgtgtacagttgttatgggtatgtggaagttagttaaatgattctgacttgaaaaaactgaatctgaggatctcatttcccgaggtcaggagtttgagaccagcctggccaacatggcgaaatcccatctatactaaaagtcaaaaattagcccagcgttgtgttgggctcctgtaatcccaggtacttgggaggctgaggcagcagaatctattgaacctgggaggtggaggctgcagtgagccaagactgcaccagccaggagacagggcgagactccgtctcgggggggaaaaaaaaaacttcacacaaatttatccaccccttgttaaaattagtggttgatgacaaaacgaagacaatcctgctctcagaacattctttgtatctcttatcatagagcagggatttcagtttcccagttaggtgccaaactggcctgcaggcaagtagctgctgccctgcctctgcctatgtcaccagtgagactccaggattgtggatctgtatgtgcccattctgctcagatctgaggcaaggatgtgctgcccctaatcccagcactttgggaggccaaggcgggcagatcacttgaggttaggagtttgagaccagcctggccaatatggtgaaaccctatctctactaaaaataccaaaaaaattaactgggcatgatggtgcacgcctgtagtcccagctactcaggaggctgaagcaagagaatcacgtgaacccaggaggcagagtttttaatgagccaagatggtgccattgcactgcagcctgggtgacagagtgagactctgtctcaaaaaaaagacagaatctcgctcagtcacctaggctggagtgcagtggcacggtcataactcactgcagccttgaacttctggggaaagcaatcttactgtcacagcctcctgagtagctgggactacaggcatgtgccaccacattgggctaataaaaaaaagttttttgtagagatggggtctcgctatgttgcccaggctgatctcaaactcttggcttcaagccatcttcccaccttggccttccaaagcactgggattacaggcatgagttactgtgcctgctttgttctttataaagggtcttaagctacacccatattcttggtagtgttatggtgcaggaggagcacacgtgtatttatgtggtcttcttagacaccttaagctaacttaattacgctttttactcatcctcagacagaaaactcagagagagaaagagatgtttatgaggagctgctcacgcaagctgaaattcaaggcaatataaacaaagtcaatagtaagtatgttcctgaatcaggcacctaaagggatattataatataatgtgaatgttgatctattctgggacttacaacatagtttgatttacttactttagacattcgtggatttgtttagcaataattgcttgttaacaatcttttgtgtttctatgcctccgttttaattatttatcttcagtcagccgcttgttcctacactgacagtagcatcatagtagtctgtttggctacagtttcactctttcaccctattacatgcttttaaatattattttcctggccaggcacagtggctgattaatcccagcacttacatatctgtaatcccaggactttgggaggctaaggcgggtggatcacctgaggtcagaagttcgagaccagcctagccaatatggtaaaaccccatctctactaaaaatacaaaaattagccgggcatggtggcgtgctcttgtagtcccagctacttgggaggctgaggcaggagaattgcttgaacctgggaggcataggttgcagtgagctgagatggtgccactgtactccagactgggcaacagtgagactctgtctcaaaaaaaaaaaaatatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaacatatttaaacaaaaatgagattatacttttaatattgacttttatatatgtgttacttttgggaaattaatttattgaaattatcattttgtcactactctgctaaagaactcaccatgactacttcatacttgccagacaaaatgcagatccctagcctagtgcagttctttatgcaatatttcatgcatacagctctttgtagaagctcatttgcctaattacctcccatactcattctgtacattttatgacttaaaaggaatctgggccaggcaattccagcattttggaaggccagggcaggtggattgcctgagcttaggtttgagaccagcctgggcaatgtggcgaaaccctgtctctacaaaaaatacaaaaactagctggacgtggtgacatgcgcctgtagtcccagctacttgggggctgaagcaggaggattgcttgagcccaggaggttgaggctacagtgagctgtgttcgcaccactgcactgtagcctgggcaacagagtgagaccctgcctcaaaaaattaattaattaattttttttttttaaaaaagaatctggctctgaagtggtactgacctggtatttgatctcttgttcctctgttaaaagctgtgtaacattgggcacctgcagtagcgttgttagacatataatacgagatagtgtatgtaaattgcctgctatttagtaagtactcaatgaacattaatattatcgctatgtcatgtaatctccctactgtaatgccttcatgcctcatctcttcctaatccaaattgtacccatcattcaagatccagttcaattttcacttcagtgcctgtcacagttcaatatggttgactttcaaatctcctgtgtcgtacacaggctcatccctataaatttgcacttaattatatattgtcttgtattgcttgatctttatttctgacatctttgtaaactccttaaagtagagattacgtattctgcttcttttgaagtcctcctaattcctagcataggtttagactcaccaaaaaaactaaaaggtttgatttcaaccaactaggtcaggcttaatcttgttttgctcaagatactcataacaataataatagtaattgttctcattgttcatttggagggccaaatttctcatttgaactaatactaataactagagaggatttagaagattttaccaattgcataggattggagttttaagtcctgaccagcattctttttttttgggttttttttttttttggagacagagcccaggctggagtgcagtggcacgatctcggctcactgcaacctctgcctcctgggttcaagagatttcttctgcctcagcctcctgagtggatgaccagcattctttgtattctgctaccttctggttcatttaggataatgaccttcctagcagaataatccattcaagtgtggatggtatcttgtgctgaatctgtattaatccttaagtcagcaaatataaactggagtgtccttatggttggttctctgtgagaagaaagtccacgatgtttcctgttgcatagagtacataaaatattttttgttttactgagggatttttctctaccttactgtttggtattttataacctttatagttttaccttgctaattgtataagaatcagttgtgagcacatgtaaggaaataataatatgttcttaaaatgtcctattcatattattattatgtagtcagaggagcaaaataataaaaattccctcaaatacctttcagtatagtggggaagatagacatacaaatgagtacttttagggcagcttgattagagcaagatgccaagagcacatgtggtgcagtcatagaataaagaagggaatgatgacttctgcttagaagtttgagcaggttttcagtgtacatggatcttcacagggatccttaggatagataagagggtgaggataaggcagaattccctataaaaggacagtcttttcctaattgtagagaaagtcttgaggcaaaggaaagttagatgccaggaggatatagggacttcgggttccaggaattaatgtaattatagataagattctttgcctagagcattcgaaacagcaatgaggccattgatgctgccccaggagaaagctgcaggccaagcagttaaaaattagaaaaagtttttattttattttttgttaagtagactaaggaaaattagagttatataactaaagttcagtgagagaaagtatttaagtaatgttccacactttattatgtttgcaatataaatgtttatagatattcatttaatatttacatatttaagtagtatgtgtacacttctagaaaaagcaaaatttactagatgcttttgtagatagataatctaagactctatgctatatacctagagaaagtctagtttgttatctacattgattttattttctgtccctagctactatgaaagctccttgaggacaggatatttgtttttttcacaattatatttgcaacatatagcagatcctcagtaaatatcattgaaggaatggatgattagttggctaacagccacatatacctgcagacatgacttgagaagccaccaccttggtatggtgctcagttgaatggcaggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgattttctttataacagcttattaattttattttgttttttactaatgaaaacatttgcaattgataagtactattatgccccagatatttttatttttggtattttattgatttctttttgctactgtgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgttttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcagggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtcatgttggtctggattggtggctccatattggtgctgagctgtctacatttggaagtttttaagtaggctgggagtgtggcccaggaatctgtatgaaatctgatgaatagcttgttgggaacccctggacttgatgactctaaggttcttttccaatcccaagatcttatgcttctgagaatcacagagtaaaggctctctgagttatatttccttatctggaactgagattggttttggggaaggaaaactattctaggctcttctgttaacatagtcctttcacaagcttttgccttttttcctcagcattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacaggtaaacatagtctggattgaagctgcaagagtttgtatatatccattcgaatcccatgctgtcatttaaagatatatatgctgcctttgtttttcccccaatacgactttttcctctgcatataaattagtttaaaaaaaaatcctcaggtaaaatacacattgtcttcagctcacttttgcttttagagctatgaatcctcttttaagataaacagacaatacccacccatccccagtctaatcactccttcacttcagctgtctctctctccaactaaaagacattggggaaaacctgaatatttttgcattcttacgtcaggaatttgcactttaaaaaaaaactgcaccttattagtttgctctggccaaagctggaaaagtacttactgtgcagtcagggtagcttgtgtgggattgtatttcgtgggttttttttttttagaacaaacatgaggggctttcttttttgtctaaataagggcaagtatacattttacaaatatccagcgtacgttggtcaaagtaagtagcattaacgtgcttaagattctacaaacactttttccttagaactttttgaggcttttcatgtaatatgtttaagaatgtactggtatctgtaaagtcactctaccccagctttggcaaaggcatttggctctacctggggctgccaccttggctgcatgtagcctgagctgtcacttatgactatggctctctctgtccctagtgactgcttttgagagatgagaaccttaaggcctggagtcataggaatgagtaatctttacataattttctttgctttgctcagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacgcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctccccactacccttcccagcttctgggaaccaccagtcaactctacctctgtgagatccacttttttagctcccatatatgagtgagatcaggaggtatttgcctttctgtgtctggcttatttcacttaacataatgaccttcagtttttatggctgaataatattccattatgtgtatacactacctttttttttttttttttttttttttttttttttaccatttattcattgatggacgcttaggttgatttcatatcttggctattgtgaatacagctgcagtaaacatgggagtgctgatttcctttcttttggccatatacctagcaatgggattgctgaatcatatgtagttttattttaattttttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctttaatctattttgatttatttttgtatattatgagagatagggatctagctttattcttctgcatatggttatccagttttctcaacaccatttattgaagagactgtctgtctcagcccattttacgtggctataaagggatacttgaagtggggtaatttattagctcacagctctgcaggctgtgcaagaagcaaggcaccagcatctgctcagcttctggtgagggcttttgtgctgcatcaaaatatgaaggagaagatcaaagggcaagtgggctcatgtgaagagagactgatccccggggtagtgagtaggggtcctggctttataacaacccattctaatgagaactgatccgttctccccaagaaccaatccaatcttgcaagagctcactaccatgagaatggcacaaagccgttgatgagacatttgctcctatgacccacacagctcctactaggccctgcctcccaacaccaccacactggggatcaagtttcttctttttttttttcatacccttagggtgatgtcaggtatcagatttcaatgtgagatttggtagggacaaataaaccaatccaaaccatagcactgtcttttccctgatgtgtgttcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgcatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagtagtggtagcatataggatgaattgaacgggaagaaaatagggatgaggagaacagttaggaggctgctttttgaagaaaacatcttgattgagacatggttcacataccgtacagttcacccttcttcagacaaaggaggctgcttttttaaagacgaaagttccacttcaaacttcatggctgatagccacagaatgtgatatttttcccatgaagattggcaccttcttcccctgagggctctctaagcccactgcgtttctgactcctgttttttacacaggattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaagtgagttcactaaacctgtcctgtttgtgagcaaagttgggtggacgtgagtgtaatacccacttcttcctgtggttaggtagaacttttttgcataaacttggttttcttacagttttattaaacttataactccctgggtcttggagaatgtctttcctcactgttttcccttctgtccctttctgtacagcataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtgggtgtccagagtgaagggaataaatccattacgtagctgttaaccctgtcttttgtatgtcagtgctccgattttctttgcaggcattattactttatcatggtcatacttttgtttggttctactttgattcacttaattctttgttatgctgaaaaatatgacattccgttcctaaatatataagtaggcttaaatatgttacatagtcaaaataacactatctctgacaaagttaaataatactttttaaatatcatctaaccctagctagttcattttcattcttcatttgttcccaaactgtcctttatagctgttttgttgaaaacaagatctagcctaggaacatgtattatatctggctgttgtgtcccttgagtatcttttaatctagaattgtccctttcttcatgagactgacttgttaaagggatgggaccaattgcctattttatggatagttctagttgctttctcatatttgccttattcctgtaaattggaaattaaatttctaggcttgtcacgattcagttcaacatttttgatgatgtgtatttcatattgcctcatatcaataggcatataaaacccacttttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaactgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaatgatatccaagcttgcgtggaccatgtgaacctggtggtgcaagaggaacatgagagtgagttatcttcctgtcctccccaaataatgtcaccattaatgatgatgtgattccatgaagtggttcaaaatactactcctagaaggatttttgggtgagagattgaaaatatctatataacacaaaaggctaaagttggatattgttttgagaacaccaggcaattgctataattaggtatatgtccagtaagaactaaattttgggggaggtgaattgaacatgatctgttatttttaaatgctgttataacaagtagtcctgacactacatggaattaggttgaattgcacaggttgtaggcatggtcctccacaagactcctctcacttcagacacaagctgaaagctgcagggttcccaggccactgtacttctgaacaactggctgcaaatttggaggatcccttctacccgctcaggtttaataatttgctagaatgactcacagaactcaagaaaatgctagacttacgattaaaattttattacaaaatatgtaaatcaggatcagctgaaagaagagaatcatcaggcaatatctgtgagagtccccaatatgaagcttctgtgttctcaggatgtgtcactctcctggcacattgacgtgtatcaccaaccagggaaacacacctgagttttgggtgtccagagtttttatttgggttcgttacatatgcgtgattgatagtattggctttgcgattaaactcaattttcatttggcctctgctccctggagaatgggaggccaggctggtatcacgtgactctatacctcagtggttgatctttccagcatggccagcctccatccttaaactctcatgaggccaaccaggagtcattggttggcataaattcaggtgtgggcggaggggcccaccatgaatcacagaaacatacctatcactcaggatatcccaagggtcttagacgctcccccagagacaaagaccagccagactttttattatacagcagagtccttacaaaagcagtacggctgcctaagatacctggggagtgaacgttcctaattttaatttgtatttcctgggagaaatattcaactgacttggtgggaagagccttgcttcgcattagggagccctgcgcttggatctttcttctgccatttgtttgctgtgtaatcttggagaagagattgctaagccttgttatttcttctataaaagtgttgaattagatgactttttaagaacccttgaacctttttaagactcttcgtgaatcctttgtgactcaagaatgtttttgattacacattccagtgtacctgaaagctatacagtaaggccagtttcataaaaatcctcatcgcttttaagttagagcaattaaaaatgaaacaaaaggacttgagcattcaataggaatatgaatacaagtgagtttagttgaaataaatactaattaaaaaatgaaaacagtgctgcttaacggatggtaagttgcagtttgaatcatggttactcttaggtggatttatgattagttagcatgttccatgattgatttgtttatgtacttccttaattagaaaaaaaaaactttctgtctctttatatttagggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggtgagtggcatcggaattgttctttatgttcagagcacctcagccctcctagaacaaaggtagaggtaggaatatcttccttgattcattcagtgaatgccttctgggcacccttagattcaaagcactggagggacacaaaaatgtgagagacataggctccacctactaggagctcatgctgttttacacatttgggtttttgttcttttgtttgttgttgacagtcttttgtgtctctttcagtaaattctttactgaaatataagatccagggctgggcgcagtggctcacgccttgtaatcccacagcactttgagaggccaaggcaggcagatcccttgaggccaggagttcaagaccagcctggccaacatggtgaaacctcatctctactaaaaaaaaaaaaaaaaatacaaaaattagctgggcgtggtggtgcatgcctgtaatcccagctacttggtaggctgaggcacaggaattacttgagcctgagaggtggaggttgcagtgagccgagattgcgccactgcactccagtctgggggacagagtaagactccgtctcaaaaaaatatatatatatatatatgtgtgtgtgtgtgtatatatatatatacgtatatatataatatacgtatatatacatatatacgatccagaaaaaaaaatatatatatatgatccagaaaaatgaacaaggtagatgggtatgcaattgcataaattttcaaaaggaggcacacctgtgtatttggcagtcagattgtagaacccattaccagcaccacagagaccttcctcatatccccttccacccttagccaccctccatttggtggtaagcactattctgatttctattaataacaccacagttcatttccgtccacttttgagctgtatttaagtgggatcataccttatgtgctcttttgtgtctggcttctgttgccctaaataatgttaatgatatgcatccatgtggttgcatggagccatcctttgctcattctcattgttgtgtactatttcattgtgtggttatatgttattggtgaagttttttgttgttttgtttgttttttcagactgttgtaaatagggcttctttgttttttttttgagacggagtcttgctctgtcacccaggctagagtgcaatgacgcaatctcagctcactgcaacttctgcctcccaggttcaagcaattctcctgcctctgcctccccagtacctaggattacaggcgagagccaccatgcctggctaaaattttttttttttttttttgtattttttgtagagatggggtttcaccatgttggccagtttggtctcgaactcctgacctcaagtgatctgcccgcctcagcctcccaaagtgttgggaattacaggcatgagccactgcccatggcctgtaaatagtgcttctatgaatttttaattttggttaaaaacatatatgtgcatttctgttaggtatacattttggagaggagttatggccatagggaacacatatatgaagctttaatagataatgtcatgaaggttttttgtgacaacttaattgaaacgtaattcacgtatcaggtaattcagcgtcagtggactttagtacgttgatagaattgtgcagtcatcaccacagtcaatttttgaacatttcatcaccccaagagaaactcagtacccattagtagtcactcattttcccttaatctcccccagccctgggcaaccatcagactgctggtttgtctatgggtttgtctattctgaacatttcatataaatggagttatgcaatgtatggtcgtttgtgactggcttcttttagcttagtttatccaagctgtagcagtagcacttcatttctttttgttgctgaataatattccattgtatgactgtaccacattttatttatttattcatgagttgatgacacatggattatttccactttaccacattttatttatccattcatgagttgatgacatatgaattatttgcactttattcgtgatttgatagacacttagcatgagtgacagctatataagttgtatcttcaatctacttccctttttagatatggaagccgacctagcttattctccgaaaccccactcctctgacagtcagatataaggctccctttggactttcttagcagcaaaaacaaacattactaccactagcatacatagaatcattgcagcctgacacattagagattctgaatcagtagaattagactttaagcttaggaatctgtattttaaaaatgactttttcattgttctgatgaccagccaagtttgggaaacactaatctaataaaatgaatcaaagacagagacttccatttctagcttccctagagccaactacttcttatccgagtaagtaaaatcagttgatctcaatttcctggctatgaaatagcagttgtgattcaaccctctccacagcatcaagtgacattctgcataattatatctcttaaatgaaacctggtagtatctatcagatactacacttacatgattaggacatggtaatgtcaactactgccatgccaatgtaatcaaaggagatcagtcaacatcataatattaccaacatataaaattgcccactcctctacccttcaccaaaacttacagagcccacacgagtgtcagtgtgcaaaaagctccaatacactaaagccttggtctgtttttatacgtctggctactcagaattaaaaatttcttttagcccttccgcttgctgcctcacttcaggagtcttctgaaggctatggttctatccagttgttgttacttagtaagcactgaaaaggaggtcaatcacaattagaaaacagatgttaattatgctttaatcaacaattatttgagggcctactacatacaaggcaacttcctagacagcaacagcataaaaagaggcataaaccttgtcaatttcctcagcaaactaggtagcgggtaagacaaacattttaaaagatgagtttatgttacaattactttaacaactttatcttcatagtagcattattcctgatagccacagtggaaaaaaacagtatgtctatcaagtcaggaatagataaagtgtaaataattcaaaaggctgtgtgtgcgttttgtttgggtcatcggagtaaaactttttgaggatgtgactatagagtttgaagcatttcctttgctgtggaataacttttcagacttcatcaaaggcggaggaagtcgggggagttaaaggaaaaattgcttaacattgccaggcccagctgggtgaactacacattgggtggaattgttttttgtttgtttgtttttggtttgggttttttgttttgttttgttttgttttttgtttttggcatcacctgagcatctaagtctccatcagccatttgggagtgtttttaaaaatatttatcactgagttacaaatttagagagcaaaagatcttaatttaaatttggtctgtagttttattttcttctgatatctttgtgtttggttttggtatcagggtaatactggcctcatgacttgaagtgttccttttatattttcaaagagtttgtaaaggattagctagttctttaaacatttgttacaagtcaccagtgaggccacgtggtccggagttttttgtgtgggggatattttttgttttgttttgagctgcagtactgtgtaggaaaggggtcccgatgcagaccccaagagatggttcttggatctcacacaagaaagaattcagagagagtccatagagtgaagtggaagcaagtttattaagaaagtaaaggaataaaagaatggcttctccatagacagagcagccctgagggccgctggttgcccattttatatttcatgatgatatgctaaacaagagctttatcagatcttttctgagcatgtgcacagcccacacatgcactgtggcctcctagatcccatccaggaatatgtcaagttgtcagagctctccatgaacatctcattctccagcttttccttataaggtttttagttagtctcttgtttgcctaaactgttatccttaatgtttttgacaattgcttttggagaaaaggctgtttgcagtggatgagctcttggtcaggtcaaataaagacagccatgcgagtgtgacctctgaacaggtcagctaatgacagttctttgggaatggggctttgaagggatggtaggaggggcagattggaataggggagtttaaagcaccacagaactcactgttcttactgagtttcagctgtttttcttgaatgcattctccaatttctgcaagcctttggttaatttctaccgtattgaaaaaactggccgggtgcagtggctcatgcttgtaatcccagcacgttgggatgccaaggcgggtggatagtttgagcccaggaatttgagaccaggctgggcaagatggtaaaaccctgtcttaacgaaaaataaaaatattagctggacacggtggtgtgcacctgtggtcccaggcacttgggaggttgagatggaaggatcacttgggcctagggggctgaggttgcggtgagccaagattgcaccactgcactccagcctgagtgacaaagcaagaccctgtctttaaaaaaaaaaaaaaaaaaaaaaaagggctgggcgcagtgcctcatccctgtaatcccagcactttgggagtcccaggtgggcagatcacctgtggtcaggagttcgagaccagcctggccaacatggtgaaactccatctctactaaaaatacaaaaaattagccaggcgtggtggcaggcacctgtaatcgcagctacccaggaggctgaggcaggagaatcacttgaacccaggaggtggaggttgcaatgagcaccactgcactccagcttgggtgacaagagtgaaactccgtctcaaaaaaagaaaaactgatgctggtgattgtttgccagtgtaccaatgttttttgtttgtttgtttttcatggtggagaggattttcagaggtctttaccattttcactaatgtcacgtttctcttcattaaatttagtgtttgtgggactcttgataaaagtggattactagtcgtgagtagtacagtctgaatgcaagacatggatatcagggctcctcaagaactcattttataattaagaatatgaatgacttaggccgtgtgtggtggcttacgcctataatcccggcactttgggaggtcaaggcaggcggatcacttgaggtcaggagtttgagaccagcctggctgacatggcgaaactccatctctactaaaaatacaggtgtggtgtacacccctgtagtcccagctactcaggaggctgaggcaggaggattgcttgaacccgggagtaggaggttgcagtaagctgagatcataccactgcactccagcctgggtgacagcgaagctgcatctcaaaaaggaagaaagaataagaatgacttaaatcggctgggtgcggtggcttacacctgtaatctttgtactttgggaggctgaggcaggtggatcacgaggtcaggagatcaagaccatcttggctaacacagtgaaaccccatctctactaaaaacacaaaaaaaaaaaaaaaagaaaaaaaaaaaattagcccggcatggtggtaggcgcctgcgcctttagtcccagctactcgggaggctgaggcaggagaatggcatgaacccaggaggtggagcttgcagtgagccaagatcgggccactgcactccagtctgggcgacagagcgagactctgtctcaaaaaaaaagaatgacttaaatctctctctgacctccatgtgtgtatatgcacttatgcacacatgcttatatacatgtagctagtaatcagctggttcacaccagcacagctgtaccagttgttaggacattgaaattcttttattttgtttggtacattgttactgtcccaaccctcccatatctttgccatcactccccaactctaattgaaatcccactatatggcaactaaaccagcagtgaccataaggactctgctccatcctgattggtcagtgcttatgttgtgtagttgataaacgtgttgtacagatttgtgtatgtgtgtttatgtgtgtatgtggtatatatgtggttatatatttatatatgtaatattgggtctatcatcacacatgcaaaccaagccacatagtaagtaaagtctttttaaaaagttttgagtgatgagaagtgccctttagaggggtgtgtgagtgtgtgctttccatatatacatgtacataacatagtcattcctttgcctcttcccccttttcctgtgtttgtggcttcttcacctcttctacctcca

SEQ ID NO: 190 - DNA, 88819 bp, Homo sapiens
tggaaactctagtgtatttatcgcactcttacaattcttttgttcagtcagcatctctcatactgtattttgattaagctttatgctagacacttgctggtcactatttatagtttcaaaacacctagtttgtttgtttgtacttaattctaaaacatgtaaataatgtcttttcagaacttttttagaaaatatgcaccaagtgagaatgggccaaatgggattagtgctgaggtcatggacacttacgttaaaagctgtggtaagtttttcaggctattactttccattgatcagataaagaagagcaggccatcctgatattgccataatcatatacatttagaacatgttaatatttaaatgctctataggaagagtaaaagataaatgttgattaaagtagtcattgatgctttgacataatagtattaacaaggtgtaaattctatttagtctttcatggatatatctttgtaatcactgaactattttataatcacagtttatctcttcctggaagctgttaattttccattagattttctctatttttgaataacagaaactaagtagaccatgggaaaagtttcaatcagaaatgattgtgctttagataaagtttaagagctaagataatggtgcttcattaagagggtgcccttgtggtattttagagtcagtccttatggtccattcctagaaataagaaagcagtagtagtatttcctagaaataaatagtaagtgacatagggattaatttttattcttcaggcatttatgtctaacttcacgaaggttatattctacaggattttttttttcattttctttatttttttcttttcttttcttttccttttttcctggagacaggatcacactctgtcacccgggctggctgaagtgcagtggcgcaatcacagcttactgcggcctggacctcccaggctcaggtgattcttccacctcagcccgccgagtacctgggactgtaggaggtgtgcaccaccacacttggatgatttttttgtattttttgtagaaacagggttatggcatgtttcccaggctggtctcaaactcctgggctcaaacgatcaccacctgctttggcctcccaaagtgcaaagattgaaggcatgagccaccatccccagcatgtttatttttttattttgattttttttataactagattgtttatgggaggattggtaaaggagttgacactagagttgagccctgaatgacaggatgtatgatgtgttataactattttatataagcgctatatttgtttatgtccctatttatgcctatgcttaagctgggagagcaagaagagggctttctagttagttgttaagactatatttaaacttgcatattattttctggtttagaagttgctttcttatacataatatttttgtgtttttcacaacacccctgtgaagtcaccttccaaattattttggaccttattttcaaatttattcgtgatgatacatttttgtctgaaaagcagaaagaaaatgaactttgagaatatggaaataaaattgtgttttataaattagagtcctttatagttttaattcttgtttttactataggaatataaacatatattacatgtaactgaatttgtttgtaaacgtgattacatgcagtatttaaagacttaaaaacactgaagattttgagagaaaatgtttacccttgtcctcttactctgtgtttctctctcttcccttgctcctttcttgtttctcttctttattttgccccatttctcttctgtttttctcagaccttcaagtctatgttttctgtgatctgaaaaaaaattgcatatcatctaaaggctcaactaggctgaacatccaagatggatcactcacattattggcagattatactgtcttagctaggcttattgtgaatcacctacacatgacctgtccctggcttgggcctcttagagctgggttccaagagcaaatattcagacagacaggaaatggaaaatactagtttctgaaggccagggctgggaagctggtactatatcagcttatagtataactatattttgttatattctgttgttcagagcagtcctagagccttcctggatttgaggggacggaatatatatagatccaagctctggatgaaaagggtgtcacagaatttgtggccatttccattagtacgttattacatgaggtgttttatatacccccaaataattatcttttacctttttactatagcatagttattgtaaaccttttaaagtcataaatctgtttaataaagaaatactttttccacacaaaatacatacacacacgcttgccctgtcagtattgactacaatttgaaaattctgctcattagtaaaattatcagaatggtatgttacaggtacatgcttaatgtcgtaccattgtgtcttttgtatagtggtccattttccccccaagagctactgaaaatatgactggctttttcatggggaaagaatagcaatttaaattatcttacctattggacagttaaattcacattatatcttatctctccccttttttccaacatttcacatgtattcattcctctgtaagtgatttaatggtaggccttctcttcatctagaagagccttctgttttctgtatggcttcctgtatgacaaaataatctgtttttgtgtaactttcattttagaaaataatgttttaatgtttttgcagggtgtaagaaaaaaattgataatagttttggtgacatcttttccagattatctaaagtctcaagtgtatatcatgcagctaaatgtgggaatactgtttattctcacatacacacatatctttactaagtaaagggaaataggatcagtggtctatttgtctttatatttttctttaagtcaaagtttttttataaaaacaatttcaagatgttttgtatctcacatggaataaaaaaactaacaacattgttttgacaagattttcttggacagaaatagtgtttccattgttgtatagttaaagaataacatcaatttccctaaaaattttctagcaaatttatttcaggtcatcttaaatcattctgagtattagttatctcctcaacgtttctgaggatcatcccattcttacctcaaatgttttgttgttatttttcaggatgtagccttgtttaaagtgccctactgagtattgacactttaaactattgaagcactctaaattttcatctttactattaaatatggccatatgttgatacatatatttcacttgactaaacatgtttatcagaatgaccatccaacgtatttatgaccataatccactgagccagggcaaaagacccttacttatttttgcatttccatataacaatgaaatgcactctcaaatttgatgatgagtagtttatagaaatattttgctttatcgttaggattaagcataattcatgtatatccagttacatgaaaattttaggtcagaattaactgttgcaacacaggtgaatcagtattctatagagatagctaaacttgaaacaaagtaaatagtgacaaaaactaactgtaatttataatttaaaaatgggaatagtaagtaggtctggattgaacaactcagctgcactgatgtacagtgatgttatttttcaaaattgtaggaatttcgcttgtcttcatatgcacattatcggtagtttagtacccttgagtggcaggtagatttctacgaatcacatgttagagaacctaagtgtactaagttctcatatgttctcagggtattgtacttagtttctctttaggaatatcaaatttaatatccctcagtaagtcacttagttatttttcaatggggagtctgtagtcatttttgaaattgcatgtattgtggcagttttagagcagtgctacttaaagtgtgatctgtggacccacagtattgactttacctgggagcttgtttgtattacagaatcttgggccttacccgacttctgtgatcagaatcttcattctaacaggattttcaggtgattcttatgttcatcaatacactagagtttagagaaggcttctcaacctttggtgtgcatagtaatttttgaaagcttgttaaaatggaattgtggctgctgcccctaaaaattctgattcagtaggactgaagtaaggctgaagagtttacatatttaataagctttcaagtgatagtgatactgccagtctgtgggatcacattttgtgtagcaatgctctagatcaagggtgagtaagacttttctctaaagctttgcagatagtaaatattttaggcttttcaagtcagatgatctgtgtaaccattcaaccctgccattgtaatgcttaaaccagtgtgtaaatgaatgagtatgactgtgttcaaataaactttacaaaaactgaggggaaccagatttgaccatcaggctgtagtttattctcccttcatctagataccctttaagtcctcctcagtggaccactaaatgttatcattgcatttagctgcagttaacataatgtacctatagtgatttaatcataagagtttattttctcttttgtgacaaaactagttataagaaattgctgttgttctaactatttaaggtgattaggaccaggtgaaggctctgtgtttctctgtgattctcttgcccttttccttatggtctgcaactacagtcatcatgtcgcaatctagacaggaaggagaaaaggcctaaagggctaacctcctagctgagtcagccgcttgcttaaaactgctttccttgcatctatatttgcttacatttcattggacacaaatcccagcccagtgactttgaacaatactattaattcttggagcctgaagtttttcatttgaaggatggttatctacttaactggcatcattaaacaggttagaaatgatgaatatgatatgcctagctaagagcctagtcttcagtacattgtaactgtgattattattaattaatactatttttccaataattatgccattgcttaagttgcttttggacttctggaatggccttcagaacctaagtcaaatgaactttattatttattgaatttgaacagggttataagttcattaacaggtggtcccatcttgtttttacacatgggctgaaataaacaggtttttgtaaatattgctatagttttatatgtttacaagttgtgtttgttgtcaggttattaatggtagaaataaacatagttaaaaaaacaaactccaaaagggtgctatttgctaaattctgtttaagtagtttcaataaatgctaaatttccagactttttttagaataaaaagataacagaatacagctagagccaatgtctttgcctttagccttgatcatgtaatttttcttaatgctttagaagattattgtgttaacttcataaatgtctttaccactcaaatgaatgcatttggttttctatctgcttccatttcaagattatttttccacagacttaaaaaacaatttaaccctgcatttacttatgttatcttacagataacatggttacgagttatgggataattgacggttgacttttaactgtgtccaatttgatattagaattgctaggcccatgttataatttaaggtctcctgaacctaacttaagttttgatgcaagtgacttttgtaatttaacagaattctacaagattttctcttttaaatagtactttgagtttcaagtgacagacatgaagattgcatatttgagaattcagatgagaaaccagagacattagaaaacaaattgatattaaagttgcacaaactgcttttatattcagtagaatgtataacctggtttgcatttgttttcacatattttttttaactgttactgcagctggatattgcgtgatcacctatatacttggagttggagacaggcacctggataaccttttgctaacaaaaacaggtaacaattaatgactaccagtagacatacattgtatatgcccatggtttttacccctgaatctatgtactaacaagataagttgcggcctggcgcggtggctcacgcccgtaatcccagcactttgggaggccaaggcgggtggatcacctgaggttgggagttcgagaccagcctgaccaacatggagaaaccccgtctctactaaacacacaaaatttgccgggcgtggtggtacatgcctgtaatcccaactactcaggaggctgaggcaggagaatcgcttgaacccgggaggcggaggttgcagtgagccgagattgcaccattgcactgcagactaggcaacaagatcaaaacgccatcttagaaaaaaaaaaaaaaaaagatgagttgcgtaattgaagataaatcagagagtcttaaaaattcctttaaatgttaccttggaagaacatttagggaaagtcctttcccttttaagaattgctttagtagtaatcctacagatggtcattttgcccacacttctgtactggaaaatgcctctttttatggaaagccaataatggatacaagtagcttagtctcttactgtatagctctagttagattgttaaaatgtcctttctcttacaaagtgtgcttaattcactttaatatctacctttaattatttgcttttccccttggagttctatgggataatcattctcagtcccctttgtcctgacaactctttagccctatgtatttatctttatgcagacagcttccagacttacagctttttacctcagtccatttcattaacttcaaattgaaatatcgaactgcttacttgaaattgtcattatatatggccagttgtaaaaggttgtcctttcctctactacctgcctaaaacctgtttctcacctcatttttccatttcaatagatagcaacatcacctacccagttgttcaagctctagacctcaaagtcattcttaacatgtctcttggcctcatctcatatactgaacctattagcaaatcttgtctactcctcaactccaaaatagatcatgaagttacccactgtcttcatttttactactttgaccccacttgaagcaaacaatatatgttgcctaaacaatttgaatgaaacctgaaccctttattggggccttgtggcttgtccaggcaggccatttgtctgaatgtcaaaccactcctgcctcagacaagagcctttgttgttttctctttctggaaagttatttattcagatctttgcagggctgactttagttattaagttgaagttctaatggcatctctttagagaagccctttctaactccttgatctgtaataacatatctgccctcttcctccaatgctctctacttattactgtattgtttatagcacttatcactagctgaagttaccttttttgtttaattcaacaactatttattgaacagctagtagatgctgggaataccaaagttaacagaagagacagaaatccttgctctcctagagcttgttgagttcttatcatcatcttctccccttcaggatgcaagttccatgagagcaggaacctttgtccattggggttacccccatgcctctggaccttgaacaccacctagctaaagtgttcaataaatcagtgttgaattaatgatgaataaatacttctgctcttccatgaacctgtctgggctaaataattcaagtttcttccgctttctgcagaaagcagatgtttacgttactctttaaattggtctctcaaaacattttctgttttgtttgtatttctccaaattgtgataataataatttaacataatacatcaagaataatctattaatataatggtcctattaatttataatttggaatgtcatatattcagtttttaattattacatatgaaaaatcatctgttagaacttgcatgggtgatgtcatgtctgtgtcaaagccagtcaatctccttaataaccaagaccaaaagaatataatcagagtgtcatgcagattcttggctgatttgctcatttagcagaggatatttataaaacattatggtgtatttggagagaattgtaatttggaagttttcatgtgttattttcattagctcttttttattggttgaatcttttaaccacaagaatcaagcaaccaaaatgattccatttttttccagattgtaatcatttacaactacaatggaattctttaatataaaaataatgctaaatgacgagttaatgggtgcagcacaccaacatggcacatgtatacatatgtaacaaacctgcacgttgtgcacatgtaccctaaaacttaaagtataataataataataaaataaaaaataaaataaataaaaaagaatttgccagtggaaaaaaaggtagtattacatctgtaattttatattcacaagttctacttgattctttttttggaaattgataaacaatcagacagtgtaaaaaacctttttctgttatactttgaaaagtgcccttgtgtgtatttgtgtgtgtgcgtatgtgtgttttgatgggggtatttaagagtgaaactggaaggaagaatctgcgtaatacacttttttggcccaggtctcagttacttgtttaatggaaattgaattaaatttcagaaacagaagctttaagcttttgttaacagttttccactagagggtgctccagatttgctttttcaaaaccaagattttaccctaaaacgtgcataagtaagatgcacatttttttcctattaaaacagcagttcattttttcttaactgctctgtaattatttcatccagttacattatgcagttagcattttatatctttcttactggatacatgttttcaagtttttagttttggtttggatgaaattagattctataaggagagactgagtatgtcaagacaaatagaagtataatgcattcttcaagttctaacaatttataataattttaaaaagtttgtgtctctagtcatttttactgagagtttgtatttcaaagtggttttaagttacatttcatatatgttataaatagactttgtatagttcaaagtgaattttgaatgtggttcagtgcaggaaatatattccaatgtttttagtttaaaaaatgcctcgactgtcatgaagacttgtccattgtatattttgagtttattatgccttcaaattgaaaactttgggttctcttacataactgtccaatctttcaatggctgatggagcattttttaataatcaagtaacatttttcttattctgcaaaatacaatacctttgttttctgtactcctttgccagcccaagcaggtttagagtctaagattctgctttagattaaagtggttttgaatttcaatcagacttccactgtttcatctgtgtccagttctttgatatgggggatggagcagaagaaggagccacgcagatttcatttcactgatattttttggggacttaaaccagacaaactattctaccctgtaaatatagatgaaatagaaaatgatccagctaagaactctgggcatgtgaaagaaaatgattcgctgcatatagagaatgtcaaaatctatacaagagtaatgttctcaaatgcaaaatattagtctcaattatggatttcccagacctttttttggcccatgctttgtttttgaatacttctagcttggttgaagtttactcagcttgcacagcagagggcgctgtgtatccaccataaatgtaaaagtgtagcgattgtattgtcagtgtattgtcatgtgattaattataacgctgttttcttgaaacaagtttggggtgaatgatattttacttattagtgcattactattgaattcttttttcattattactatagaattctttggacaagaaattacaaagctaggctgtggtgtggagttgaaaaataatagattttttcccaagaatcattgtccttaggagaagctttaaaaagcttacttagggcgatcagttgtgacaggattcaaatgaaacatggtttgagtttatcccagctctttggagaaaggttaatttttttgtttttatttttgggagtttgaggaaagaggggaaggcagtataactgaaaaatatgttcactgcttatggtatactttttaatgcaatcagtatttgaaattcatttgtaaataactgaaaaatgttcacaaaagtaaagagggaactggtatctgtactaaatggaaagttcattgtgagtcctaaggatggccctcctgatcttgagttgccatttgtgagagaggtagtagcttttctgtctgccttgccactttagagtaatacactttgaaacttttctcagaaagctcaacataaagaaaaatggttattcttatttttatcttaattggacattttctttcaatatagctcctgtaatacagggttctctagagggacagaactaatggtatatatatatatatatatatatatatatatatatatatatatatatatatatatatatatatataaaggggaatttattaagtattaactcatacattcacaaggtcccattataggctgtctgcaggctgaggagcaaggagagccagtctgagttccaaaactgaagaacttggagtcggatgttcgagggtaggaaacattcagcacgagagaaagatgtaggctgggaggctgggcaagtctctcttttcacatttttctgtctgcttttatcctagctgccctggcagctgattagtttgtgcccatctagattaaaggtctgcctttcccaacccactgactcaaatattaatctcctttggcagcaccctcacagacacacccaggatcaatactttgtatccttcaatccagtcaagttgacagtcagtattaacatcacagcttctatcctgattttctgtattattctttaattttatgtgaaaatgattattttttagaccaagaaacagtctttcagagtggctaatttgtttggctctaaaggcaaatttttgcatttattttgcccctcccccattgggtgactttgggtaagttacataatatgccagtaactcagtctcttcttctgaatctgtaaataataatagaacctctctcctagtggtgctgtgaggtttgaatgagataagtagacttttgcttggtattgagcacataataaacattccttaagggctattaggttttctttgcttgtttgttttaccaccatgagatgaataatgcctttttttttttaaacttatgtagttcttatttggactcatactattagagagaagaaaatagttaatatatttcaaaaatttctttttcccacttgctataatttgggtatttgactcctccaaatctcatgttgaaacttcatccccattgatggagataggatcaaatgggaagtgtttgggtcatggtggtggattcttcatgaatggcctggtactgtgctggaggtaatgagtgagctcttctgttagttcccttgaaagctggttgttaaaaaagagcttcgtacctcccctctcatgctactatgtgatctcagcacatgccagctccttttcgcctttatagattattgatctttgatactgaaaactattattgaaaaatattgcatcattgtgcttttaactgagtgaaaatactgctaaccaagtatattgtaagggtttaagtaataagtattgggaacagagagtgggagtataaatgtagggagcctttttaattctgaaaatataggttttgctataagaataaattgctgtttgctaccttctgtatttctaggtttagtgatagggcagtaggaaagatacgacattcaattaagacaaaaggcattttatggaaaaaatggtaaataaatgccaggttatatataaaaaattgaagagtgggaaactcactggagtaggatgtcagggaagaatttttggagttgggaattatatggaatctttaaataatagagtttggattataaggaacagcagaagaaagtcaagtagaaggaggagagtaagaagaggtatgaaaaacagaatgaatacagttttgatgttggacacgtttaattattaaacaaaatggaaatttaaaataaactttaccattaaatactgtcaaagagaatagtgtatgttctctttaatccaagaattacagatgcctcaaactacaattttagaaataagttcatgttatttatgcaaataacaggaaaatgtaattagcacctcttactccctatgttttacaagttggagacaaaaggaggttaacaaccagtttgttttatgtatactttatttcttgactgtttaaggtggtagattcgaataagatcatactctctgaacttcttaaacattttttttaaatttcattatgtgtattttttgaacctttacaaattgcattttcaaatattaactttaaaaaaaacattcccttcagtatttatgaagatgaattttcttaaaacattacattaataggctcttttgaaaatacatggctatttaacttgtaaagcataatataatttcattgttagatactgaatcttttacaccttttaattaagtagtaatcctgttgtttgagttttctgacaagaaggatagaaatatactcttcgtttgtaaacagtgatacatagccaatattggaattccagtaattcctgtcatgaaatgaagaaaactgggataggtttcgtattaaaagcatggagctcattaaataaaccatgcatgatggcagttttgtgtcagagattgaccggattggtcatctgttcaagtatattggtaacaaaacattatttaaataattaaataaaaccaaggaaaatgtatctacacctgtaatattgtgagcttcttatttctttacctcttttggggcagaatcatgtgtatccaacaaggtaaaagatatatgagaacttcaaaatgagaataaagtaccaaaagaattgcttagcttagttgaacagagaacacatatttagttgaaggtggtaaaatggttaacagaaattgatcatggacttttcatcagttcatggaaaactgaaatcatagcatactccccttgaaccttaagagactatagggatgctgcttttccagtgggtactgaagttgtcaaattcacttttgtaaaactggttcctcatatttgttgaattatggactttccttgggaatctggtgaagtatattgatctccccccaaaatcagtttcattgtacttagagaccattaaagcccattttgggattctgaaagagtagtttttcagtcataaatcattcagtagtttcttttaatagaaatgaacccccccccccgtgttgacattttatgatcttaaatatgtacaacgtgaaacctcataattgtgcctactcttacatactatacaatgaaaacagatttataaatcaatgtgttacagattagtaaaatttaacaacattaaaatgataggtggtatattattacaactaaattgctatttacatactatacaatgaaaacagatttatactatacattactcttactatacaatgaaaacagatttataagtcagtctttcttacatattagtaaaatttaacaggattaaagtgataggtgatatattattgtaactaaattgctatttatgctaagaatatggtttttaaaatttttcctttctaaaattttttttgagtaataataagttagcagaaggattcatctcaggaatatttaaagaaataattttctactatatgaagggcactgtgcttaaactttagcacaaaaaattttctacaagattccactttctgctgataccttaaaaagttacccaggctctgaccgtctttgattctgaagacttataaataggatttaacatttttagattaccattactgtgacatgattttaggcatagtttcgtgtgaacgaatgagttaaaatgagttaattatgttctgaaggccactctcaaacctgcagttagaaatatcgaagaatttaataggcttcatcgtgaactaatattctttatgaagagacactgtttatatcaattgtgtgacatatcacctacccagttctttaagataattctggaaacaaatgagtttcttgtcaacatccaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtaagttgatttgcttggcacagagaatttgggtaaatttattttattttatagaacaagagaatttgtttaaatgtatgcattctttagcattgatcactttttcaaaatgacaaaggcaacaatatttcctatcttacatttaataccaattttgacaaactgtcaaatatcaaaggaaaaagacataaactttcttgctttcccactatcttattactatatcccaccagctaggaagctggcatcacataagatgaagcaaacatggaggcttccaactcaatggtgttgatgtcactttaataaagtatactttgacagtactgagatagagaaaaggttaagaaacttcataccattcagatctgcctgaagacagtcctggagacttccttctccctagctgacttcctatttctttatcaaagaatataggatattttagagtgatattagttcaatcatttttattctttagcagccttagttttgggtactcttcaggaatattcagaagtttgctcaatgattgtggtaaatgttaaatatgatttttatctctttttaacacctcatcagtcattctgctacaaaaaaatgttttttctccgtccttttttcttcaacaccactaaatctgtgcttccttcttgctaatttacttaggactgactatcatatgtcatcaggaagaaaaataaaagtcatgtttggtaaatttaggacatggctctgatgattattagtcaaaaatgacaggatcatttgactcatgctattttcagcccaactatgcaaaatgaacttttcttagtccagcagaaaatcccagtccaggaaacatacatacatgctcttccaggtgaaaatataaccaatagatagccagttgcctgtgcacatgggttctgtttcctttgacttcataacctttgtgacatcaattactcatacagtgtttagtacataggcactcattgtgtgtttattcattgagaactcttcgtatttgtatgagaaccctccgaattcctgctttgagtctagtgtgaggccatgttcccagttaatgttgatgtgttggtcctaggagactggttttcttacagtaatggggtttcatttatgcactgactaggtcttcattgtaaactcagtcttttccatgtatcacaaacctgtaacaggcattttacaaatggccatgatatttatcctttgggtggcagaatggctcagttttaccttccagaaatgccaaaagaataatgagaaaatcagtgctctttagatttgtttggtgatgcagaagcactttcagagagatgagagtgccatttaatatctgcgatttttaatttaaaatagtcaaagcccatagaaaactaggtcgaaccatggatatctcagggaggtggcggacaagatggtaaggaatgataactagagaaatgtcagaggtgctctatcttattgaaagcagaaggaaaacaatgtggtttataaactgtcattggtagtggattagtagcaattcaatagaataagaaaacaggcaggttattaatggagagccaaggttgacttccttgctacaaagaaaagccacagagagattaatctaaataattttatgcagagttttaatgaaaactgtttaacttttaaaaatttccctgtacttaatattatctggacctaaattatttgatcaactttttttttttttttttgagacaggttgtcactgtcgcccaggttggagtgcagtggcatgaccatggttcactgcagtcttgacttcccaggctcagatgatccttccacctcagacttgcaggtagctggaactacaggcatatgccaccatgcccagctaattttttgtgtttttttgtagagacggggtggggtcttgctatgttgcccaggctggtcttgaactcctggattcaagctgtctgcccaccttggcctctcaaagtgctgggattacagacataaacccatcgcacctggccaacatttattttttaatgttgtatttcagagtatgttttagttggttgaaaaaatgccttcaggatataagaattaacctgatagttgtttggagctaaggttatcggcacttttattaagctattagatatgatcggccctgttattttatagtttttcttgataattgatcagtttcttcacaaagaatccactgaataacattgtaccacataagcagagtagtccatttgaacttagttataaatggttacaaaatacattatcatctcttattaatcagtacatattaagtctttctcccaacccacacttatgccaaacaccattcttagacactgatgttacaaagatgttctttttacattttttggtaaaaattttcaatagtgaaataaggaatacatttaccagctgggcacggtgactcactcctgtaatccaagcactctgggaggctgaggtgggtggatcacttgaggccaggagtttgagaccagcctggccaacatggtgaaaccctgtctctactaaaaaagaaaatacaaaaattagccaggtgtgatggtgcacgcttgtaatctcagctactagggaggctgaggtatgagaattgcttgaacccgagaggcagaggttacagtgagccaaaatcacaccactgaactccaacctagacaatagagcaagactctgtctcaaaaaaagaaaaaaaatttaaaaaaatgtgtttaactatcaagtaaggttctcatattgtctcagagatgtttgcctagtcaccaaacatcagtgaatttattggtcacatacatcattaactacattgcttcccctctttgaagtagtacacttattgaataacactttcacaggaactctgattttgctgtcatggaaaatagaatgtagaggaaatacatttgaaatactataagaacctcaatgtagttaatggatttctattttcagtaataaaggtttttcctgaaaaatttaaactatctttgtgtgactagagtgtagcacaatagttggcatgaacgtgggtaagagaaagagtgcagtttccttgaacattacatgcaacctgcttctttctaaaaatcctaattatatcacattccatcttgcaatctttgctagattttgcacgctttcccaccctattattgttattattattttttatcttacccttaggttgtctaatactggtttgttggccgggcagggtggctcatgcctgtaatcccagcacctcgggaggtcgaggcaggtagataacttgaggtcaggagttcgagaccagcctggccaacatggtgaaaccctgtctctactaaaaatacaaaaattagcctggcatagtggcactgcctgtagtcccagttacttggggggctgaggcaagagactcgcttgaacctgggaggtggaggttgcagtgacccgagatcgtgccactgcacgctagtctgggtgacagaacaagactccatctaaaaaaaaaaagtggcctttaaatttgtgtttctgagtaggacattaaatgactgtcctatgaagtaaacacttggtattttggttcacttgatgtatcttaaatggaaaattcaggttaatgacaacagatgtaaaagattaataccaaaggtagtgacaaattattcacaaagtatgtggatatctaacctttatatttatttctgtttccctttgctataacaatagaagcgtggatggttaaatttaaatcaggaggtaatccagaaagcattagtatttacttttgttaaaaggaacatcgcattctacacccgtaaaggcagatttttttttttttaacattgatcctggctgcccgttagaatcacctggggagcttgtaggtgaggtggcaaggggaaagttctggactcgctcatatttaattggtctgagattgggctcaggcattgatacatttgaaaagctaccaaggtgaatctaatgggcagccaagttggagaacttctaatatatctctttcaaaactgactttgtattctccttatgttaccttctggtagatttccccatgccaagatgggaaaaaattatgtacctatgtaatcaacaaaacagagtacgaatgatggagagttagttgaaagagcatcttttttttttttttttataatatgtaacagcggattgtacgctgctggcatcacattccttgaagccctctcaagtggatcatctctatttccatagagaagggcttatctaacctgtggcccccaggccacatgtggcccaggacagcttagaatacagcccaacacaaattcataaactttcttaaaacattatgagatttttttttttgtgattttttaaagctcatcagctatcattagtgttagtgtattttatgtatagcccaagacaattcttcttccactgtggcccagggaagccaaatattggacacctctgatgtagaaccttcattatcattataaagggtttcattctggacatttatttttgcccacccctcactccccttaccattttcatccagtcctgtgactttacgtatgatcctagtgctgatgactttaaactaatatcactagccttcatatctcctctgagatatatctgacatctctactaaaaatctagtaggcacctcagactccacatgtctaaaacgaaattcttgaatccctgcctaaaatcctgttcctcttccatttagcctctcctatcttggtgaataacactagtgtcctattaggctaaatcctttgtgtttttcagtttctctatcctctcaccctgacctccattgaaaccatcagcaaggatcatctatttcatctccaaaatatagcctgataacccccatgttggttcctgtccacctggaagtctatgatatagtttctctactttgattcttactcccttcaagatggccagtgtgaactgttaaaaatgcctatcaacgtgtgttactccactccttaaacttagttgcttctcagtgcatttcaaatacaactataccgccttaagatgcctctctctcattttcccattttcctgttgtttttttctcttttaaatcttttaatcaagcagacataaaattatcatgtttatcaattcattatattagtttacaccctcctccagaatgtaaacttcatgaatgtggggaccctgtttgttcagttcaccactgtctgtctgtatccctagtgcctacaacagtggatatagtgagtactaagtaagtgtttgttggttgaatgaataaaatgattacatgagtaggaatggaataacatctgtggtatgcatttatcaattcccacaaagaaattagtaatttaaagctaggttaaagctgtttagctattatcataactttttgttcctaagagtttaagtgggttagggcctgatttgattagactacatcaaggtagaagtttttcattataattcctcttgatttttattggcaatataaaattcagaaatgaggataaaacagataatttgaaacttatatggatagtcatttttctataaaagttccattatcattacagtttaactgttaaacatttaagtattaagtaacagttcgtattttattattattattattatcattatagataggtagatagctggaataaagatcctacatcacccagatcctgcccccatcccctagagaagacagtgcaaggcgcttggttgacatttttactgaaacagctaaaacccttcattgcctaaaaccaacgctttccttacatccatcctgaagatcaaacctgaatctctttttatcagtgctaaggaggggccactaagagcataactacccaaagtggagaggtcccagtggagatttatttaaaactttccccagaaggccccacctctggaaatgaccattcagaatagtaacatttgttctctttggaggaagaggaagagtttgaggattggtgaagagaaactgttagttcctgttggaggccagcatactctgaagatatcattatttagatatcttgcccatttttaatgcagcagagtactagcaattttttctttcttatagaattacttttatccaggtcagtcactgtagttcctgaaatgatgattggtgtatctggaagatactcaggagtgattcatgggatgattttatttccctttcattcatttagccatgacacactgaggtcatcttaaagtagcagattgttatcttcatctagcaaaaacagatagattttaattgttataaaatgtgaattgcacataaagtagatcttcctcagatcccttctaaaatatatatatatacttactaaaaaatgaaaagaatgtcattattagatgattactccaaaggtctgtcccatggtgtaggatttagaaatggtgttatacgaagaccccaaaataaaatatttgtcaaggcttgcatttcattgataccaactgatgaattttctgctggaataatagtaatcactgtagaaatccaagtaccactacttctaaagtattcttaatatgagaaagaaatgcagaattcttaatcgttgctatttttttcttttctgctcttctttaggtattctaatctgattttgaacttgttttccttgatggttgatgcaaacattccagatattgcacttgaaccagataaaactgtgaaaaaggtaatttttaagtaacataaatgaagagctcttctgtataatttttccatattccagaatacaacaacctctcaagtctctgcagccagttttatccccttccttgttcctgcccacagtcacatgaataggttctctcatctggagagacagtttgcttgctactccagccctgcagtcacagggaggaggaagcagcagcccaaagcttaaagaactgagcagagttttcagctattgtccatcatagggaggatttattttaaaattgaatttagccaagttaactgccagctacaatgaatcttcacaagaacacaacagaattcatagtctctctaacatatcatttggaatgtctattatctctcttttttttaataactagatgtgtgaataaacagaaaatgtgacactaagccaatgaaaaaataaaacaatccgtagaaacaccctgagatgacccatgaccgcagaaaaggactttaaagcagctgttacaaatgtccatgcacctaagggaaaataaatgcataattactgaacagataggactatcaatagagacattaaaactaggaaggaagaacaaaatgaaaattatggaactgaaagtacagtagctaaaatgaaatattaattgggtaggcttaacagcagattgagttatggcattagaagtcagtaaacttaaagataaatcaatagaaattatttaatttacttccacagcttcactgcctgtggaggaacaggaacgatgtcaatcattggcaaaataaactaaactagatcttctcatatgtctccattcctatagaatttccctgtatccctgtaaaggactacctcaatagatctgtagtttccaaagatggggatttttttttagttcatatttaaagttgtggttaatttacaatagccttaagtattagaacaattagtgtatgtgttaagaatcttaagaacctagaggacagcctaacataagtcagtaaatctgataccaaataactatttatatacagttaaccctttggtataaaagagaatattttcatatttggtaaataacatttttatgccaagtgtataccttctctttgtaattcaggcacttatgtaagtatgcaagctttgataaattgggctaaagtttattttgattctcctgctctgtagattttttatttccttaaaaatagttccaaaattgtcagatattctctctgtaagtagaagttaaggaaatcaaaagatcgaacttaaggaatatgtttgtcattatctgggatgcagacatgagagagctagttcattgaagatacagccttagatgttcctccaccaaattgttcttgtcttcacttcttacatttacctctcttttacctcctgctatcttgtggctcaagcactctcagatcacctggtatacctccagtacagtgaagagacaagggcactgagctggggctatggattgttgcactgtttgtcatttcttctttgtagctttctagtagtgaaaccctatacttcaaacactaaatggggaccacactttatccacttggaatccccattttctcctagcctgtctttgagaagtatatgtgggttatttacaagagaaaggagtagtctgtaatggttgtgtgtggtggcgtaggattgtctggaagcatgtgccagttaagggttcttgagccggcttcgtgaattctctgtgcctcaatttctgcatattatcgatgagatattatctactgtatgtttgcgtatcagtcggatgaaatgttgcatgtataatatttggcatggcattttgcacaaagtagttcttcagtaacattgacttttatatatatataaaatatacgcacataaatatacatactagtttttctagtacttaatgctactgaaaatcaagtgtagctttaaataagactaaaaaaattattttatctttggaaacgatagacctattgatgtagttttgtgtggggatgtagggaaattcaataggaaaggaaaccttagaagatcacatttagtttgtcagtgattgacattgttcctgttctcatatagacactgaaggtatgggagaatattaatataatctcaccttgcttcatccaattcacaaggaataacaggaataaagtggattattaataaacattccacaatttaaatcatatatagtaactctagattttagattaaaaaaaaaggcacacctttagttaaaagagcagtttttctgtttttgagatgtagggccctaagaaatatttcttcttttcttttttcttaaaaactgtttacaaccaacaagaacaaggtgatatacagagcatataacaaaaacagcaaacttccacactccaaagaatgccattcagaattctaataagttacaggtcatttatttgccataggaatagctcatgttaccttataatgtctgcatcagtttgattctgcctgttcaaaatgtgccctatttttcttcgttgtaaagactaagagtgttatcttataggttcaggataaattccgcttagacctgtcggatgaagaggctgtgcattacatgcagagtctgattgatgagagtgtccatgctctttttgctgcagtggtggaacagattcacaagtttgcccaggtaagttccctgagtgcagtgcatttttctcaccttctccgtgtactgccccagagtccttggagagccatgcatttctcctgccagttgacatcttttctgtttttctatcaagtcgttttgacatctcaccagccagctgaagtgaattgtgtttcacacgttactaattccaaaacatctgcttttcttagtaatgactaacttctggagcaccagcataggtatttttgttctttgcagtcagtggtgattatacgtcctcttgagaatgattttggatccagcagaggccttagcaattgaaacttggacacttgttgggttttggtgaatgatgaagtgctgggaaagtttagaagctaagaaaagcaatccacatcacacaccagaaaggtctatccatagacttactattagcagtatccacagataagtgagggattacccctttatggtaaacttcagatttaaaacccattttaattatgaattgcataataaggatgactatgaaaatggttagcaaacggaaaaattaggctgcttttttcttctatgccctcacctctcctgtgaactccttcctggtgttacacattcacttaatgattttcctaatcatccaagcttaaagcttgtctgctttgaattttccctcagccagtgaccagtatctcaccaagccgtgtttgtttctttaacctttttaacccagtttttttaaactttatgatacctaggtgtgtgcagtttcctcattgcctaacagcgaagtcaaatctctggcaacttaaggccttctagaatattgtgttctatgctgcttttcaagctgttgtgtaatactctctttctctaaatattttgttgtctttcatcatagtggacaactttgctgctgtcatttcttcagcccagaaatcaatcttcttaataatgtatcttctgtaaacttctacatggcaaaatccaacctgtcctccaagagctcttaatgctctttgattgatctttctctaaatttctgtatgttttctacctttattacgacttgcacttatgttttgctttctttttttccttccccccacctcccacttttcccacattagctgatgttttgctttttattatagatatttagattcccggggccaggcgcggtggctcacgcctgtaatcccagcactttgggaggccaaggagggtgtatcacgagatcaggagatcgagaccatcctgactaacacagtgaaaccctgtctctactaaaaatacaaaaaattagccaggtgtgatggcgggcgcctgtagtcccagctactcaggaggctgaggcaggagaatggcatgaacctgggaggcggaggttgcggtgagctgagattgtgccactgtactccagcctgggcaacagagcgagactccgtctcaaaaaaaaaaaaaaaaaaagaaatagatatttagattccgttataactcttcaaatacagacttcctgaaggctgggctttgtctatcagtcacctagtagtgcaatgccttatatacttaaaaaatatttaatgaacataaaggaattcctgcctctagatgttagcttatactctttttctagctcaataaaaaggtgtttttccctgaacaccagtcttgatcatatttttattacaagggctgcctcagggtctgcttcatgggtcattaattgtaaccaatcatttgttgagaataaattgtgattcaaatagtatgtgactcatcaaagtcaaccagctagctaaaggtggaccttgctctacatatagcagaacagaatattttagaggtatagggggaaaaaggccagagagatatcatgaccacttgacatctgtgacaaacaagggacaaaaccaagacttaaacccaaatattttgactcccatatttagtattttttaaaccagatcttttcagtgtcttgctcatcactatactacattagtgtcaatcaaacttttcctggccacggcccatctctgtgtgtgtacaccttatttttttctttttttaagctcaactagttaaaacatgcttgaagtcagaaactcttaacttctgtgtctttgcatttctgtagcaggggatttacccgttgtagttggtcatttatattttatcttactccatctctatctacaagtgtagaaatatctctccatcatgggttttccttattccatacttgtagattctggtttttctcctttgttttcctggagaatgatataatggagctaaaactccaaacttgaaattagtgctgctgcctaacactgatttcagtaatctatagctacacaagcatctccagacttagtagctgaaaaagcaataatgatttgttatttcttacttaggatgcttcagtcaggaatttagctagagcccagctatgaggtttttttgtttgctgtaatgttagctggcttcactccttcagctgtattcgactggtagttgggtttgtcttggaggtccagcaaagcttcactcaataggtctggcacttaggtgttctctgcatggactatctctctccacttcctctgtcatcatttcagactcctgcccaaactgctgctctacagcatggtgactgatttccccaagaggatatgaaggcagacgtggcagtcctcttaaaataagtcccaagagcagcccagattcacagagagaaaaaatagattctgcctcttgacaggaggagagagttgcatatgcagaaaagagaggaattaagtagcatttttgaagatttcactgccactcagctaatgtgctccagcttaaagttgagccttcaagttctgtaaaatgaattagtggcatgctttattttagtggtctagttttgaaattctattgttaatttgcataagatgcccattttgcttgctggatctaaaaatagaagggccatttttcttaattctctttattaaaaatggaggagaaaaagaggttgataaaaagtagtagtttttagggggccatagtattatttaggggagctagtaatagaaggactttggtttaccaaagtctctgggcctcagttttcacacctataaagtgattgacattgaggttaaaacatctgtttttgatataaatttaatataatgtcaaaggttaattgctttataaagctaatgttgactactgcaagggttggtaaatgaaatctgcctctcccctctccccatcttagggatggttacattgtgaaagttgctgagagctctttgagttattggcgtgtacctattcttctattcatagagaaaataaaatatgaatggcaaaacgaattggtaaaattgcagtgggcatgctcttaaattagggagggatcattttatacacattaacagattattataattcttgagaagaaacattaagtctgtttcctaggttcctgttttctagttcttcattacaatagtagatacgatgtagaaatcctgtaattaacattactttagccttggttgttacaggctcttttggactaggatagattgttgataaccttgataatcaaagttactgccacatgaaaataagagttaagaacaaatatttgaattattctaacagtctaaggatcaccatcttagatttgtaaaactggaggtttattgcagcatgaatatgtagatgaactttttaaatatcatttcttagctctccagtttacagtgatggacagtgtttgggacaataacagcttcaacatttattggaatgtatttcatacaatgcttcccatttttaattaaataaccattactgtgataatacaagtatgttttagtgttatccctattttatagatgagaaaactgaaccacataaaaagttgttttcagcctggctcagtggctcatgcctgtaatcccagcactttgcaaggccaaggcaggcgaatcacatgaggtcaggagtttgacaccagcctgaccaacatggtgaaaccctgtctctactaaaaatacaaaaattagccagacgtggtggcgggcacctgtaatcccagctagtcgggaggctgaggcaggagaatcacttgaacccaggaggcagaggttgcagtgagccaagatcactccactgccctccagcctgggcaacagagtgagattctgtctcaaaaaaaaaaaaaaaattaataaaataaaagaaaacttagttagttgttctaacttatcagacagattcagttcttttttaccagaatttcatactctttatcctaagggatgaacttaaaaatgtttgtgatatttcttagatttccttaaatatataatttgtgctccaaaataagggttacctatggatgtttaattttactggaacttgtttaggcactgaagcatacatgggatgctaaataaggtcttagcttcatacaaatcttttcaaataacaattataaaagcatagttgtttcttaattgatctctggagtttattttctctttgaaactcacttgtctacatatattgtctaagtattgatactaataaatcacataggcattcaaattcagatgactggcatctatttttttgtcacttgtagtcatctattataatgatgcaatattgttaatcgatttatggtaattttagtacattcccattaatcattgtggatagtagaaccaactttttaaaaaatgggagtagattaatacatgcttaaagaattacagatatttcagcataaaagaaacaacattcaaaaagaagactaagagttactagatacaactattatatccaaatgctacaaaagcttgttttctttcatcatgcaattccttaggaagggtagagattaaacactgcaatatttgtttcctagcaacacccacatattagtgatacaaattttccactggaaaacaattttattttggtcattgtctttgaaattgcatcattgtaacccttctctatgccaaaatgatcttttttggcatcttgttctgtcgccccccactggagtgcagtggtacaataatggttcactgcagccttgacctcctgggcttgagtgatcctcctgcctcagcctccctggtagctaggagtacaggcatgcaccaccatacccagctaatttttaatttatttttttgtagagatgaggtccgactatgttgcccaagcggttctcaaactcctggcctcaagcaatcctcctgcctcggccttttgagtgctgggattacaagcacgagccaccatgtctggccttgaagtgatctttacagtgctttcgagggttgtatacgtgggaaagatagaggtcatatagtttgggtcatgtacagttgcacaagtaggcctttcactggtgatctcttacactgcagtccatttcctgtttctgcttctccctgtcatcctttcttttcatttatggtagtaaaaatcttgagaaaggggtgtgttttccagtaatgttaatacatactaaatctaattaattaaatcttggcagattaactagagacagaggtttttgtttttcagaatgactgtaaaaaaataaataaccaatagattgggttcagaaggttcagaagttccagctcaagatactaggaacatagcactgctgtccatttaaagggaatccttactcatcacttgcagtgttcaaggaggaaaagcacacgtctaggcagagagacacctgattctatagtcacttattcttaagttagagaccagttgcctttagcttaagggaattcaactgtgatatatttgggtggatttcaaaacaaaagaaacaaaaaaaatggaaggaggaaaatggtgtggttattctgcttgaatttcccctaaagaatacctgtcctctaaggaatgtgacagtggctctctcaaaagtgtttcagttatcaagtgcctctcatgcataacatggcatcttactacgctgaaggtgatcccaaaattgaaaattctgagtgtttggtatttatatcacagtttctaagtgcaaaccagttgctgcttaaccagagaaacagggttttcttgtgtcattgctgagggaaaagcttctgattttggactttttaagagatacatgtctcttatgtgctgcctcctcaagggcttttcttgagtaatttttttttttttaatttgtattcctgtttttcctttctatgttgactttagcacctaaacccagtgtagagtgatttcactttatttgctgtcctctttcatcttctttaagaaggcaaccttctaggtcagtgagtgagtctcttggttttcagaattgggaactaagaccattcaagcccatttctccttgtatttctctaggtaaagtacaagcattttctgtgttcagagtatgtataaaaacatttaccttaggtttatgtgtatattcacagcacctttgacagttaagagatcagtacttgtgctggtgttaactcttccattttttagttacttgaaagtcgctctttcctgggtcagtggaattttgtttttgtttttaagcttttgaatagtaaatgtaacaatagtaaatgtttagatatacttacaaccctagtctgttagtcttaaatataccataatgtgttttcatttgatgaactttgtttgaaatttgatcttacatgatacattagcaaagctagttctgttttaggaccatacatagctaatactctttttggaaaaggagaactatcacacacaggaatttttgtttatgttttttttctttaatttatttaaagtccttactcccagacttgtagtataattttgggtcttgatttcaggtgaacagataagtagaaaataaactatatcttaattctttaatgagaatgtactctcctttaacaaacatgtaattggctttaataataaaaatgttgataaaactctaattcatgaatttattatttcctgctgtaaatattaagtggcatttagtatttagttgtgaaaccgatacataagtatgtagctgcaaaacaaactattgcaggtttaaagcattactagtactcgtatgttaaatataagtacagatctttttatatgtgtgttttgtttttatagcattactttattcatactaactttccattttttttcttttggtgacccacttttgcctcatattctctctttgtactttttgaaacttccctttttatgtaaattgaccactaacactgaattccgttttgcaaattgaagctctttaccctttcatgttccctcatacgtgccagactagagaacatgggatgctctctagttttaaattgtgttttacttaagtacctactcatacttcccatgaggttgaaagccgtgtagccttgagtactcaaatagccatgtacaaaggtaaaaagttcatatcactcagtatatgtaattcatatagtctccctttatatttagttcttcttattttaccactttaaacaagtgtgactctttttataataactaaaatttgtttggaacatcaggttttatcctactttatggatgcaaaattgtgacctaaaaagaagagaaaaatcatcatttctgagtttccatttttagggacctaattttatcattaggaatgaagaatagcagtgtaaaatatttcagtgaacaaaacaaaaagtattgatttgggggtcaaatagaaatccttttaatctaaaacaaattatttttaatttagtaattaattttctaaagaatgagatgattcccttaccagtggcttaagtaaataatgtaacaccaatatatcacacacagctttttttcattctgtctcccagatctaatttatttgaatttttcttggcagaaataacaacaacaggaaaaatcattaatagcaaagtattgaacatttaaatgtgccaggaattatgtaaagttctttctctgtatcaactcttaattctcacacctgtgaagtaagtgtactacaagttatgtatttacagatgagaaaactaaggttaatagatgacaaagcccagattcaaactcaaaatattttgagtcccagatctagtcctatatttataagtaataatatgtatataaatacataatatacatttatatatatgtatttttatataaatgtttatatataagatatttagtaactagtgactatttccagtcaccagctgcattagcccttaccaagaaagtcagcctgtcctttgaagccagactttgacttctctgtagcatgaaagtcctctgtggcatcttattccattagaaagctgtttcatctgcactgaaaatctgttctctagtgtagtcaccttcatcagtgatcttagctagattgtagataacccgtgtgcagttcttccatcagtactgaaaatctgttctctagtgtagtcaccttcatcagtgatcttagctagatggtagataacccgtgtgcagtttctccatcagcactggctgctttaccttgcatatatatatatatatatatatatatatatatgcgcatatatatatatatatatgcgcatatatatatatatgcacatatatatatatgcacatatatatatgcacacatatatatatgcacatatatatatgcatatatatattacatattcatacacatacacacatacatacatatatcaaagtcttaatttagagacctgaatagcttttgttgtgagtagtgagtttttaaaattttacttgtaaatttaaattatcttttaacttttcttaatctttcacctacccatcaaagaaaaaaacgttagctgtgtaaacagacaagtaagtgtgatatataaaggagtcgccaggagctgttaatccaagataaataggataaatgtgggataacatttattttgcacattggccaaaactagtcttgaatttcattgacccacctgtgctctcttgttccactgcagtcagcattgctgcacaactacccattaaaacacatgatatttaaaaaacaaagaatacaggcacttgctatatgacaaatgtttgcagcttgtaagattagttaattattgtaatagcaagagtcagcagaatgccccataattttcagcccaaatgccttgcagtttatttctcattcatacaaatttaattttcttatcttctccaaagaagatttttaaacacttgaatgtcatccttgatagggtttgccatgtttgcttcattaactgcttttagtaaggttagttttatactgttgttttctttccctctgtgttctgtcaaaaccttttataaaaattcttcaaatgtacagtagttgaatattttgggactgtctctgctatatgttttttatttttatttttttcctaaagacacagacatttcaaagtatttgggaaaaagaaggcataccttaaagattttttgatctgaagtccagaccactgcaataaatgacttttttgttttcccagtgcatataaaagttatgtttacatgatactatgcagtagcattatgtctttaaaaactatgtgcctatcttaaaaatattgctaaaaaatgcttaacaatcatctgagctttcagtgagttgtaatctttttgctggtggagggtcttgccttgatgttgatagctgctgatcagggtggtggttgctaaaggttgagtagttgtaaatctgtgaagtttgccacatcagttgattcttcctttcacaaaagatctctctgtagcatgtgatgctgtttgatagcattttgcccagagtagaactttttgcagaattggagtcaaccctttcaaaacttgctgttgctttatcaactaaatttatggaatattctaaatcctttgttgtcatttcaacaatgttcaaagcatcttcaccatgaattgattccatctcaagaaaccactttgcttatccagaaggaggaactcctcatctgctcaagttttatcatgagactgcagcaattcagtcacatattcaggctccacttctaattcttgttctcttgtagtttccaccacatctgcaattacttcctctactgaactcttgaacccctcaaagtcatccatgaagaatggaatcaacttcttccgaactcctattaatgttgatattttcacctcctcctatgaatctcaaatgttctcaatggcatctagaatggtgaatcctttccagtaggttttcaatttgttttgctgagatccatcagaggaattactatctgtggcagctatagccttacgaaatgtatttcttaaataataggacttgaaagtagagtaactccatgatccatgggctgtagaatggatgttgaattagcaggcattaaaacaacattaatcttttggtatattccatcagagctcttggatgactgggtacattgtcaatgaacaatattttgaatctttttttctgagcagtaggcttcaacagtgggcttaaaattttcagtaaaccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactctgtctcaaaaaaaaaaaaaaaaaaaaaaaaaattttcagtaaaccatattataaacaaatatgatatcatccaagctactgtttcatttgtagatcaaaggcagagtagatttaacataattcttaggggccctaggattttcagagtggtaaatgaacattgacatcaactaagtcaccagctgcattagcccctaccaagaaagtcagcctgttttgaagctttgaatccagacattgacttccctgtagcgtgaaagtcctatgtggcatcttattcattagaagcctgtttcatctgcattgaaaacctgttacttagtcaccttcatcaatgatcttagctaaatggtagataacttgtgtgcagtttctttatcagcactggctgctttaccttgcacttctatgttatggagatagcttctttctttaaacctcatcaaccaacctctgctacctttagacttctcttctgcaacttcctcatctttctcagcctttatagaattgaagacagttaaggccttgctctgcattaggctttggcttatggggatgttgtagctggtttgggcttctatccagaccacaaaaacttcctccatatcagcaataaagctgttttgctctcatcattcgtgtattcactagagtagcattttaatttccttcaagaacatttctttgcatttaaaacttggctctttgatgcgagagtcttaacttttggcctatctgagcttttgatatgcctttctcactaggcttaatcatttctaggttttaatataaagccagagatatgcgactcttccctttcacttgatcacctagaggccctgatagcgttcttaattggcctaatttccatattgttgtgtcttagggaggcttaaagagaagaagagagataggggaatggccagttggtggagtagtcagaacacatgtaatatttatcaattaagtttgccatcttatgcagacacggttcgtggtgccccaaaacatttacaatagtgataacgaagatcgctgatcatagatcaccatagcaggtggaatagtaatgaaaaattttgaaatattatgagaattaccaaactatgacacagagacacaaagtgaacataagctgttggaaaaaatggctctgatagacttgcgcaagcagagttgccacaggctttcaatttgttaaaaaaaaacaaaacaaaacagtatctgtgaggtgcagtaaagctaagcacaataaaacaaggtatgctggtatattagagacctttggttcaatagcaacatttttgtcatacatagacgcatacacgtgtacatatgcagtttttcattgcgtccaaattacttccaagttatttagactccctcgtatgttagtgtagaccctttgcagtttggcttttacctgcactttcaacccttatcatcttcaaaagccttcaaaaagaaccttctttgtagctctgttgattcaccgccgctacctccaggcaacacacctcttctctttgcatggaatgagttccctcttatttccccaacttttgagtgtgtgtgtgtgtgtgtgtgtgtgtgtgtgtgtgtgtatgtaagagagagagtgtgtgtgtgtgtgtgtgtgtgtgtgtgtatgattctgtctatattaatttggtcctcgggcattttgtcttaatttgagatctcccacagaatctgagacacttcctggcacatagtaggcaccaaataaacatatgtggttttatatgagtgccgagtaccatttctttaggaagtttattttctctgataattgcctttagtaaaaatatttaaattgcttcttaaattctaaattacattatttttattcacatgaaaaataaatcttgccaatttttttctagagtgacactttaaaatgtgtcagattaaaagccatcaacatcttggcatttttcacatttgtacatgtacacatgcatgtgcacacacacacagacacacttgtcagcaaggtgttttgccttcactttttctctgagtaataatgaagtgaaggtcttagaaacagaattcatgtaagcagcattcataattcctccaagagaatgccagtatatttgtatcaaacaaaaagggcacgagttatggatgactcagtgtatattcagccaaacaaagaaatcttcgttgattttattcctactggggatatctcagtattgaacaccattaatagtgttggccccaaaacagctcttcactaggcctctcgacttcttcctttgatttgatttccagaccatttctggaatgaagtagttgcactctctgggataagctacaggttttcacagcctctcaaaatgtggcaccaagaaccaagcacactactcaaaatcactttatctaaatcactttagaattcagtggaatttttgccttcctagtgctggatgagatgatttttgcttgtctcgtgttaattacattcatcttgagcttacagtcagcagacaccctctccttgaattattttctcatataaactgatttttaagtgaagcctcaggaatcctatacagtatagttaattgcaatcctcttggtagcatttagcaaactaattaatgcactttttattttattagtagtcttttttaaaactatagactattgtttatctttgtgaataattaagtaaattattttctgtttatttctttttaatttttgtagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacattcttatttatgtacatgttatgagagttctggaggaagtaatatgttgaaatagtaaaacattttagtttttgagtttaaaatgttattttttcctcttatatcttcatatcaggacagcagtaacctgaatttagattgtcacagtttacaagtttttgtttgttccttctttcctctctcttctcccactcacttttgtgtgttgtttgtttttgcctaatttacatgtttaaagttctacttaaaatttttcttcaagttttacatgtgatggctcattcttctgcagttcaagaattgcttatatttttagaagatactcattttctcttacaaataattaattttttgtaaactacagttaatagttcttctagcttgtaagtgtgtaaagtagaatatgaaaatgtggctatttagataactggccaaaaggtcatatgaccaccagttttagtattgagcataagatatttttacatattcatgtaagacaatgtaaattgtctttctgcaataaattttttggatgcaaatttagatttcaaaagctttttgatgttataaaggagttgaggaacaaaaagctctttgaaatagctcacctagacctgttaatgtaatatattctttctgaattaagcaaaattttttttgtcttttaagactagaactaatccctctagcttttttactggaactttggggaaaaagaacaaatacaaatatacaaatgatatgaacaatatggtaataatcttttgcaacttaatatgttacatagtcatatgacttggtcttggaagaaaaagaattgttttggtgctgaataaatattagaaatcaagtgacagagaagatgaaggtaaaattgtggcacagtttcagagaatgccgttaatgataacgtgttatttgtctcaaattcttagccctgggcttgcctcttcagagtggggttaccggcgagagggcaagcatgtaattaagagacactctagaggcatatggaatatagtttgtataaaacatacctgctgattagaaaaatggtaaaaatgaaaatacctttgtacatcatcttaagagagcttatatataaactaaatgggcaggctccatcgtctacctttctttttcttttcttcacatgtttatgtcttttttgttattagtcagacatttttagccctctgtatgctcattcttgtagttctatttctattgaaacttcctccaaaacttttctctgaattacccttgttgaaactgacctttcttccgtgtgaactcctacacttgcatctcctatttcaggatttggcatactttttctttaatgggctaagaaagtaaatatcttcagctttggggggcatatgatcccaatagcatcaacttaactctgctaactggaaggcaaaagtgtatcatcttactcgtctttataaactccacagcactctgcatagatatgaccatgtttataaggaactcaataaataattttgacacaaacatgaaattctagaagggcagacactgacaactagtaaggaagttgatcatgagtaactttgtattcagtgccaccttaacaagaattgtaaagaggataaacctttctaggaaggttgatgcgtgttgggtgaggaaggagcatctctcaggagggtaaacagtagctgtggttttgctgagagattttggctgtgagtgacaagcctatatcaaaaagaaaagtggcttatcaatctcagtttttattgctcaaagcaattctttactcctattttttccaaattccattgtttttactctttagagctctatcctcagagtgtagtctgcatatttctttattatcattgccatgtgacttctttggtgacaagttcagtgatatttcaagcatgatgttttgagtttgagaaatgtatttgtgaggacacatcactttaattaaaaaagtgtgagtactatggtcattaagttattcagagtgagatttctgagaggagaagagagaatgtagatggcagttattgagagtggggctataggacaaaaagaagaaaagtatggttaacattgccaaataaagggtcatacagccttgctttttgctggagttagcaaaaatcattctccatatgatagttttagatgttccccagctcatttgtattattgagttttcagctgggtatatattataataacagtcaacatgatgtaggggctcagtattacatggcagggctatactaattgcttcatatgccttatctcattattctgtgagatagaattgtctcctcattttttagttgaaataactgaagtttaaagcaattgaatcatctgcccaaggataagctgctggtgagagcagagttgggatttgaagtcgagttagaccccagtgatcacagtcttgacgattaaattcttccagctttcatttttcactgagataatggtagtgatagtactgacctctaatgtgtgcatttgtgggtatgtggtccattcagctttaatccccagaagacaaggcttattccttttcttatttttggtcatgttttatttttccattgcttttaacaggattaccaaaggcacactcagtagtcagtaaacacatttctaggaaaggtgttgtgtcatcatgccacatattcatactttccttgggttggaaaatagatcattcagtaaaaacatacaggaaaaatgaatcttgccaatgcaattgttaacctacaaccataatataccttaagtatatttttgcacataagtataacattgcgatttaaaacaataaaccagattgagattctaaggagcattttgtaagtaattactaatgtttattttagagagatcacacaacttcaaataaaaactgacatagattgaacaccttgagaataaactttagtgccaaatggaaaataattttttacaagtaaatttgaagaacaatgtgaactttctataattatatacagaaaatatactgatttgccaaaatgagtaattttgatatattaatatttcacttataagaatgcataccacctgatccaggatgggatccaggaacagaaaaagaacattaggtaaaaatgacagaaatctgaatatagtatagagtagctaaaaacaaaccaaaaaaaaaaaaaaaaaaaaaggaaaaacagaataagcctcagaagatagtgagcatcccacctgggtgaccacttagagaagctgaggtgggacccctgcatccgataagtggctgcactagaccacaggaaccagactccactgtaagaactagagtgggaatggacatgtcaaaacctcctgggaaccttattaaatgtgcacattcccaatccccactcctgagcagccaaatcaatctgcaggtgggccttgtgagttttcccaggggattccgatgcctgctagatttaaccagtagatgagatgttaagttatcctgtagtccagagattccacaggccagtgtcagggaacaggggccagggctgggaaggcataagaacagaagataaatttgaggctctgttacgctggtcatccaacccaaccaggtatctcttgttatatgctaacttcattttccctttcttgtccatagtgggaaaaaataatttttaactggctatgtagttaaaaaacctaacaaaaagcacttttctatataatgagtggtttatattaagaataggtacaatgtaaatactggtaagtgaaagttcattttgttcagtgctatgggctggtacattgcatttcaacactagttttttacttttatctaccctgagggtagataacccatattccaaaatacagtattattttcatttgctgtaacattttaagaaatatgtagtttctaaaacttcatatactttatatggaatatgaacaactttaatatgaataaatagtctagaaaaaaatttaggaaaaattgccatgaaatcatgagctaagtcaatggttattttaaaccacttaattttgagactagtatttcatacagaaaaagctaatactgatatcacacactaattgtgtataaaacactaggaatgtcaaaatagaacataagaaaatgagtctagtggacccactgcatagtgtaactttgggatgaatttaaaagaatatttaagtcacagtcaattttctgttggtctaattttaccaaataaccccctaaataagaagtctgatttatctaaaatagaagttaacatagcatcccagtattgccattctaaaactctggcatgtaaatgggagaaatggaaataagctcaaaatgggtagagtaacccatttctgcatgaaccatagaatttaactagaatttggctggctcatgcctgtaatgccagcactttgggaggccaaggcaggcagatcacttgagcccaggagtttgagaccagcccgggcaacatggtgaaactccatctcttcaaaaatatatatttgtgtgtgtgtgtgtgtgtatgtgcgtgcacaaaaattagctgagtgtggtggttcacacttgtaatcacagctacctgggaggctgaggcaggaggattgcttgagcctgggaggcagaggttgcagtgagctgagattgcaccattgcactgcagcctgggtaatagagcgagacaactctatctcaaaaaaaagaatttcactagaatttatatcttcagtgtttgcattagattgtcaccagcactatctgccttgtgactgtcaggactaatccttatatcatttatcttatgtcctttacctcagtttatgtctgtcaccacaagaaacccagacctccctaatcataccatatgccctggtcttacccacatacagctcggtacaactgcatttccccaaacctcagaactccttgggccatcactgtcagagacatttgaactagagcaactccatcttgagtagggactgggtataatgaagctgagacccactgggctgcattcccaggaagttaggcattcttagtcacaggatgagataggagattggctcaagataaggtcacaaagaccttgctgataaaacagtctgtggtaaagaagccagccaaaacccaccaaaaccaagacgggaatgaaagtgacctccggtcatcctcactgctcattatacgctagttataatgcattgacatgctaagagacactcccaccagcaccatgacagtttacaaatgccataacaacatcaggaagttaccctatatggtctaaaaaggggaggaaccctcagttctgagaatttccttgaaaattcatgaataatccaccccttgtttagcatatgatcaagaaataatcattaaaaaatagccaaccagcagctcatgctgctggtctgcctatggagtagccatcctttctttattaacctgctttcactttatggactcccctgaattcttctgcaggagatccaagaaccctctcttggagtcttaaccaggatccctttccagtaacttcagcaggatctgtgagtgccagtttccttctgtggtgcaaaactaggtgctaagtacactttttcccccctttcctctatttttaaaagaactttcagcccttttgaagtgggtacattgtctggagtacataccctggggttcattgttataggagaatttaggacacagacacacgaggagtttaggagcagaggtttaataggtagaagagaagggaaagagaaacagcttcctctatagatgtctgcactgacaccgtggctttaaggcatggcccatgatgtgtctccgagtggaaaagactggttggtggtgaatgcgccaaattttatagtccggtttgaggaggtggtttctgattggttgcatcatgtatgacgtttgcaaggtgcatgtggaaggctggtcgccccaccctaatcttatgcaaatgggctttccagttgattgggtccatcttgtgtaacacgtggctggcagagaagggaagatgaagccaccatcttgaaaatgtctagtccttagtttctgctggcattcacccatgcaagctgccagcttgtctatgtctgcagctcaactttacaggctgctctttgttagcaaatgatttggagcttcttttcattaaagaaaaaagccttaccgaggactcccatacccttgctttctgcttaagtgatttcttcttaactcctatgtcaattttatacagcatgaaataatgatgtatctataaatgagcctttgcaagattaccatttatcaaagaaaaccagtgatgtttagttaactgtttgtaaaaataaatggttagtagaatgtctaattcaataaatgtttcataaatgagtaaatgaatgttttaatttcaataagattgattcttgatcaaacgttcccttttaaatctaattttaaaaatctgagtttgatttttttaaaaaaggttaatataacgtagcatacaatactgcaatttcactccaggttatctaccaagagaaatgaaaatatgcccacatgaagagttgcacacaaatgttctaagcgtgattcataatagccaaaaaaaagcggaacaactcctgtgtccatcaattggtgaaaggctaaaaatgatgtgatttagtcacacaatgggatactgttcagcataaaaagggaactccacctcctcccactgcaactggaatagctggttctgtggaggcttccaccctggctgcagcttcctcctcacctcctcttggtcttcacctcagatccccctcgtccaccttcacccatgctgtggtcaccagccctgtggcaacctccaagcctggacatttgccttcccctctggcactgctttccagagtcagttttcctcacatctctgcactgacaccgtgcatacctccaggctttaaggcatggcccatgatgaccctgaggaccagtacagcccaggctactgcccgggaacacaagtagcccaaaaagcaatggactagcctgaggccccgggtgcttgctgggccacagacacccatagacactgagttcatcaacagttggcctgactgcaccagaacaaatcaagtttgctaagaagactcatgatcttgaaagaaactgggtgccttatttaagcctctgcaatgatttgagatgaaaatgaccaattcagaaaactgttgtgatagtcttatcgagcaaagggggcttgctgcctgatgcattaaaagcaatactgtgacaccaggtttttgagaaatggaaagctttatttgaagtcaacacccaaggagacaggagtcaagctcaaatctgtctccctgtgcaggctttaaggtagtaattttattacaaaaggtttagaggatggatactggcattagcaggtgattggtggtagggaagaggaggcctgcaaagtccttgggcatgtgcagttatctcttcatgggtcccatgtgcaaattcaggaagagttagtataaaccatgtggtggaaatttaggctgtgacattagcaagcttgttctgtacaaactttagttggacatcctggttccaactgatttcaaccagttctttcgtcgcctaagcaaggaagtttctgtgtttcagcaagtggtttctttttctatctgccattctacaaactcaaaaatttctgttagtcattggtctgtttaactcttcggggtattgtttcaattgacaaataaagcatgaggcaaacatcaagcaagcaaagtttaaagaagaaaaaggctggagtaaaggaagatcccaaagaaataactggggcaaagctgaagaaaaagagtttaaaggaatttctgatgaggaggctaaagaaaatatcaatactaaaggaatttctggattttaattcactgttttaaagaatattgttttggttttgtgatgaagaagcattgatgaatttgttctaaaacatttgaaagatgttgaactaaaattctcagttcctggcaagcccctgaagttatacatttgactttcactttaagcccagtgaatattttaaaaacaacgcactaacaaagacatataaagtcttgactggaatttatagcaaatgcttacctttctcagggagttgaaattcaaagctgcataggatgtcaagtagattggaacaaaggaaaaaaactatcacagtgaaaaccattcaggagaaaagcggtgtaaatgggaaaaaacaaaattacttaagtagttgcagtgactcgttctttaatttgttagtcctcctgtagttcctgaacaagaatacctggatgaaaaagaagaagttatgcttgcttaggactttaaaataaatcagattatacatgatgatgtaatcaccaaatcagtatcttaccttacaggaagagtttctcatgtttctgaagaggatcctgataatatgacaggacacttgatgaggatgaggaggatacatttgcaaaaattactaaaaatatgaggaatatctgactagaagtatgtgaactgtaaactataacgtgtaaccttggttattataacaatttaaagccaacagaatttagagtcttaatgtatataattttcttagtggagatagttttagagaatacgccaaggaagtttttaagtatgaattaattatccttggcttttattagtatcagtttctgcaagatgtggagaatgaagtaaattccataaagcagattaatttgttctgacatatttacttttgtgaagtctttttgacaagtacttcttggactacaactccaaacgttatttgaactattaacagatatatatttacatatatattttgttttggctcagttgaaagtttattctgctagagctagaggtattttctttattctgctgaagcaatgcagtgacttattaaactataaggtagtttgctttttaaatgttctaaatcaatttctagtccatatttaagaatttctattaaagtgacagttaatgtcaattactgctttattatggttttttttaatgacagaaatctataattatactgtcattgtgaggtatttaccattatagtgttaatataatgttcttaaatgtttgtgtattggtatgtgaggtgaataagcacatttttttgggggcggagcgcatcttatatttcattgaaatgttcattttatatttttaaatactattcagcaagatttgttcacgttcttttgttacttggaaatgtcaaaaataaaaaaagaacagaagaaataatatttctgtgagagaagatacattataatagttaaatagagaacttttagcttggcaaactagggatattaatagcatgtgtaattaaaatttgagagattttttacactgctgttccacaaacattttgcttgagtagatataacattttgctttcttttagatgcccaaataatagggatatgatcaaaaaataagaacgtggtaagaacacacaaactgaataaacagctgaacatattaataagagaaaatgtttgttagcttcagaaaagaattaatatgaaataagagaaaggtaacatagtctgtctctttatcatcgtttagagattatactttctgacaggaagttgctgccaagacaatattagaaattattattgttttcataaaaacaattcaaagatgaattagtaataaatatgtcaataataaatgagtaacttattaataactaattttgttatgaatgaggctggggaactattagattaaagccagcaaactatacgattgtattcagaatggatagagaagtttgcataaaggcctgagatccaataatatttgagtcctacagtattttcaggaactatatacaaaggggacattagcataatggaaatgaaaatatcactagtgccctatatgccagtgtttaactctgtttttaaaagggtgaaagagctaaattgtaaacactaggtttgaggactaaaaccattttcctcttagttctaaacctctgcatcttgcccttcttgctggctatatggaggaaagaactggaagggagtttgcttggagtggatggataaagaaacatgaagatagaagctgtatcagcccttgattagcttatccacccatttcatccttggagatgatggtgtgggaaagagtgttgtctgtacattaggttcgtatgactgctgtagaaatttaccaccaatttagtggtaaatgtaccaccaacttatcttacagtctggaggtcagaagtccaaaatgggtctcactggactaaaatcaagatgtcaacaaggctgcattcctttcctttcttttctttttttgtaaaatatttatagaggtttattctgagccaaatacgggtgggtgatcaaggcctgaggtacagtcacaagaggtcctgagaacatgttctcaaggtggttgggttacagtttgattatgtacattttagaggtacagtcacaagaggtcctgagaacatgttctcaaggtggttgggttacagtttgattatgtacattttagggggacagaagttacaggcagacattaatcaaaaatgttaggtgtatattggtttagtccagaaaggtgggacaactcaaaggcgagatgcttccagaccataggtggactcaaaagagtttctgattggaaatcagttgaaagagttatatcttaagacctggaatcaatagaaaggagtgtctcatttaagataagtgtttgtggaaaccaagcttctttttcttttttctttttttttgcaatagcttttgggatacaagtggtttttggttacatggataaattgtatagtggtgaagtatgagatttgaggctgtagggaaaaatctgctttcatgctttttttcagcttttagaggctgcagatcttacttccatcttcaaagccagcaatgactagtcatgtcctgattcttctgcctctctctttcccattgaaggacccttgtgtttacattgtgactacctggataaaacaggataatctatttaagattagctgattagcagccttaactccgtcttggcttgtaacctagcaaattcaggggacaaggattggacatcttgttggttagtgtgggcagggagcgccattctccctgcatacagtgtaagactctttaatgcaagtgattctaccaaataagctgactgaacagagttgcaacttctacctagggttggaaaccaggaaggccgtggaaagaggtaccagctttctggcactaggagagaacagaaatgtgtctgcccttaaatacttatttatgttctctattttaacccatggactctgaaaagggcctaaatagtatacttttaaataaacttcaagaatataatattttagcccacatattcatgcccctcatatttttcatttatcaatactccaagcaccttctccagaaaaaatcctgaggactatgcaataagcacatgacaacacaatagaaagccaaatgtattaggtaagtgagagcctcttctcattaagacataacatgtctgttttccaaatagctgcttcaactgtgtggaaatattccgttctcactgggtagcagacagtttcatttcataactttttggaaccttctagtctgattttggctttaaagaccaaagcttgtttttttcagtctgtttgcttgttttattgatctcctgtttaacttaatgtcttctctcaatcctaaatgcaacctcatcttgaagcaaaagatgtgtgtgtaggatacctccagtagatgattccttctttctctgctcatccttccaggtcatcattcccaaatgctcttttcttttctggtcaccataataagcagacacttccaaacttttgagtagttctcctggggcctttctctcttggcttgagaaagttccaccttgttcaccatgaggagggaaagaaggtcctctctgtgaaccttgcactcttctcaaaaaagtgaccctctctctttcagtgctttcatatactaggtgcaggtagtaatagtgccagttctgataactttttgcttcttaaattaggaggggaaaaatccaaattggtattctgggattactgtaactctatttcttggttccgtatgaggaatcagtctcttatcttaaaatatactctaggaatgtgcaggggttctagtccatttcatagaattactgttgtagcagctgccatcagcagccaggtggaggtttttgcttatctttccttaggaaaaaaagtcacatatatgtgctgccacagaaccagcatcatttcccagccctcaaacatctggttggcatgtgtacagacacacaactcaaatctcagctcccatgaacatccctctgaatccaaaattggcccagaacttgtttttaactattgtcacactttcctatgagagcattaatattctattccactacaactaaatgacctacctctatcatacctacccatagtcctggcagttatccaagaatctatttcaatagtgagcctcttggacaccagtgccatcctgcatagtctatcacagaatgagagccccagaaaatgcaattaacaacatcatggccagatgcccattgaatatcccaaatctgaaaatccaaaatctgaaatgctcaaaattcaaaatgttttgagtgccgacatgatgttcaaaggaaaagcttactggagtattttgcacttcggatttttggatttgggattctcaaccagtaattataatgcaaatattccaaaatccaaagaagaaaagaaaaaatctgaactctaaaacatttctggtcccaaccatttcagataagggatattcaacctgaatttcttcatatcatgtcctcctacctccatggctgctctttctcagtctcctttgtgaactctttctactgttcagcctctaagttttagaccaccagggttcttgttcctgggactctgttttctctctgtactctcacagtgatctcatccaatcctgtggcattagatgccattcatacactaatgaccaggactagcttcatgggcatgctatctgtgaagctgcacaagacctcacattctgatgggccctgtgtttagtttaatgcaatgatgttgctgtcttaaaagctttaataattaatttgatctttgaatcgatattgtgtaagtgaagactgatgggacaatggagcacgtgtaccagcagaggatatgccaccatgtatgtgtctaccaccactctttgacaatccatttgccacatgaacacagaattctggtgggcttatatgcatgtggttcaatgagaaagagagaaaaaaaggtaccgtttacatctacaatggaataagtggggacactgacattctcaagaggccacattttccatttgaacaagaacttgtttagacatagaacacaaaaagtcaagaaaccctatgcacaccctgaactcagcatgcttatgtgtgagctgtgggggcagaggtgatagtatgaaggttaaggtccatccagtgcatagcaatgccctgatgaggctaccatctggccacacttttaatttcacatacctctgggcttagtcattttctcctaggaccagcacctacacctgaaagaggtgacaacttcaactacccacctggtattgaccttaggttatcatcctagacttctgattcactcaacaatattttatttggggatccttgatgtcttccacatcactgggcttttgagaggcacctactcctataccataagactcctttatctctgaatcttagaaagagttgaaataaatggctttataaaaaaacaaaaagttctctaggatcctcatgtaacttgctccatcctctcccccaagatctgcatgcagagacaggacctagaagagaatgccagcttccctaagtcagaccaaaagtccccaccctccttttctacaggaattattactttctggtatatatcggtgtagcctagtgtcatgaacataggtgtcaaacccagagcacctcagttctaaatctatgtttgcttatatcttacctgagtaacactgaggaagttgcttatcttccctgcacctcaatttcctcatacaaaaaaaaaaaagcatataataatagaatttaccttttgaagttgttgtatcttttaaataaataactcaatttacagggcttgtaacagtgtctggcctacacagcattatgtaactattctgcattattaattttttgaagatgggtaaaaaagttatttattcaagtaataatttattgaatctttattgtatgtttagcattgggggtacagttgtgaaaggaacagacatgtttcctacctgcatggattttacaacctagtaaggcaacagttggagagacagacaggaagcaatcatacaagcaatttaatagttataaaatgtagtaagtgctttgaaagaagcaactgtgtgtggttaaagagaatacaagaggaaaatctagtttagatataatcaccaaaaaaagtcatctgaggagataatactttaagccaagaatagatgatgaaaggaaccatgcatgaaaggttgaggggtaaagggagcaggaggggcattttaattacagggagcagcatgtgcaaaggtcttaagccatgaaaaagcttgctttgtgcaataacctgaaagaaagctagtatgtctggaacctggtaataaaggtgaaacattaaaaaaggagcctggagaggtaggtggaatcaaatcatacatgggcttataaaccatgggaaaagttggaattttatttaagtgcaaaggaaatcagtgaaccaaatgattaggtttaacttattaaattatcactttgtttctttcatagaaaatggacctttggggaaaaatcaggaagactaattagtaatctaggagaaaattctggtggcttggattagggtggtaaaagtagatatagggagaaaggaaatgaatttgaagcatgatttggagaaaaattggataggacttgctgatggattgactatgggagagaagaagagggaggaatgaagattgactctcagcatcctggtgtgagcaatagagtgaattttgggggcacttgcagtgattaggaagacagaagaaaagttgaatattttagggggagatatagaggtgaattttcagttagcttatacactttgagatagctctgagatattttacctgggctgccaattaaaaacatagcttcaataagagtcacagcttcagaaaagaaatttgagaggtataattttgagagttatctgttagtagatggtatttagaacataaaaagtgagagatgcaagtgatgaagaatacccaaaagaatattgaaaaaaaattagagaattcaaactccctgataaacttactacaaagctacagtagtcaagatggtgtggcactggcttaaggatagacacacagattaatagaataaatttaagaatctacaaataaaccattaacttatggtcaattgacttttgaaatgggtgctaaaacaattcaacgaaggaaacaatagccttttcaacaaatggtacagaaacaactggatagtcacatgaaaaccaacgaagttggaattgtacttcaagaaaaaattaaaatgggtttaaaaattgatccaaaatgcaacatagaaattattgtgtaattataaattataattacaaattatatatataaattataggtgtaaacctacttaaaacatttggagaaaaatataggcaaaatctttgtgaccttagatttttaggtacgttttttagatgtgacaacaaatgcgcaagcagcagcggcagcagcagtaaccaaatacataagttcaactttgtcaaagttaaaaacattcgtacttgaaaatacaccatcaaggaagtcacatatcacccacagaatgggagaaaatatttgcaagtaatacatttgatgttggtgatggacttgttcctagaatatataatagaaaacttaccattcaacaatttaaaaaatccgattgaaaaaatgggtagaagatctaaatagacatttatctaagaggatatacaaatacccaacaagtacataaaaggttgctcaacgtaattaatcattaaaaagatgcaaattaaagctattatgagataccacttcatacacattaggatagcggtcatcaaaaagacaacatgttgatgaggatgtagaaaaatcaaaacccttatacgctgctgttgggattgaaagatggttctgctgctttggaaaacaggttagcagtttctcaaaatgttaaacatagagttatcacatggcctagcaattccactcctagatatatccaatagaaatgaaaacatgtccacacaaacacatgaacccaaatatttgtagcagcattatttatgataaccaaaaagtagaaacaacccaaatgtttaccagctgatgaatggataaagaattgtcatatataatacaatgaaaagtatttgttaataaaagggaatgaagtttcaatacatgctagaaatgggaacattgaaaacatgctaagtgaaagaagctacccacaaaaggccacatcttctatgataccatttatatgagatgtccaagataaacaaatctatagagacagagaatagataagggataggagcaataggaaatggggagcgggtgcttgtgtatgagatttttgggggagggtgatgaaaatattttagaattaagtagtagtgtaagtagtagtgatggtttcacaactttgtattatatgtaaataatatttcaataaaattgttataaaaatttgtaaggtcatctagagagaaagtttaaaaaggtaacagataaccattagatctggtgatgtagcattatctttatctcttattagactgtaagttccctgaaggcaggttgataagagcattaatatatgtggaatggagcagagacagagcagagtgggtgggggacactcatcaatcatcttgaaggactggagagaataataattgtggacctctgctttctgcctgttgaagaagcagttaagtgacgggacagctactagaggacattggataaagggagcagcttttttaaacatagaagataccggaaccataggtgatggtgatgattcagtaaatgcaaagggggctgtaagtaaagaagtgaaatccccaagaaagtgaaaaggcatgtcatcccagagactagtggaggaatgtacttcagttgggaagagagtgaatcttccattacaataggagtggcatggagcaagattccaaactctcctcctgggatgtacaagtggcttagaacaaggagatacaggttttttcagcttggtatgcaggaccatctgaaagctgccttcaatgataaaaaaatttttctttcctttttttggcaaccattttaaaccttaattcagacctcccagagttcaaatgttcaaccagagtggctggccctcttcagtatttcagccaatcagatagcagctctgctcaaggtcccagccaatctaatttcttggcccatatgtaattgagcttagcaatgaaatgacatgttcttcattccacttctctaacggcatcattttgcaaccccactcctgcccagtctggtaaagaggaaaggagttgtaaatgtgttcacacacacattgctcttgttcctatataccaattttcctttgtacttcaaaaatatatgctcatattatgctttatgagggcttttacaatggaaacaaccatctacaccctcctctttctctcattattttcctaaatttaacatcacagatttcatactactacatatttctgcttagttgaaaatactcatgattaaaaatgagcgttgccattgaaatgtatcatgttaccaaagtatttcttgcaaattatataaaatttattttcactttatcagtaggatttaaaatatttttaaaatcacaaacagctgggatcttgaaaataatgtttcaaaatgagatttccatcattttccatggaatgcaggtggaatgtctgttgttagggaaaatattttaaagatactattttctttccataagattttataaaatggcagtggtttgaacaaacaaacaaatctttatgatccataattgcaatacttgaaataatgaaatgattagaaattatggactctaaacgccttattttatggaagaaactgataccaagaaagggtgcatgaatgctctgtgtcacaggggatttttgtggggctgagaccgtgtgctgacttctcagctcctacaatgcctcctcgtgatgaggaaacagcaggaccttccttattatgctagttggttcactgaagatggatgtgattccactttctcatctctaaaatgaaaaggttgaattatacgtctaaggttctgcctggctagaataactgtagtctctgaatttggacaaaaagaaatgcaaattgcaggagaagaatgtgctaaatgcagatactcatcacgatctcaaattgtagtcattttttttcttcaaaataacaatacaaaaattccttgcacttttgtatcattccgtacagttctaggggtccttacagttatggtccatagcatcctcagcaacagagttggctatataactcacacttgccctaatcatggtatccaggcacattatatacatatagaattttatgtgcagtcactgggagataaaggtaaaaattatttgctttgaggttactagctgggatgatataagcctggaactatctatttatagtttcatccctccatgtctgcaccacagcctctaaccccctcaacaaggaggaaaatgagcagaggaggaggtgcaggggatgggtggtgtggggccgagatgacaggaaaatgagaaatagaaagacagagaatcactcagattcctgatttatctatgcctgaagtgtcttcctggacttccaattacatgaggcaataaattactccttttttgcttaagctaatttgaattgcttttctatcacctttatctgcaagacccttgactaatgcaattaccttttaccccacagggaaatggaaagcagttctcaaaataaaaggcctcaaaataaatcccaaggatagtaggtaatattcccccaattattagacatgatcctcagttattttcacttattcattcatttgctgagcactttacatatgcaaagtaccctatcttaatccattctggcttctacagcaaaataccatagactggggtggcttataaacaacagaaatttatttctcacacttctggtgactgggaatccaagatgaaggcactggcagattcagggtctggtgaggacacattctctggctcatagtgtcatttcactgtgtcttcacatggggaaggagtgagctagctcacgtggactccatggacttggactttgaatatgttaatgaggggttagcatgctgtggtggggaaagatagaatgactctgtctagtccacaggaaaaggtcataagctgagacggatgttatctcttgggtggagaccactgactttgtcatcctgttcttgactttgagaaaaatacaaaacactgacaatctgaaacaaatcatttagaatgagagagtgtgaaaaaacagaagcaacaaagaaaggggaggaggaactgccaaggactcattaggacaacagatatcaattgccacatctccaggtacttgaaaaattagttgagctgctggtgagggagcatttctttttgaatatgactgatggaaaagatcagaaagcaagagttagcagaggtttgtgaatctaaataagctgcttaatgttgctgaatagaaaaaaaatctagatagatgttttaagcttgcttcttagaaggttcaaatacagaaaaaagacaaattagtagtgacaactttctgtggactgaatccaaacaaggtagctcatcagaagaattgaaatcttagcaataaagttttgtgtgaaacatttttttaaaatgaaaactaaagcttaaatattggatctgcctttaaattaatatcctttggaactggtatgtatgtaaaccttgtaaaaatccatgaattatcaatccatggcagagtctcatagagtttacttttgggttgctgatcatgtgttaggaagaacataggagagcttagttgtaggggaaacagaatgcgagggctgggcacagtggcggacacctgtaatcccagcactttgggaggccaaggcaggcagatcatgaggtcaggagttcgagaccagcctggccaacacggtgaaatcccgtctctactaaaaatacagaagttagctgagcatggtggctggcgcctgtaatcccagctatttgggaggctgaggcaagagaatcacttgaacccaggaggcagaggttgcagtgagctgagatcatgccactgcactctagcctgggcaacagagcaagactctgtctcaaaaaaaaaaaaaaaagaaaagaaaaaagaaaacaatgcaagattcaaaatgtttaagtaagagtctatgatatcataatactaattgcaaaaatattgtaatgtttgttagcagtacataatatagtcaggatgaagccttgataagttactgaatgaatagagctggagtctacataactctgatgggacagaccctagacctcccttccttcagctgctgctccagcccctcattttccatgatgtagtaataagttcaggcccttgcacttgtgtgcatggttgggagccaatgtgcacccaattcatgtgccctcttcagttgttttcatcaaaaaatgcctgtagtccggccccattcaaaacagtccaggaggtaaagttctcgactgtcttcccagggactctggcttctgaattttattccatcctatgccaaagacctccacactctgacaagaaagctcttgctcaagtgtgcattgtcacagtgcttaaaaagtggatgacattcacatcacatgcagtaaataagatcctgtgagagttttctaagtaatccatggttggtgacatgtttccagtttcctaagcacagttgggcatcatcctgctagggccagtgaaaggaaggtgactcagattctaactagaagaccacgagtggcctctggagtggctctgccacctcattgcatttaactcgggcccttctttttggggcttaagtttcttcatctttgaaatgagggagtagaatgaatggcctacagttgtccatcttgttctaaatgtcactgattcaacaaaaacagactctcccaacttttcattttcttaaatgaataaaggttcagcacttgttttaataccagaaaaagtgaagttgtttttgtgtcagtaaaggtatgaccagaaaaacagaagaggtaggaaatatattcaatttattgcaggaaactggcttataccattgtgagatctggcgaggcaagaacaaaatctgtaggataggccatcaagaagggcagatggaggccgggtgcggtggcttacacctgtaatcccagcactttgggaggccgaggcccgtggatcatgaggtcaggagtttgagaccagccaggccaacatagtgaaacctcgtctctactaaaaatacaaaaaagttatctaggcatggtggtgggcgcctgtaatcccagctattcaggaggttgaggcaggagaatcgcttgaacccgggaggcagaggttcaatgagccaagatcatgccattacactccagcctgggcaacagagcaagactccatctcaaaaaaagaaagaaaagaaaagaaaaaaaaaagaaaggcagactggaactcttggacacaggttgatcctgtagtctatcggcagaatttcttctggaaatctcagttctgctcttaaaccttttcaactggttgaatttgaaccgtctgattatctaggataaactcctttacttaaagtcatcttattatgaacattaatcacacctgcaaaatgccttcttggcaatgcctagagcgtatttgatggaataactgggggttagagcctagacaggctcacataaggttgacctcacagtacgcatcacagtaacagctcccactggacatttatttctgagggcagaatttccttggtatggagtgggctccttttgtcctcatcttagtgagcttcacagcggctttcaagactgttggccgatgtctgtttttcccacccagtctcctattttgatttccttggcattgctcccacctagttttcctcttacatctctaacagcttctcagatcctcctcctccacttagcctttacttccgtctgtacattccatctttgcctaacttcatctcttctgctgctattgaataccattatatgctggtgactttctcaattgcatctccagctcagaacttgcctttgagcttcaaatgcataaccaactgcttatgttccttatcaccactcccaggaatctcaaagtcaaaacatcccaagtagaacacactgtctgtctcccaccaccaaccctactcttccattgcctttcccatcatggctaatggcaccatcacccaccatttttcatgtcagaactcatcattctagatttgatttccttcactcattacatctaaaccaagccacagtcccatttttcacatctgtctgctgtctccacacaattgttcctgccactgtagcaaaactctcttacttcttgtcagaacaattacaattgccttctaactcatctgccttctttacttcttgccttcctccaattcattctccagagaacacttttagtggttttaaaagatgtaaatcagatcacatcactgtgcttaaaagtatttcctgctctcttgttctcactcataggtgggaattgaacaatgagaacacttggacacaggaaggggaacatcacacaccggggcctgttgtggggtggggggaggggggagggatagcattaggatatatacctaatgtaaatgacgagttaatgggtgttacatatgtaaaaacctgcacgttgtgcacatgtaccctagagcttaaagtataataaaatatatatatatataaatgaatttaataaaaagtatttcctgctctcacatatacacagagtacagtgcttcttgccaggccccatttcttctctgtgtcttgatccatctcagtgctgtttcttttgttttatttctttagagacagggtctcactctgttgcccaggctgggctgaaactctgggctgaagcaatccgcccacctcagactcctgagtagctggaatacaggcaagagcagcacacctggcctcagtgtcatttctacatactgtttcttctgtctggactgcccttccctggctttttgcatagctgtattctcatctttcatgtatctgcttcaatgtcaccccctcagagacacctcttctggcaaacctgtaataataagtcttctttattattctgtatctcagcactcctttgtcttgtctcacagcacttgtcaattcagtacttatatgtgtgtccattaattttacttgtttgtattgttgtgccttctcttgcattcaattaccttgcagtgctacggtagaaaattagaaattcaactctgaaaatagaggataaacacatattaccagttaagatatacatatgaaatagtattagcatgaattctaggaattacagctttcagtaaatgctgagttgatttaattccttctctaagcgatgattttattctataaacttctcttcatctagtgtttttgcagaaaaatggaatccattttatgtgctttctttagttcaacacatgaagttggtctgaatatttcataggcacctccaggtggttagctgtctggtcccctgctttgctttctctaaaccacaaaaatgaaacacatggaaccagagaagagttttagtcttaattctgcttctttgctgtgtaattaggaacctgtcagctcattgtctaagtgacaggcattgaacaagctgcacgcatggggtgaaatcataaaagcaactttatttgcctccctcaatccctttacacttgctctgttgggaaactcctctgctgttcttgatgaaaatttaacagatcctttgggttttcgtgtttaggtagtaaaatttcctacaatccctttaaatcacagaacatggtttcagtttaacacttagtccaaggtaacagccaaagcttccaactttactcagggttgtagctgttccctttcctctggtggggtctaatggcaacaaccttatagccagggaaagagatgggaggagaggtcattatccatcttctctccccacctctcctatcccatcttgctaaggtaggtttttgaccattcaaagtaagaaggtagaggagagaaatggggtctggaaattcattacttaaatggtactgctctgagatcgctttgcgacttgggggtccagtaggcatttgagatggtctctttctcttgtccatgcctcagtggtctttcataggcttccatgagggactgccctatcaatgacctcctcaaatttgctgccttgccctcaggcctgcttcttggcaatttacttcacagaccctctctttctggcagttttcttgcatgggatttaacatggccccaggacagctctctcccatgtggcctgcatctggtcctacattagaaacttgtatgtattctctgctctaacagagcagtgattcttcttcactgtctctccaaagccacacacgagcattctcttttgttctctgggtttcctggatttgagtctctcctcaagcactctccttactgcatagagttttttacttgtgggctcttctcttttttaagaaataaattttactgtgtgtacttaaagtatgcaagatgatgaagcctcttctttttaacacttggttacagggttggacctagaagaagctggaccataagagaagctaaatgagaaacagaagctggggtcagaatctcttcttcctttcaatcttgagaaaatatctttgaactaagtgtctcttctcttcctcttttccttatatagttccctaaggaggccactctggagaccttctagacatgtaaaatgaggataataatagttcctaccttataaggttgtgtgaaggttaaatgagttaatgtgtgtaaagcacttacaacagatcttggcacatagtaactgccatgtaagtatcagctattatcataattgcaatgccatgcagatgaaccctctagttcatcgttatagttctatgggctttaggcagagaggtggccatggagatgggagaagcaaagagaattagccttgaacaggagacttgggactgtacgtaggggacttaagtatctgaggtttattaacttgacaggaagcagctaatttaaaacagtattattgaaatttctttgagctatgcttcatgaaaaagaaatgttgagcagacagacagtgaaatattaaatgtatgcacttggctgaaaggaaaaaaaaattaatgggacatactacctcattaagtaaatgcagcaattaattctttactcagtaagctagataaacttcaaaaatccctatttatacttcaaacagtgtctaaatgatttagctgatatttcaaagggacactgaagctcaataggaattaagatgctaaatcgttagcccaggagcagtcaatacctctgtcagcagttgggttattgttcattttaggcattgagttgctattgtgttctgtgttcttaggctaacaaaaggcacagagtatgcatacccaacacaggtagtgccttgtagtgagtgctcagtaagcacgcattggatatagagcattcactggcctatagtgtcacctccctgactgcattcgcccattccacaaaagtcccaccgtgttttaggggtcctacattctccaatttttataaaattagtacattgtttacaatcagaaaataagtcccttggaacttggaccagtgagcactgtaatcagcgttcacctgcgttggtttttctttctacatatttgtgtgcctgggttcttaggagctcctgctgccctccctgtctgccagttccaggaggcttgctgaccagcttagcctttcacgctctctcagatcctgctggccgtgtctcctctctcccaagagctacgtgtaaaacatggtatgttctgcacgttttaatttagccacattgattccattgatgccttgtcagatactctgaagcctgaggcttcatcagccacacaggacagatcagagatgggccctctgactttttgaccctgattattctttctttttattctggttttctcttggcattatagaatgatgtggagaaggagatctggggaaagggaaaggaagagaacaaggaggagggagtaagaggtcagagctcacacatacacaagaacaaaaggactgcaaattgggatgtctctccacagcaaccttcccttcttccctttgaaaagtcgatgctgaaccatctgtcatctctcagggactccagctccaggctggcttggaccaagtgagagctgcctagccagtcactcatcagtccgtcctagggctgcctctgtgcattcatcctgctttccccaggtgggacattccgctgcctttggggcttcacaccccaattatttattaaggagacagaaaagaattgttgataaaggccgtggctggagagcaggaagtagccatgggctgctgcaggggtgggctcctgcttagcaaatgttagaccaggtttgtcttgctgctgtttttattttgtttggacactttttactgttgttatttcacacatccaaagatgatatgtgccctaattgcatttccacagcacctttgacaattctgagaatctattaattttttaaattcaagccttggcattagaggttcctacaatatttgagtctggtttgtatgtgaaggtgggttggggttgaggagtctgtgaataatatatgcaatttataactatctgtgaaactgaaaataaaataggttgtatgtgcatgtctgtgtgtgtgtgtgtgtgagtgtgtatgagagagagagagagtgagtatgttgggggaaaagagtgactgtatttacatcctctatttggaatttagagttttaagtgaaagttggtccctttatctaacctgtcaacattatagatgatgctgtatatttataaagatatttgcatatcttttatcagatggatgctcttagttgatttagtattccagcttctatttggaaaataaattaatattgaaaatgaacatgaaaagctcagggaatttgactcactgccaatgctggggtcctcttgcactgggatgtgtgaccttttgggtttaatgctggatgtagtcaaattagtgaaataggggccttctccattctttttcttttttgtaccacccaccttcaggtttactctgtatccaaatcctcaaaggtttgttctggtctctactgtctgccaatcatcatttaagatgaaaccttccttctcttgtgttttaaacggacattcttgaagacctaatgcatacaaaattaaaaagagtagtgtctttaagaatttccacacacaaaaaagcaaaacggtgttgacaaagtgcttttcaaaaattgatacatattaattctacatattttgggggtacatgtgatattttgatgcatgcataccatgtgtaatgatcagatcagggtaactgggatatctatcatttcaaacatatatcttttctttacgttgagaacattccaatttttctcttctagttcttttgaactgtactttgcattattattaattatagtcactgtactatactattgaacactatctgaatgtaattttttttgggggggacagagtctcgctctgtcgcccaggctggagtgcagtggtgcgatcttggctcactacaacctccgcctcctgggttcaagtcattctcctgcctctgcctcccgagtagctgggattacaggtgcctgccaccatgcccagataatttttgtatgtttagtagagacaaggtttcactatgttggcctggctggtctcgaactcctgaccttgtgatctgcctgcctcggcctcccaaagtgctgggattacaggcctgagccaccgtgcccgtccctgactgtaattttgtacagattaaccaaactctctttatccccctcatccttcctagcctttggtaaccatgaatcagctctctacctccaggagttccactttcttagctcccacatacgagtgaaaccatgcagtttttgtctttttgtgcttggcttacttcacttaaaatagtgacctctagtttcatccatgttgctgtaaatgacagaatttcattctttttatggctgaatagtgcatatattccacattttctgtatacttaagtgtatggacacttaggttgattccatatcttggctatcatgaatagggctgcaataaacatgggagtgctgatatttctttgatatatggatttcctttcttttgaacatatacccagcaatggaatttctggatcatatggtagttctatgtttagttttttgaggaaactccatactgttttatggtggctgtactaatttacacttcttccaacagtgtataagtgttctgttctcccttctctacaccctaacaaagtgcttttgcataaattatctcattctgatttttctttctaaattacagaagtcttgttcaacaggaagggtagattttattgtatatattttaaagatcataaagctgatattcagagaaattatttaaagccaccatgagctccagttctaacatatgaaagctcattttaactcccttgaagtgctttctccctctatgatattgcagtgcctatcttctactatgatggagtgtcagacaatagaatggaaaaggaagttagacttttggctagaaaagtttagccatagtcttgagaatgggcttttgtgctacctgtcttaaagatgaacatggtagactagaacctacttggggtcagacagaatttggttcttaatccaactctgcaacttgctagctgtgtaatctttgcaagttacttaatgcctctgattcccagtttcacctactataaaatggaaaaattttgaagaattgtgacaatttgagatgtgcatataattttcttggttttggtatttctgattattaacacctcacacttgctctctccattttcaggacaaggaaagcttaaataagaagataattcaggctatacatacaagtgtttacacacagtttggcttggggttaaaaaaacaaaactgatataattctgataagcaataatttttatgttaacaaacagcttattgattcagtcaaatctgggttttccaaataggggtttatatgaagataaagtctcatttcattgagttctcacacctggctgtctaatacactcatctggaaggttcatctgggggactagaaaacaaatgaagcaagaagtgggatgtcaagaagtatggaaggtctcatcagagttttaccctaattgcaaggtggcaaattgttctaccacaatttcatgggcactggcagaacacatgagtctcctgagtcagagacaaaggattttattgctcacagcaaagctagcagcatgagcctcatgttcatgtcagtttctcttggccctcaagttcagaggcaacatggagtagcctaggtagatgctgcacacatagtgagtgtcacagatgagaaatcttgaatttaggaaaccccaatagtttattaatggactgcaagcaaacttgcccttcctttttgcagagaaagtcattatctttatttactaagctacaaactgttgcgggaagtcagggactccgaatggagggacctgctaaagctgtgacagaagaacataaattgtgaagatttcatggacatttatcacttccccaatcaatacccttataatttcctatgcctgtctttactttaatctcttaatcctgtcattgtaatctgaggatgtatgtcgcctcaggaccctgtgatgattgtgttaactgcacaaattgttcataaagcatgtgtgtttgaacaatatgaaatctgggcaccttaagaacaggataacagtgattttcagggaacaagggaggtaatcttaaagtctggctgcctgtgggccgggcaggacagagccatatttctcttattaccgaaaacaggtaagagacatattgaattctttccccaacaaggaatattaataattaacagctgtgggaaaagaatgcattcccatgggggtctctaaaatggccactctgggggcgtctgccttatgcagttgcagataagggatgaaacacaccctggctgcatgcagcacccccaggcttgctaggattaggaaattccagcctggtgaattctagtcataccggttctctgctcttgaaccctgttaagatgtttatcaagggcaatgcgtgcacagcaggacatggaagttcatgggtgattctagttttgccctgaccttgtaatctcgccctgaccttctgtctgtgatcttttgtcgcccttgaagcatgtgatctctgtgacccacaccctattcgtacactccctcccctttgaaaattgctaataaaaacttgctgattttacagctcagggggcattatggaacctgccaacatgtgatgtctccccaggacacccagctttaaaatttctctcttttgtactctttccctttatttctcaaaccggctgacacttagggaaagagaaaagaacctacattgaaatattgggggctgaattttccccgataacaaataaacctgcctttggctctggagggagtgatcttctaaggctgttagctatacaaacatatttaggaagacagtcaagaacaaagggagttgggcctctgtttctaagatatgcagaaacaagaaagagccatagagaattgtctcactgcaaatgacatacacattctttgttgatgaaataatatccgctaaaagcctactgtatattaagtgctgtttgttttacaacggctcagtgacaaaagtcaatacattgctgtattagtccattgtcatactgctatgaagaaatacccaagactgggcaatttataaagaaaaagatatttaatgggctcacagttccacgtggctggggaggcctcacaatcatggcagaaggcgaaggagaagcaaaggcatgccttatatggtggcaggcaagagcacgtgtgcaggggagctgccctttataaaaccattggatttcataagacttattcactatcacgagaacagcatgggagaaacccgctgccattattcagttacctcccaccgggttcctctgacgacatgtggggttatgggagctacagttcaagatgagatttaggtggggacacagccaaaccacatagaatcaagagttctttggtaacatcctccagaatttctctcctttgagaatacagatgaacgtttctagattgagctcactttcttttactggtaaacttgccagacttaatgtttttaaggtttctccctccccaacttttaaaaatatttgccattgagcacttactatgtgctaggcacactgaagcttttcatgacttagtgcctgcctatctctgttttacagataaagaaacttctgcccaagtgttaaggcagcttaaccagggttacatgggtgtagactgttgccaatctcaactacgaaaaaaagcaaagtgtgtctttgatgcaattttgccttcttgaaatatatttaccttcttcaaatacttggagggggaggaatgagtacaaatggaatggggaagtgagaagcagaaacagaaaaactgagaaaaaaaattctcttcacattttttagtcaccatttaagctgctatatatacacagtgtgcttggggaaagctgtaaaataattaatagtgcatgggaggaacatttgtatttcaattgtctacatttaaggaacgctttgcatatctgttcaaggcttccaatcatggcctttaacatgaatgagggaggaggagacaaaggaggcccagaggctagagaaagcctcagacagggcacatcaatcgccatagaatcccagacctgaccttgttgccaagcctcgaagtccaagtctggttatctgtgttttttcactgagaatgaagttctgtttgtggcctcttctgtggtttacccatgattgcatcagaacggtgcccataattttcctttataattggcttatgtgggccacatgcaataaaggttattggactctaaccagtcacttcataaactttcagatgcactaattaggtttatatgtgccacaatcctagaaggagagaaaaccaataactttcagccaaaacttatctgaattctcagggcctagagaattctgctttgttagagtaaaaattagctttcatctttcaagtgcagctatgaactaataataaagaccctgagggttttcagtacttcatatttttcacccctgtagctaagaaagtagacagaataggcactattatctccaatttcatgcacgaggccgctgatggcagtttaaatgtcttcccagaagccattcagctaattgttggtaaaactgaaaccagaaacaaaatccttccactagatggcggtgctcactaagctagaggcttgggtggtccggccaactgtctagggcttgtttctcagcacagaagcctgaaacgttttttgtttttttgtttttcccctgaaataactaaaagaagaaagctacattatatgttctaagattttccataacttctctccattccactataatttaatgtggttagtatcataatgcgtatctgaacagggtgtttctggaataagctgctctttttatagaggatggtgttttggaggcagtatttataaagtaaatttctgaagattgggttgtattttatactttaatttacatgattaaaatggatatgggcatcaagaaaagaaatcctacgtctcatacaaaatatggacttacagaaacaaagataaggacttaaaataatactgttgaaagaaaatcataccatttggatacggtctagataacaagaatcactcagaataaatcccaaggaaaaatactgtcttgaaacttcattccccctgatttgcagttgtacgaggaacaatgtaataatatgtaaaattctagtttctctgtgttcagttaatatgctcattctattctaaatattctttaaaagcaaccctgttaagtttataatataaaaaatatcagccatgtgttgggtttaatatatgttactgtgctgctacctgtttgttgacagtttgcatattaagtatttctgtcctggtactgttgagacttgcttttcaaaataaccttgtgttttctatttaatagacttattttttagagtagttttaggtttacaaaaaaattacacagaaagagagctttttatccttctcccccaagtttcctcattgttaacatcttacatttgtgttgtacatttgtattactcagttctcatgttgctaataaagacataccctagactgggtaatttataaagaaaaagaggtttaatggactcacagttccacatggctgcggagacctcctaatcatggcagaaggcaaaagagaagcaaagacacatcttacatggtggcggcaagagaatgcatgcaggggaactgacctttataaaaccatcaggtcttgtgagacttattcactatcacaagaacagcacaggaaaacctgcccccaggattcagtgacgtcctgctgggtctcccccacaacatgtggggattatgggagctgcaatttgagatgagattcagttggggcacaaccaaactatatcaatatttgttaaaattgatgaagcaatattgatgcacattattgttaactaaagttgatagtttaaggtttactctttgtgttatacagttctatatttttgaaaatgtatagtgtcatatattcaccattatagcatcatacagaatagtttcactgtcctaaatgttccctgtgctccatcaatagaacgcattccaccttcttgcagcccccagaccttgggaatcactggcctttttactggctctatagttttgccttttcctgaatgttgtattattgggatcacagagtagttatcctcttcagaccggcttctttcactcagcaatatgtgtaagattcctccatgcctttcatgtctgctggctcttatttaaaaattgctgaataatactccattgcatgaatgtaccatagtttatcaattcatttggtgaattgctatgaagtttgcttctaatttttcgcacctatgaagaaagctactataactattatatggacacaagttttcaactcactttgataaatatttaggagcatgattgctggatagtgtaagtaataggaaagagatatgctgggtaggtaagagaatgtttagttttataagaaactgccaaactgtcaaagtgactatgattttgcattcctaacagcaatgaatgagagttcctgttgttccatatcctcactagcatttggtattgacagtgttctggattttagccattctaataggtatgcagaggtatctcgttgttgttttaatttgtaattccctaatgacataagatgttgaatatgtttgcaaatgctcatttgccatctgtatgtcttctttggtgaggcgtctgtacacatcttctgcccatttttaaattgggttatttgttttcttattgttgagttttaagagttcttcgtatatttggagtacatgtcctttaatagatatatctttacaaatattttctcccagtctatggcttgtcttttaattctctttaaaggacttgtttcttaagacctattttaaagctaatgggaacatttgactcatttgacatagaaaaagatcttttcctgtaacctcttcatttgtaagaaacctctggatttcaagtcaggctctgcttcaagataaaggaagacagtttcctctctcagcgtcaattttcttatgtgtaaatacaataacttgagttgggttatttctaagattgcttgtagcttgaatattgcatgattctatttgatgactacggattatgagcagacaaggattttttttacagctcgtattctctacaagaacgttattactggggatctttctaattctccacatatattgatgtcagaaatggagatttcattcttccttggattggatgctatttaatcctatcttaaaatgtttataattttgtgtaaaggacttatgctgtcctacaaagcaaaatttacagacacacaaacaatgaaatagaacctgacttggtaaggttagagaaagcagagttaagggcaattagaaactctggagtattcaagaaggctgttttaggaagtgtggtggaagtcagccttgaagatgatacttaacatttagttttggaaggaaaaaaaatgaggcatttttttctgcccttcacatcaagatatttggggttaggctaacactttcaagtacacatggaataaacagagactttggacttggaaatccaaaaatgagagactgagtcatggagagaagaacgattcatcagtgtattcagagtattttttttttttttgcgatgtctcgcactgtcgtctgggctggagtgcagtggcacgatcttgactcactgcagcctctgcctcctgcgattgagaacctcaagcgattctcctgcctcagcctccccagtagctgggattataggcacctgccaccacacccagctaattttttgtatttttagtagagacggggtttcaccatattagccaggctgtctcaaactcctgacctcgtgattcacccaccttggcctcccaaagtgctgggattacaggtgtgagccaccacacccggcctcaaagtgttttttcttaattttagttggctttgagtatcctctagggtttggagttagcttgactttggagcttgcttcccatttttccctttgccggaaagtatcccgtccccagtcttgcatcatcacctgatcccagtgccatctcctccaccaaaccttcctaataccatctcagtaaaaagagttattatttccccaagatcctaatctattttgcctgtccttgcctgtttctttgaaatcttttcctacacattcctccttgtactaggctcttgtccacaatcaagctcacccttttcttagggttttttcagtagctcttacagacttataaaactctgcctacaaagttcctcaggcctggcaattttttgtcattaaaatctcagctggctgggcatggtgtctcatgcctgtaatcctagcactttgggaggctgagatgggtgaatcacctgaggtcaggagttcaaaaccagcctggtcaacatggtgaaaccctgtctctactaaaaatacaaaaaactgggtgtggtggcacgttgttgtaatcccagctacccgggaggctgaggcaggagaatcacttgaacccaggaggcagaggttgcagtgagccgaaatcacaccattgcattccagcctgcaaaactatgccaaaaaacaaacaaacaaaaaaaaacaaaaaaagcaaaaacaaaaacaaaaaccaaacaaacaaaaaaactcctcaaccaaaatctattccttcaatgaaactttctctgactccgaaaactaatgtagactctgttaacccatttttactcccaccatcccactccacctccttttccgacttctgttagagtgactgagactctacaattccctttttacttctactggtttcaaagtgatccacgtgatttttattcttctggtgattgttgttacattttaaatatgtatacttagtctaagaagggttaagatttattaatatctttctcctctgaaacaccctccaaaatttagttatcaccatctttttcttctaaatcctcaatacatatttacacttctcaatgtatttactatcttctttgcttattgcttcccgcaatcttcctcttgggcttaatttccttcttgtggaagcatatctcttatacagttatttcattaaggatttgtaagttgttgacacttccagtttttatatttctgaaaacgtttttatttggcactttggttttgaattcagtttgaagttggttgcctgttgaaatctcttccaacagttatttccatgctacgttgaagaagttagtcctttgtcttctgatatatattgttgcttgtaaaaatatatatcatcgatctaattatcatttctttaggaaatttctttctggtagcaattggaatttatctcttttctattacattctgaagcttcactgggaaatagctatgatggattcatttttatttgtctttcttcagattcattgtgcttaaatatcagaatttatgttttttactgattttggcatcaatctttattatttctcttcatctgcttacattgtggttcatttatcttcttattctagtgtcttaaaatggaagttataatcattaatttgagagctttttggtgctataaatttttttctaagtactattctagttacatcccacaacattcgatatgttgctttctcatttttatgtaattcaaaatactttctaacttcccttgatttctcttttaatccatgggttattaagaactgtattagtttgcaaatatttggggggagtgttctagatatccttctcttattcatttctaatttatttccattatagttagggaaaatatttttattttattactggtttttgagaaatttgattgtgatgtgccttgggttaattttcctcatgttcttgtgctttggatttgttgagcttcttggatctgtgggtttatagtttttcatcaagtttggaaaagtttcagttgttataccttcgactctttttgtgctcctttccccaaagactccagttacacatgtattagggtccttggaattgtcccagaggttactgatgttcttattatcattttaaaattatttttctctgtgtttttccttttagatagttgctatctttatgtcttcaagttcactaatcttttcaactgctatgtctattctgccactagatacattccatgtattttttcttctcagacattctaattttcaactttagaagttttggaagtctttttttgcatatcattcctatgtctaattacttcttcatggatgtctggaatatgggtttttgtttaatgttagtgcttaagtcttctattttattatttgttttctatttgttcattctgttttttgttactctcagcatcttttcttgatttcttttgagttacttgaactttgttttagaattctattttcatttatacctaatattttacatatattgttatttttattagtttttttagagacaagatcttgctctgttaaccagaccagagtgcagttgcatgatcatacctcactgcaacctcgaactcttgggctcaagcaatcctcctgcctcagtctcctgagtagctgggactataggcacacaccaccatgcctggctaattttttaactttttttttttgtagaaacagggcctcattattttgcccagattggtctctaacccttggtctcaagcgatactcctgccttggcttcccgaactactgggattataggcatgagccactgtgcccacacttttttaatatattattgtgtaggttctttttagtggttgctccaggtattaaaatatatgtatgaaacatatcccagtctacctgtatcctgtgtgcattttactactttgagtgatgtgtaaaaatctttattttaaaacataaatgtttttattatgttttgtatgcacattgagcacaacattagatgatgttataatttttgcttcattcatcaaatataatctaaaaaaactcctgaggaaaaggataatctctttacccatatttttcccattccatttttcttttttccttaagtttgaggctctttctattaccattttctatctgtctagagaccattctttagtaactgtctgtgggtattttgtaggcgaaaaatgctgttagatttttttctcttctgcatatgactttatttcccccttcattgctgagggatattttcagtagctatagctcagtgttgatagttcttttctttcagcacttaaaaaatgttgtggcacttttgtgccacttccttctggatcccatggtttcaagatgagaaatctgctggcattcgaatagtttttgtcctctataggttagactaacttctttaagaaaaaaaaaagtctttagttttcagaagtatgtcttggtgtatatttattgaccattattctggttggggttctctcatcttctgaaattaggtttatcctttcaccagatttgggaagtttttcagccattatttctttgaatattttttcagctccatatgtttcctcttcttttgtaactcaaacgttatgttagatctttcgttattttcctaccggtctctcaggctgccttcattttttgttttgttttgtttttaagtctcttttctctctgttgtttatgttgggtaatttttattgatctgtctttgagttcactgattttttcctctattgcctccaatctactttttaccctgtccagtgagttttaaattttggttattatatttttcatttctatattttgtatttggttcttaaaatatctgctctttctttgttaagaattttactttccatttgtatcaagaatgttgataattgctattaatgattgaagaatttttatgatggatgctttaaaacccttgtcagataattccaatacttgagtcatctcagtattggcatctattgactgtcttttctaatgaaatttgatagtcctagttcttggtatgaatgactttcaactgtgtcctgggcatttttggtacattgttatgagactctggatttatttactctttttttgtcaggaagtcaccctatttagatatagtacatgggttcagattgggatgagaatgtttagttctctcctaggccatgctgacattactctggcaaaagggaaatgcttactcacttgcctcattgcaaataagtgggtggaagttaagcttcttattaggccctactgataactccctagagaaggcaaattaataacttgtacctccttgttactgctgcatgaaaatataagcccagttccctactcatccatgccaacaccaccctggcgggagaactggagtggcaccaccttcttctactgggtgggagttggatgatcagctacctgctagataggccctactgaagccacagtggggaggcaatgcgagtgttttttcccttggtgtttagctgaagtagggtgagtattataaaaaagtttcttttctgttttgttaggctaacttttttctaggcttctctagcaccctctctgagctgtatggaagacaaaaagaaaaccaagggaacacactaccatgttttttctcaatttcctgtatcctttccacctttcagaatcttcctatcattgctttttgtactgtgtcagggttttctgtttgctgtaatgaccatattaatgcttttctttactgattgtattaactgtgttgatgagttattttcaattggtttatttttcttcccattaggggttgtattttctggattctatgattggatgccagacattgtggattttaatttttgagtgctgaggatttttgtattcagtttttttctttttagaaagacaataactaccttttaaaaaattattatttttagttcttgggtacatgtgcaggatgtgcagttttgttatatagataaatgtatgccatggtggtttgctgcacagatcatcccatcacctaggtattaagcccagcatgcattagctatttttcctaaggctctccctcccccaacaggccccagtgtgtgttcttcccctccctgtgtccatgcgttctcattgttcagctcccacgtggtgtttggttttctattcccccattagtttgctgagaataatggcttccagcttcatccctgtccctgcaaaggacttgatctcattcttttaatggctgcataatattccatggtgtatatgtaccacactttctttatccagtctaatattgatgggcatttgggttgattccatgtctctgctattgtgaatagtacagcagtgaacacatgtgtgcatgtatctttgtaatagaatgatttgtattcttttgggtatatatccagtaatgggaatgctgggtcaaatggtattcttcattctagtaattcatcacataaaaagatctaaagacaaaaccacatgattatctcaatagatccagaaaaggcctttgataaaattcaacatctttttatgttaaaaaaaactcccaataaactaggtattgaaggaacatatttcaaaataataagagatatttttgacacacccacagctgatatcatactaaatgggcaaaagctggaagcattcctttgaaaaccataagacaaggacgtcgtctctcaccactcctattcaacatagtattggaagttctggccagggcaatcaggcaagagaaagaaataaagagtattcaaaaaggaaggggaaaagtaaaattgtctttgtttgcagatgacatggtcctatatcgagaaaactccatgatttcagaccaaaagcttcttaagctgataagcaacttcagaaaagtctcaggatacaaaatcaatgtgcagaagtcacaagcattcctatacaccaatagcagacaagcagagagccaaatcatgaaagtactcccattcacaactgctacaatgagaataaattacctaggaatacagctaacaagggaagtgaacgacctcttcaaggagaactacaaaccactgctcaaggaaaccagagaggacacaaacaaatggaaaaatattccatgctcatggataggaagaattaattatcgtgaaaatggccatactgcatgaagtaatttatagattcaatgctgttcccatataaactaccatttacattcttcacagaattagaaaaaactattttaaaattcatatggcaccaaaaaagagcccatatagccaagacaatcctaagcgaaaagaacaaagctggtggcatcacactacccaacttcaaactatattataaggctacaataacccaaacagcatggtactggtacaaaaacacgtagacccatggaacagaatagagaactcaaaaataagatcacacatctagaaccatctgatcattgacaaacctgacaaaaacaagcaatggagaaaggattccctatttaataaatggtgctgggagaactggctatccatttgcagaaaattgaaactggaccccttcctcatgccttatacaaaaattaactcaagatgtagtaaaacccaaaactataaaaaccctagaagaaaatctaggcaataccattcaggacacaggcaaaggcaaattttcatgatgaaattgccaaaatcaattgcaacaaaagcaaaaattgacaaataggatttaattaaactaaagagcttctgcacagcaaaagaaaccatcatcagagtgaacaggcaaactgtagagtgggagaaaaattttgcaatttatctatctgacaaaggtctaatatctagaatctacaaggaactcaaatttacaagaaaaaaacaaagccattaaaaagtgggcaaaggacattaacaaacacttcttaaaagaagacattcatgcagcgaacaaacatatgagaaaaatctcaacatcactgatcattagagaaatgcaaatcaacaccacagtgagataccatcttacaccaatcagaatgaccattattaaaaagtcaagaagcaacagatgctggcaaagctgcagagaaataggaatgcttttacactgtaggtgggaatgtaaattagtgcaaccactatggaagatggtgtggcaattcctcaaagatctagaaccagaaataccatttgactgaaagatctagaatcagaatttttgtatccttttacaaatttttgaactctgttttagttagaagttacttggaaactgatccttttggtaaaggatatttaagatttgttagatgggaccagaactgcatcttgtacagagctaactattctctatgaatggagaaagactcttataagtattctccacatcatcttatgaattacaaggttttccagcctggcagatgagaacaggtgttattcccagccatgtaagactgctgggcactgtttcctctaatcttctcagattgctctttctctagcctcagctagtttcctcacattcattctcacatgatgaatactcaaaggaatctctctacaggtattcattattttctttctgtgaagctttgtcttctttggtactctgtcttgtggactctagctgccttggttttccccagattctcagcttcatctcttcaacgcaaggagtccaccaggttccacccaggctccacttccctgtgcggctacctgaacagtctcatgtagcaagctgagacagtcccatttttaaactctcagatatcactctcctttggtgtttgatgtccaatctcttaaaaactactattttatatattttatatttattgcccttctaaaagttgttccatagggagaataaatctggttcctgttactccatcttggccagagcagaaatcccatggatattcttaaaagggggaaaaagaataagaaaatgcagctttgggtagaggtgtgaggaaatgagaaaagcctatgttcaggtgaagctggaggagttcatgataatctgcaaaaatacttatcacaaaacagccacaatgtatttttcctccacacttggcttcaccccaaaattattatttaatgcccagtagtgagagggccctaaaatatgcagctaagacaactgtacaatgtctgtttttagctttcttcatgggacaatggaaagaaactaactcttctcactaatttccaccaaatcttacctctttttcaaggacaaagtcaattacttctggaatctttctgaagctaaacttccttccaccttcatacaaagttccatgcagccaaatctcagaatgattaattttactttcacagacctagacaatgttataattggaaggatatttaaagatcaaaaatctctcattttacatatggaaacaggaaactgaggtgtggagagaattgatccatataggcctttgtgttagatacaatacaatgaaataaccagagaagatactgtttttcatgtgtcgtggatctggatacaggctgtagacatcacgcttgcagacatcaaataatttactccgtgttacatgaagaaatagagatggggtcatttggttgtaaaatgtgtgcatatggatttgcatacatctagtcctttctcaaaaaaggagctcctattttctggtcctagagctagaactacctttgctgtagccctggaaaaacttataaaaagtcaaaaaactctctgattcagaggattctgatataagttgatgtcataatattatgacgtagaagccagagtgtgggcatctccatcctagctctgagacagaaattatgaacaaggttaatataagaaagaggaaaaccccttctcccattgcaacatttcaaaattcccttccagtttcaaccactcagtgtgctatattatgtgaacttacctcagggatagttgcactgggaagttcttcataaacagtgggagagtggggcttttctagactttctggcacaattacaggcacttaagtcttccctctcatgtccaacatctacagtcttggcagatatcaaaatgcattacagatttataatatatcaactgtgttggaggggggcatagatgaaagcaaaacattccaaaagaagggaattgcaggttataagtaggtgtctctgtttaatagatttaaaaaatactggcagaacatgacaaaaactactaattaaactggctttgattccagatccctgatgtttgagcagggaccccagaactctcctaattcccactacagccacctcatttaacattttaccctgttcaggtaatcccattagagcaaatggtttggaaaaacaaaacaaaacaaaacaaaaaaacagaaaacagcaaagataatttttgaataatgaaatgatctctaagtgtcaattccattggttcatggattcaaatattcaatattacttttgataatatctcaaataactaaattcttgagatagcttcttagagttcttgtaactagacttatgttggccaggagatttaatcattgactgcttatatgcctaattctgtgatattcacatactaggagtttgggccattttgtggttgatacaaatgtcataggataaagggttcttattgtcacataagaagactgttccaaacaactgatgttgtctttttaggttggtgatatttgagctgtgatgcctatgcagagtgcaaagtgagacgcagagctttcacaagtctgacatatgtgtgctctgacaactctgacgtaaaccagcagtacgtccttggagtgcctgaggctttatgtacccatttagagaggaaaactagtttatttctttatatatatgtatatatcatatatattatatatatataataaatatattattattttttatataatatataagaagaaaaatactttcaaaacttgcccccagtttctctcaccagaagcaaacatgactcttagactctcttttcatgctttaatattttctttctaaataataagtgtggcaaactatatttttcagtaagatctccatctcatgtgctcttcttgcaatgtaacattgatactcctcccactgagatgtggtgtctgtgtttcttcttccagaatcaaggtgggcctgtgattatggtgaagtgacacttgatgacttcagtgactaggtcataaaaaatggttcagcttccacatgaacctcctggggcaattggcttcagagtcctgagctaccatgtaagaggtctgaagctgctatgctatacagtaattcatgcagtgtagagaagcctcatgtaggtgcttcagccaaccatcccagttgaggtcctggccaattggcagaaccagttccatacatgtgagataataataaaatgatgactattgtactaaactgctgaattttggggtaactttttatattaatacataactgaaacattcatgtacatggcaatcttctatttcattaattttagatatactctattatgtatttttaatagtacttgatcagaaaactctcttataccattaactcttttgcttcctctccctatacttctgatatagtattattatacatttttgttaatcattgcatttgcatccttatgtctatagtgcactttgattgttccttttcatattcttgtataccttaagtgattaattagtaactttttgatttttaatctggttagttttctttgtactaaattgcttttctctcatttcaatagtcttcagtataatttttcattaagttaattatagaaggtaatctaacaatttcatttttttttctggagtcatcccacctggaaacttccattttccttttattttggcctgctgttttcttggaaattatttccagctgtcatcctgagactttttgctatcattttagaaacttctctgatgtttagaaagtttggattccctatttctcagatttcatgctgtcttcttacttggtttaatcttttattttggtggaaaacatccttgttaaaaaaaaaaatatgtaccacagcagaagacctgacaataatagtcctgaataagcctgtctctgaaatccaggttggaatatgtatataaaaatttgggggccgggcgcagtggctcatacctgtaatcccagcactttggaaggccgaggcgggtgcatcacgaggtcaggagatcgagaccatcctggctaacatggtgaaaccctgactctattaaaaatacaaaaaattagccgggcatggtggtgagcgcctgtagtcccggctactcgggaggctgaagcaggagaatggcatgaacccaggaggcagagcttgcagtgagccgagatcgaactactgcactccagcctgggcaacacagtgagactccgtgtcaaaaaaaaaaaaaattgggggagcttgcatacctgaaaatatctttttagaacttggcacttgaaaaattaaggtttcttcacagcaactttgcctaagtttgaatggtaattttcagcttttggacaatgctgtgaattgctataagtaggcgcatgcatttctgggaataaacttaacttatataagggaagcgggaaaaaaaaaagtgactggcacctaatacggagcctgcaaaaagtacaactactttctagactaggggcagggaaattagataaatatatttgtaggaattgtaagtgaaatacaattacagaaattgaagaaattcaaacccttgtacattactggtgggactgcaaaatgattcagccactgtgaaaaacagtttggcagtttctgaaaaagtaaagcataaaaataccagctgacccagaaatttcacccgtgggtatattgaagagaattgcaagcagatattctaattgatattatacagaaatatttatgtgtgcactgttcacaatacaacccatgttcatcaataaacaaatggataaataacatgcggtatatccatataattgaatattatttaactataaaagagaatgaaacactgaccagctacaatgtgaatgaaccttgaaaatggttatctaagtaaaagaagccagacacaaaaagttacacgtggtatgattctatttatgtgaaatatacagactacataaattgataggaacagaaagcaaattggtggttgccagggttggggaaaggagggaatggggcatgaccacttaatgcgtatggagttttaggatgatgaaaacgtcttggaactagatggaggtggtggttgcagaacgttgtgaatgtactaaattccagtgaattattcactttaaaatggtttatgctatataaatttcacaagcttaactcaaacaagtgaagtagaaagatgagtgactggctgtaataatgagcctataagaagtattactactttctttttttttttttttttttgagacagagtctcgctcagttgccaggctggagcacagtggcgtgatctcacctcagtgcaacctctgcctcccaggttcaagtgattctcctgcctcagcctcctgagtagctgagactacaggtgtgcaccaccacgcctagctaatttttgtattttttagtagagatggggtttcaccatgttgaccagatggtctcgatctcttgacctcgtgatctgcctgcctcggcctcccaaagtgctgggattacaggcgtgagccactgcacccagccaagaagtattactactttctaggctggctgggaaagcaaaaaaaaatacatttgtaagaattgtgtgtaagagggagaaaaagtgagcactggcatgtatataaatgaaatgtctattttgactttctagaaaattgccttccttatgtaacgctttttagatactataatgttttggatatgagaacattctagagagatgagctctgtctagataagttgttcctgagccacacacatatattttgtgataataatctaaaaatttgtgatcaaatgagaatacagagaagacagatatttaaaaatattaagtacaaggcaatgttcaagaatttctacctctaaagttatgtttgccaaataattttcttaaaaaaactataattaaaaaaattaaaaagagataaacaaaagacaaggtgaataagaacctcatcttagagggcctccctttgaccagcctgatgcatcttcgcctcatggagtgcatttatgtgcacaagagtgagtgctgctcttctagaaacatgctctgagtgagcgctggccgataaacccagcccagccagcagcagagctgttattaagctgtagccctagagcttcccagttttattttattgtttctgggatgcaagtactgtcgagttcttaggcaactatctttccaagcaattaagtcccccatctcagaagccacagaaaggaagtaaataagaagggggaggaggcagcttggtgggggcttccaggttatttattactttaataagtctgggctcctcccaacccggcttagactcctgtttctgtcaagctcccaaggacaaacgatcgcttaatcgtcgggtttgtgggccgaggtgggcgccaagcacagtttattgtgcaggaaaggctgttaagtaagacgatgttatagtgccctggccaataagtcattaagcagaaattaaaagcagaaaacttcccagtacctcatatctaacttgtattaccctcttaaaggcagagtcaattgtgtttggagctgaagataaaaggtaggcccagggagaaggttctatcagtgaagaaggagaatagaagagactggctttagaatcatcctgtgtcctgcattcacaagggtgtagcccctaaccagttcaatctgacagcagctgctatgcctgagaatggcaggctgccaaactcctggcaacaggttttcatctgttatcttaattgaactttattttgttttcatttttattattattttttaagttctgaggtacatgtgcaggatgtgcaggtttgttacataggtaaacatgtgctttattacatccttgcaatatatggggcacattactgccaccacatgagaaggcagctagagccatgacacttgtttaggtccccgtcaggtgaaagctgggctagcctggaatatgggccaccccgatcccagcttctgtgtttcactgggagcagaaaactgtgacctcagggaaatcagtctcaaacttgagcttgagttcattcaggcagtgtgatattctcttctggaccagagtgctgtttctcccctccaggttgagggaataaagtaatcgaagaactttgaataaaggccaatcacctgatcactacttctaacagtgtgacaaagaaattcagaacaagtgaataataagggaatggaaatttca

SEQ ID NO: 191 - DNA, 14121 bp, Homo sapiens
ccgtaggcatgaggaatgtgctgaaagggatcctcctttattctgaaatgtggcccatcaggcctcagctagagattcttccctaaggaagtctggagtcccgtggctgtaaccacagctttcagaagcggttctcaaatgtgggcagtttgggcaccgtctggaggcattttcagttgtcgcagctgggaggcatggtgccactggcatctcatgggcagaggccagggatactgctaagtacccccacagtgcccaggacggcccccgccacagagcatcatttagcttcaaatgtcagtattgctgaggctgcgcatccctgcgttggagtcacagtgccctgagtccctgtcccaatgctgcacttgcccttgaccttcctgcctcctcgaacctcagtttcccatctctaaagtggagtgatcctcacatgcacctctctcagctagatggagaggaaacgccatggcctgcatgtagaatcacactcagtggtcggggttgcagctctgatatttggggaggccctagccatgggggctaggatctgggctgtggaatccacctgtgtgactatgggtgggtcgtatgtcctcctgagcctcagtttcctcatctgggcatcaagagaggaatagggcagcctctaaggatgtgaggattaaatggtttaatgtctgcactcggcacatggaacctgataaacgtgcgtgagcagcgccatcctgactcagcggtgtggttctggggtctcctgagacaccactgtgtgcccgacacccagcttgcggcctccttccctccaccatctctctcctcatccacgagtcaggttaatcctcccccttgaccccacacaccgcagcaaagttttaggaagttgcctgtggttgccctttggtgtatggactccagggtggctcctgtggaggtgggaagagccttgggggcttccaggcaagagaggtgagtggggcttagcctaggctgtggtggtggggttggtgaagagggaaggaattggagagaggccctggacacagagcccagaggagttgcctgcaggttggatgtgtctgttacggtgagctgcaagcaatctgagggcaggagggtacctcatctccctcagcgtctctctagtgtgtgaggctgtgtagtttgtggatttgaatagacttggagcttttggggcatcttcctgggacaacctcaatttatttggcatcttctcagagtttatctgtgggcatggcaggagtgaccccagactgggttcagccctctcttcctggctgagcctctttgggtcttagtctgctcatctgtagaatgggaatagaatccttcactctgtggcctgttgttttaagttttcaataagacctggtattggaagcccccatcaaagtgaggagctcatgaagcacaggcgttgggcaccagatgcaggatctcttcctgatggccgagcaatgtggcgctaagcggggtgtctgcggttcgccccgcccaggtcagcagcacgacaaggggcaggccttggattctcttagacctgctcacagcctgggcttctggggccctgaatgtggccagtgctcaggtggttgggagctggcctggcagcacctggggctcccaaacacaagggaagacaggcagctgggatggtgaccctggggaccctgctatcctgtggaggccccaggattccgacttgtacccgggcttgcttggtgctgtcttgggactgtctctgggctgggacagtgagctcttggatgggccctcggctgtcagtgcctcagagctgcagaaggtcagagccaggcctggggtggaccaagtggtatctacacccctcccaaatgtgtccgaactgggtagttttgtgcagctcactctgcctctctgagccttggtttcctcacctgacctgcacagtggaagaggagaagagcctgacaggaaggccggatcaagctggtagggtttcagtgcaggccctggcagagcagccccgaagcttgggaaggccaggaaatcccgcgctggtctccagacctgcctgcccgaggagtcgagcttctgatgaaattcagctgagatttcggttttttgtgctctgtaccctgacaaggggcaggaatcgggagccagcctcggctgtcagtgtcctgggctggttccctcccacctcccgcttaaaggtgtcattagcaagggcaagacgtcttctaacaggtggaaacaacttgtcaagacagcctgtggctgctgcgtttagagacccagagaccctgaatgtggactaacgcccccagaatgttcagaattaatgtgctgccccaggcagtgctggggcggggggcatggctctgactcctgcccttgggtttgccccactctgccctcttccccttctcctgttccttccccttctcctgttcctccttctcctgttccttccccttctcctgtccccccttctcctgttccttccccttctcctgtcctctcttctcctgttcccccttgttctcgttccccttctcctgttcccccttctcctgtccccgcttcttctgtctccccttctgttccctccttctcctattccccgcttctcctgttccccccttctcctgtccccgcttctcctgttccccccttctcctgtccccgcttctcctgttcctctcccttctcctgttccccacttctcctcttcccaccttctcctgttcctgccttctcctgtccccccttctcctgttccccctcctcctgttccccccttctctggttccctccttctcctgttccccctccttctgtttccccccttctcctcttcccaccttctcctgtcccccacttctcctgtttctgccttctcctgccttctcctgttgccccttctcctgtcccccgcttctcctgtctctgccttctcctgccttctcctatccccccttctactgtccccccacttctcctgttcctcccccttctcctgttcctccccttctgttcccccctctcctgttcccccttctcctgttcctccccattctcctccctgttcctcccccttctcctccctgttcctccttttccccctctcttttcctccccttcctattcttttccctcttcccttccccctcctcccctccacttacccctctccctccctattcttttccctcttcccttccccctcctcccctccacttacccctctccctccctgtccttctccctcttcccagctaattgtattgaggctgtaccttgtgataggaactttgggtagctctcttagctcatatcacaccatccctggggaagggtaccccattgtacaggtgggtacacagaagaggggagagatgcccccactacaatgtgctgggagcagaatttggacctggatctgagtccagctcctccatcccctgcaggaaggatctgggctcttggggtgtcagggggcaactacctcttcatagcaaagcttcattcgttaagttcctggttctgggctattgtccctgtctccgaggatcagagaggtgaagtcccctgcctgggttcagatggttatggagtaggggtcctggttcagacccatggctgtctttcttgccagcagcacttctttctttggggtgatttttcccccaggggacactgcagtgcctggagacattctggttgttataactggggtggagggtgcttctggcctctggcatgtagctgtcagggatgcggctaaacctcctgcaatgcacagcacagcccccaccacagagaattgtgtggtcccaaatgtcaccagtgctgaggctgagaaaccctgcaccaggcccctccccagctgaccctatgttcctgcaactaagccagcagtagacatacctgcagcagcaggtgttggtgctacaggtgaccctaggtcctcgacctccccatctgtctgccacctgggcctgggcctgggcccggaataaaaggtgcaccaagggtccctggcttcagcattttttgttttcaggttgcatatcagactccttcttgcctcctgaggtcccttgggacttggctccaggcagcctccctgatctaagacttcagcagccgcctcaggactctgcatggccaaggtcccctctgccccaggtcaccaaggtcattgtggtagggaaggagaagagagggccctaagaaaaactccagtcccactagttcctggaacttgcctaaggccaggagaagttgctgccatcgtgggttctgtatatgggattcaggactttggttcaggtggtttctgccaggctctggccagatgccagcctaggcagtgtcctggcagtgctgagtgacacgtctcgggcacagagaggagtgggcgcctggccctgagcagaggggaggcttgttgggggccagcacttgatccactgagccggaccctcagaccctgggttgccctcctcacccccacccccacctcatctctgcttcctgcaacatctatatttaaaaatgttgacagataataatggtgttcagccccaaaatgcagacaggagcttcctgacaattgcagtgctgcgccgggttggaggttttctcagggagcggagcgagtccccaggagcaagtgagagtgccagggctgtgagggctctttgccaatcttgacctttcagggagatttgagagaaagactccagaagcccgcggggagagcaggggttctggggaagataaagcccttcatccaggatccctctgtgaccataaggtgagttgctttgccccacatctctggtgaggcagagggcagggactctgcttagggagcaggcttcttaaaggcaaagggtttgcaaattctagcagcagcagggccctaagagaatggctttttttttttgttcttgaatcggatgactgcatttggagtctggggtgaggggtgggggctgcccctcttggagccacagatgggtcatttttatgtatcaagggagtcagaccaggatcagccctgggtttctggcacagagtccagaaagagtcacgaaggtcttttgtttgcatgtgaatggtattttaacctattacttctgggctaaaaataaaaattcccctcagatgcctttttgtctgtagattgtaagatcgtttccaggaaataatagattgtcattgatgtgcgttttgactgcatggtgtcctattcttaagccaggttttataaaaattcaaagtagaggaggtttcccacagtggagattgaagccttcatttagtgtcaggaacatatgctccactatcaggagtcattgtccttccgggatctccaccactgaaccctgggtgggagtgtgggagtgggtgagggagaaggcacacttggcttttgtgtggttttacatttggtatcatttgtggacttttggttctgaaaaatggtttgcaagtgaagttggatgtctggagttggggcccaagaaggcgatggagaagtgaattctaattcacagttaatatgggtcatggttaagttcttggaagcaacattggtttccaaaggtgcctgctgcgtttttaagctgcaaggttttatgtttttttgacccagtggaaaatggcgattcaggatcccaaggacttcaggagaggttgtctgaatgctaaaaccccttccctgaaatgcttgctttctttttagaggacaggaaatatgggaaattaacagtccttttgtggagtgtggtttgcgtgttgttctttgaggaggaattacggaattatgtgcgtgtataatgatggtaaccacatacacaatcgaagaataacaagtcagaaaaatccatggtgaggttcattcagaaataatcaagagtgtattgtttaattaaggagaggatcagaggaatgcagtcccagagccaccatttcggttgtcacctaggtgcaactctcagcagaaggaagcattcccaataagatgttctgaaaacgtactgccgttgaatctcacaactttcaccccacaagctgcaataagaggccagtatgaaaatgcgctctttcttccccatacattttcttctgttcctgagccgagcccataggtagcttggcagtttgcaattctctgtctacacggaatagatatagatttttttttcctgtatgttttgggtattaactctttggttgccaagctgttgagccctgagtctatattatacaccttcagcccgtggcttacagggcttcaacacatcgttgttatataatgcagtagttttgcttgtggggtgactgttcatatcgtggatgctcagaaaattctatttttaaagtataaaataccactcttcagagcagcctgctcactcctgcctccctgggagccacacgctttgcaccgtggagttgttggcatgaaggcacatgacatatggatgggagtgcgttcctcctgtctagggcctcttaggacccgaggaatggctggaggcagtttctctccagtcctgaggttgatgatccgaagctcttggtgctgagcctgtgctgctatttttagcttcctttcttccctgcatcttgacataattcgacatgtcgcagctgaatctcatctacttgcagagcttaccgtgttttgtaatctgtgttttgtggggcagaaatagtccttgccagagcatattatatcattattattcagggggaaagttatgatactatcaattaactttagaagatgcaaaacacaattgatcctttgattttctttctactgctaatttcctggctgggagcacctggagggtaggcactcctcctccttctgccggaccagaaggcagcaagcagtggttctcacatcttgggaacctgtatcagaagcacctggaggggctgttacaaaggcaattgcagccccactggcagagtttctgagttagcaggtctgggtggggtgggggggcaagtaatttgcatctctcacaagttcccaggtgatgctgacgccggtccagcactgcactttgaatcacagatggagatcacggcagagggttggtaaatatttagggggtggacgatgcctacatgcagagagccaatttaagaaatatacagatggtggagcaggagattttcagttgttgtgtatcctgtccacgcggttgaagatggacttgattgaaaaagaaattaaagttgaaataaaattagctgactgagaggatggctcctgacagtgtccaatgctgtgatgttatttagggaggatgaagcatcacgactcagacaacttactttgagatggccaacagcacacacagacataaatgaagtgcgtgtacatgcacacacacgaaactcagcaaaatattaactgctgaaacaataggtgttcatattattctaatttcatactatttctatttctaatacttttcttcataacaaacattgtattaacatggcaaacacaataatagggcttaggacagcttttcttgtgtgtgtgcttaatagtaaatcaaggtcacccacatgttcacagctgtgttgctctgggtggcatgggcatcggtactgtattagtccatttttacactgctgataaagacgtacccaagactgggtaatttataaagaaaaagaggcttaatggactcacattaagcctctggggagccctcacaataatggcagaaggtgaaaggcatgtcttacgtggcagcagacaagagataatgaggaccaagtgaaaggggtttccccttataaaaccgtcagatctcatgagacttattcactaccacaagaacagtatgggggagactgcccccatgattcagttacctcctgctgggtccctcccgcaacacgtggaaactataggagctacaattcaagaagagatttgggtggggacacagccaaactgtatcaggcacacgcatcgctttagggagttctcatttccttccattcaacctgatcctttatctgcttgttctttcctcctttcccttccattctctttcactccctcctccctggcttccctctcttctgctctccctccctccttccttcttcctgtccccatctcctgtcttctggtgactctgggtcaaaggaccctggtccagaagggttccgtgtggggatgtgttgtgctgaacccctgttaacctcagtagggaaggtaccaggttcaagaggccaaagaagagacctggagccagcaaacaagacatacagttttattatggacttacatgcagggaagagagtccagtggtggcaggttgaagagaactgtcttaacatacagaaacggtccagtggtggcaggctggacaggagaactgccttaatgttcagaaacggtccagtggtggcaggctggacaacatatccaccttcctacagtctggtggtggcagactgggcaagaaaaccacaactgcaaccgcctgcgaacatcatgcagtttacgcagcattttcatttagcaccctcctcctaacagccctcacctggcaaccttcatgtaacccaagcttgtccaacccaaggcctgtgggacgcatgcagcccaggatggctttgaatgcggcgcaacacaaatttgtaaactttcttaaagtgttatgagatttttttttttagctcatcaactatcattagtgttagcgtattttatgtatggcccaagacaattcttctttttctaatgtggcccaaggaagccaaaagattggacacccctgatagtaacccaaaactcagggcctcaatcccctgtacagcccgtgttccacaggacaggccggaggctcagatgttgtggtagataggaacagatctctgggtgggccactcccggattccctagtttggaacacacattcaggtgcacctgtcatacagggtcattctaagggtatgcttaaaatattgatgtcaggtgtgtttaccctgcaggatgctgtggcatctgcccaggaaaaagttgaattatgccagttattgttttcccagggttttcaggctgcctccttgttttttaaataaagttttattagaacacactcacacccatttacttacacacttctctggctgctttccagcagcatagctgaggcagagaccatagatccacacaactgaaaatatttacttctggcctgttgcagaaaaaatttgcccatgctgatttgtttctgtgggctggctgtcttggagattccacacgtacacacatgtgcacatgtgcatacatactcatactaaggacatgcagcaagacgttaagggttgtggagtctagagtacatgtgattgttcattgtaccattttttttttctactttttcacgtgtccaaaaaatttgtaaaacattttgatgactgtggcagtgaccaccccagggtctctagaggaatgccacaggggtccatcccaggttctgagtcttcaacatttgcctcacccacttggcaggttaatcaaatgggtagatgacacaaatcaataaaagcattaacaaagtgtcccatatattcaagagccaaacagatatctcaacagactgttagggaggctgagtcaacaaggagaagtttaatgttcataagcttcaggtatccagctcagatttacaaagatctttgcccaggtcctgcaaggagcagactttgataggaatcaggcctctgggccaggcatggcggctcacccctgtaatctcagctctttgggaggccgaggtgggtggatcacctgaggtcgggagtttgagaccagcctgaccaacatggtgaaaccctgtctctactaaaaacacaaaattagctgggagtggtggcacatgcctttaatcccagctactcaggaggctgaggcaggagaatcatttgaacccagggggtggaggttgcggtgagcagagatcgtgccattgcaccccagactgggcaacaagagcgaaactctatctcaaaaaaaaaaaaagaaagaaagaaagaaaaaaataatcaggcctcttggctggacgcggtggctcatgcctgtaatcccagcattttgggaggccgaggcaggtggatcacttgaggccaggagttcgaggccagcctggccaacatggcaaaaccccgtctctactaaaaatacaaaaattagctgggtgtggtggcgtgcacctgtagtcccagctactcggcaggctgaggcaggagaatcgctccaacccaggaggcagaggttgcagtgagccaagatcatggtgctgcactccagcctgggcaacagagtgagactctgtctcaaaaacaaaaacaaacaaaacaaaaaaaagggaaagaaatctggcctcttaatggaaccaaagtctgcggggtccctagagtgtgtgcaaactgttccagtcactgggacatcagtgtgcaaagcctcctggagcttgtgtgctagtgggagaggacaatgaacggcacctataaccagtaggggatcgtcctgcatgttagtaataagtgttgtgggaaatgaacaggagaagtagggggaggtaagagaaggtataaatgtggtaggctgtagacatttgagtattacatggagtgtcaggattggcatcattacggaggtgacatttgagcaaagccgtgaaggcggtgaggaagtgagccatgtggatatctgaggcaagagcctttggggcaaagggaaccttcagtgaagacgccccgaataagagccggcctggtgggttccaggaacagggaggaggagcccgtggtggctggagtcacatgagattgctggggagggagacgggagagaagcagggacattgtagggaggggcctctgccagcacttgggcttttgctctgagtgtgacgggtcgggggggacattggagggtttgagatttaattatgattcatcaaataacttgagaacaggctagtgtccaggtggactgaccagcctagcagtcattgctgcaatccaggcgggagatgatgctaactggccacagtgaggttgtggacgtggacacttctagaaggtagaatgatgcagttggctgagggagcagatggggaaacagggacagtggagtttcaagggaggactctcaggttctgtcgtgagtaacagaaggatagagcgttggtcctggcctatgaggggaaggccgtggtggagcaggtttcagggagagagcagttcaattttggctacagtgaatttggagcatctatttgacatccgtgcaaagatgacaaattggcaattggctgcacaactctgtgcttgggagagaggtttgggctgaagctgtgcattcgggaggccgcagctgagcagaagctgaatgtgagctaacgcgctctctccctgacttagtcatttgtctgccacctgtagtctaatttgccaaatactttcttttaaaccaggtcttttttttttttttcaaatttaaactcattttaaaaggatatctatgttgcacttttaagtagaaatccaatattgcttgcctttgataaaaggtaaccataaaataaaacaatgacaacaaaacaacatttagttcaagttaggcatagtctctcactaaggattttgagccagagggtcttatgtattatccaaacacagagatcaacaagtgtcagatgccagggtcgtcataataccaaactaagactctcctcttgaagttcttggaagattggagggaaattggcaagaaattagcttctgttgctttgtcctgggtccacgaatcccttaaagtccccttttaccctgttatgtgcctggcccttggggagatgctgagctgagcagccgttatagtgggtagaagaaggaagcttggggtccagcttgaccctctgctagaggttgggtttgccttaggactatgtattttctgaaaggcaaactgcaatttgcaagaacgcagagaggggcaatggctgtttattctagaacagacttgggggatgagaaccttggaaagaaagggtgggatttttcctgcatggttctaggatgtggccctgcagccagctgggaaggataaaaggatacaagtgggttggtttcacttccctctgggcacaggctttctctctgagaattctcactggggctcatatcttttaaattaagtagtctgctcctgaataatatctttctttggggctgtttctttttcagtttatatattggggtccctttttgacattataggctttcctcaaatgcctggtgagccaggatcgaccttgttcattgcagaatgaagcagcaaagagctggtgtgtgctcacggtgtgtttcagctggtgggttttgtttcaggttgcccaggcctggaggtggccttggtgctgaggggcctttgcagaaccttctctttgtggctggtctggagacaggcaaggatgctcctgtactttttgcctggagatgggagttgtccatgttatctgcaatccaccctaggctgatggtgagggagggagtctgctgtcataggaagcatgtaaacagactcaggcttctctcagcatgagaagggattttggatctctgaggtccttcctactgtggatttgcagtttccctccacaacctcacccgcaggaatccggaagcgcctgatgccttccctgggctgggagcccctagagaggaggatctgctgagctgttatgacatcgtgcccacaactgtgcaggcatttgggagatgctctgaaaatgcccgatgaagggttgtgaggatgaaagaatctgctgctgaacacaaactgctgggctccaggctactgagcccaacttattccatggcccagcatgtcccacggctcagcatgtcctgtggctcagcacgtcccttggcttcccatggctcagcacgtcccgtggctcagctctcactcctttgcttctgcaggtcccttggtctggcgtgtcctccccactcttcctgagttctctgaattctacttgtggctccagggccccctctttcatgaaaccttgactcaccacctccacctctttccccacctcacccaccactgtcctgctcttggggccctgcacccacctcctgctgggcccctgcttctgccctgcagtgctgtggcccccttcctgcccagcagctgggaaggcatcctgaagtgcatatcagatcttgccctgtccctgcctcccattgcctctggaccacagcctctgagatcctgcctgccttcctcatcttgtcttccattcctggggaacagtggccacatagccaggtggctggcagcacggacttgggagaccctaccagcctgggtttgaaccctgtctctaccgcctgcttgctttgtgacctggttcctcattttcctcatctgtaagatggtggtgttgaaaggacccgtctggtagggttgttctgaaggttgagatattcaaatgctgagaacaccacccagcacaaggctggtgaatgctccaggagggttcactgcgccgttgccattttcctgttgatcctggagttccggccactctggcctctgctcacatagctggaactcgtcagaccatctcccacctcaaggtctttgcctctaccgtgctgtctcaggacactcgtcccctgccttaccattcggtcagcccattatccttcgggcctcaggttgaatgtcacttgctgagagcagccctctctgaccatccttttagagtggcttccccgcctcacattccccgttacagtctggcctgattgtatctgccagtgggttctgcttcccccaaccacaacttgcccatcatgagggggcagccttgcctgttgtcccctgcactgcatcaacactgcctggaccagaggccctcggtaactgccagttggctgaatgaatgcaggaatgaggcatgaacaatgcaaagatgctgaaccatgacatgagggactgtttcattcatgtggcatgggggtgggctacccccccca

SEQ ID NO: 192 - DNA, 2119 bp, Homo sapiens
tttgccttaggactatgtattttctgaaaggcaaactgcaatttgcaagaacgcagagaggggcaatggctgtttattctagaacagacttgggggatgagaaccttggaaagaaagggtgggatttttcctgcatggttctaggatgtggccctgcagccagctgggaaggataaaaggatacaagtgggttggtttcacttccctctgggcacaggctttctctctgagaattctcactggggctcatatcttttaaattaagtagtctgctcctgaataatatctttctttggggctgtttctttttcagtttatatattggggtccctttttgacattataggctttcctcaaatgcctggtgagccaggatcgaccttgttcattgcagaatgaagcagcaaagagctggtgtgtgctcacggtgtgtttcagctggtgggttttgtttcaggttgcccaggcctggaggtggccttggtgctgaggggcctttgcagaaccttctctttgtggctggtctggagacaggcaaggatgctcctgtactttttgcctggagatgggagttgtccatgttatctgcaatccaccctaggctgatggtgagggagggagtctgctgtcataggaagcatgtaaacagactcaggcttctctcagcatgagaagggattttggatctctgaggtccttcctactgtggatttgcagtttccctccacaacctcacccgcaggaatccggaagcgcctgatgccttccctgggctgggagcccctagagaggaggatctgctgagctgttatgacatcgtgcccacaactgtgcaggcatttgggagatgctctgaaaatgcccgatgaagggttgtgaggatgaaagaatctgctgctgaacacaaactgctgggctccaggctactgagcccaacttattccatggcccagcatgtcccacggctcagcatgtcctgtggctcagcacgtcccttggcttcccatggctcagcacgtcccgtggctcagctctcactcctttgcttctgcaggtcccttggtctggcgtgtcctccccactcttcctgagttctctgaattctacttgtggctccagggccccctctttcatgaaaccttgactcaccacctccacctctttccccacctcacccaccactgtcctgctcttggggccctgcacccacctcctgctgggcccctgcttctgccctgcagtgctgtggcccccttcctgcccagcagctgggaaggcatcctgaagtgcatatcagatcttgccctgtccctgcctcccattgcctctggaccacagcctctgagatcctgcctgccttcctcatcttgtcttccattcctggggaacagtggccacatagccaggtggctggcagcacggacttgggagaccctaccagcctgggtttgaaccctgtctctaccgcctgcttgctttgtgacctggttcctcattttcctcatctgtaagatggtggtgttgaaaggacccgtctggtagggttgttctgaaggttgagatattcaaatgctgagaacaccacccagcacaaggctggtgaatgctccaggagggttcactgcgccgttgccattttcctgttgatcctggagttccggccactctggcctctgctcacatagctggaactcgtcagaccatctcccacctcaaggtctttgcctctaccgtgctgtctcaggacactcgtcccctgccttaccattcggtcagcccattatccttcgggcctcaggttgaatgtcacttgctgagagcagccctctctgaccatccttttagagtggcttccccgcctcacattccccgttacagtctggcctgattgtatctgccagtgggttctgcttcccccaaccacaacttgcccatcatgagggggcagccttgcctgttgtcccctgcactgcatcaacactgcctggaccagaggccctcggtaactgccagttggctgaatgaatgcaggaatgaggcatgaacaatgcaaagatgctgaaccatgacatgagggactgtttcattcatgtggcatgggggtgggctacccccccca

SEQ ID NO: 193 - DNA, 17266 bp, Homo sapiens
acgtgctatcagatggactcctatatggtgtgctgggaaagacgccctgtggctctcaaccagctcagcctatggccctgagagaggatgtgggcaggccctgaccatcttggttttcttccctttttttcttttttatttatttctctttttctttctttctttctctttctttctttctttctttctttctttctttctttctttctttctttctttctttcttcagctttattgaactataattcacatattatacaattcacccttatacagttcacagttctgtggtttttgctacactcacgggtttgtgcaactgcaccacagtctaattttaaaacactttcatcatcccaagaggaaaccccatgtccattaagtgctccctccccacttcccctttccctacccctggcaaccgtgaatctactttctgtctctctggacacttcatacaaataggatcgtacagtgtggggtgtgctgtggcagggttgtttcacctaacaccgtgttttcaagttcacctgcattgcggcattgccagtttagggctgatagtattccatgatacatagaccatactctctttatccattcatccgttgatgggcatttgggtttctttcccactttgtgtctattatgagtagagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggtaaggagtgagaatggtcatatggtgactcggtctctggggtgtggtcaggagtagaatgttcatggtgactcggtcctcaaggtctgctcaggagtagaatggttacatggcgactaggtctttgtggtctgctcaggagtagaatcactgtatggtgactcgatgttgaattatttgaggagttgccagactccttccatgttggctgcctggtctgcatcctccccactgtgtgtgaaggctctgatttctcacctccttgcccacaccttttattgagcctgaacacctttcacatggtcacacctgacctgagcagctgcccggccatagtgccaacacatccctggccacgagaggtggcgcctgggctggccaacgtgcaccctcagggtcgggatgtgatctagagcagggcttctctcattctgttcctgcccatgttcatttcaacccccaaaaggacttgagctctcaggcttaatttcatttacttaatgcatgaaggaggaaatgatttctgaggccaagaccggagtggtccccagggactccatttcaacagtgtatttaaaccaccacgtggaggttgcttgctaggctgggaactgtgatcaaagaacttccaatattttatgttcataaaggcagtttgagagtaatgttttttaaaaaggcatctgaatggggaggaataggatcattgtgaggtccacagtctctttgcctttgaagtttgcaagaagctactgaatgagttccatgctttgtaatactctggtctgggcaccctcaggcgtgcgtggccggcagggacctgtaggaatcctcttcacctggggagatttgaagcctagtgcatataaccagggccgtcacccaatgctgtgtgatcctgggccagtcagttagccttttgcagttagctgatcgttttcacctcagcttgaggcatctctttcaggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggtaggtatgtgctcaggtgtgctgtgtgctcagtgaggctgtgaacccacgtgggtgtgagcccaggtaagctgtgtgctcaggaagctgtgagcctaggtgtgctctgtgcttagtgaggctgtgagcccaggtgggtttgagctcaggtatgttgagaggagggtggatgtgagcccaggtgtgctgtgtgctcagtgaggctgtgaacccaggtgtgctgtgtgctcagtaaggctgtgagcccaggtggatgtgagttcagtgaggctatgcactcaggtggctgcaagcccaggtgtgctgcgtgctcagtaaggctgtgaacccaggtgtgctgtgtgctcagtgaggttgtgagcccaggtgtcctgtgtgctcagtgaggttgtgagcccaggtgtcctgtgtgctcaggcagctgtgagtccaggtggatgtgagttcagtgaggctatgagctcaggtgggtgtgagcccaggtgtgccgtgagctcagtgagtccaggtgggctgtgtgcccaccgaggctgtgagcccagatcggtatgagcttaggtgggtgtgagctcaggtgggctgtgtgccttattgaggctgtgaacccaggtgggctgtgagctcagtgaggacagacaccacacctggttttgctcatgggtatcaccccagtacctggcccagagcagatgattgtcttgatttgggttttggggaggtgaccctggaatgaggatttgagagcaagtaatttataagaaagctgtcccaggagaagctggcaccagtgctgggaaagtggcacagggaggccaaggaggggtagtatcaggcacagctgtgcaggggcagttgcagcctgaccctgagggtactctgagcatgagtgtgtcagagtttgtctctgctgaggccaggggctaggctacattcttgccaccaccagtcattggctctcggctctgtgcaggaggacagagaggctgagaggctgggagttggcctgtaggggtgcccttaggggcaaaagcacatgggagctgggaggctccacagccttggactggaggggtgggcagagcactgacagtatccgcttggggtcaggccatgtggatccagtgttctactccgatcctctccgacaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttcggatcaagaatactgcacctgtaacacctgcctccttagtggtgtgatgattgcgtggaatgagacatgaaaagggctcagcccaaaatcgtctggcaccaaatacccaatggataggggattttgtttattttgttgttactgttgttgaggtaaaattcatatagcacaaaattaactattttaaagtgtacaattcagtggcatttagtacattcatgatattggcatctgccacatgtgtctagttcccgaacattgtcacatcacatccaaaggagatcccatgcccattctcccctcccacatcccgcggcagccaccactctgccttgttgagtggtcttctgtgactggctcctttcgtttagcaccatgatcttgggggtcatctgtgctgcagtgggtgtcagtgctttcttcctggtaagagcgtaacatggtgcagtcattgtggaaaacaattgggtggttcttggaaatgtgaaatataggattactgtatgagctagcagctccacttccgggtatctaactaaaacaactgaaaacaggtattagggggaaaaaaacctgcacacgaatgtccaatagcagcactgttgttcacaatagccagtatgtggagacaacctaaatgcccatcgacagatcgatggattaacaatttccatacaatggactattaccttttgttattattattattattatagctttcttaactcctattgattttttcaaaagtgacctcagctgtcatctcttttccacaaagagtcttacctgagtctggagaccattcctttttctgaccacagaaccccgtcttaatctctgtcctgcctcttccactcattaattcattccctgattccttccaaagtatttgttgggtgcctgctatagacaaggtcactccagtggggagggaccgacaacaccaagtcagctgaaataacagcaccgtggagggagtgtgtgccatgcggagaattttgggttgggtgggagggtgcttggatgtctcactgttgctctgatggaccaggaggagatgtttgcaatgaaacccaagtgataagaaggaggcagctttgcaaaggtggaggagagcctcccttgaggggctgcttactaggatccggaggtggggatgagcctggggaggctgcagagaactgtgaggttggagctgctcacagggagaggtcacagggctttgagggccaaagggaggcctaactcctgtggaagccactggagggtttgaggcagggtaaggcggggtcaggggtgtatgccatgtgacccgaagggagggcattgcgggaacctgggagcgatgagggagacctgggccgggggagtcagggcagggcggatgtagcaaagtcacattgtcctgagtgaccattcacttggctgtccccgctcccaggcctcaggactgtgagggcaggcactgggtctcaggcccagagaagatgctcagaaaaggaaaaggagaccggggcacgagtgagccagtgcagtgtgcagagtgagggggcagtgggcaaagaaattgcatggcccagatcactcactggagaccagagacaccttagtgtcccaggatgatgaagagcgaggggccagagctaggggagttagtgatgcatctgctagccgggctggccctccctgtgggcacagagaaagtggttcctcaacagccatgggtgacctttaaggatgcccacagatggtgccatctcaggagaagggtcccagagggactggctctgtcacctgctgtcagctgctcccggaaagcccgcactgcatgacttgctggtttgttggaatggttccatcttgctgtgtcacttccatgacaatcaccagaggaaccaggcccaggcaaggggcctgtgatgaagcgagcagccctgatgacatcagaaatgcagacagttccagacattcaagcatgatgtccttggctcttgggtgaaaatcctcctcggtgtgtcagggaaagtcattgaattcacgttggacccggacttggtaaatcttcagaagcacgctctattctgcaggatttaagcttcagatgggcctagactggtatgcacaggtagggactgtgcacttgagcacagatggaccttcagcccatctccttttggttctcatatacttgttgagccctggctaggccctcctgagctctgtttcagggcctgcagaggctgctgtacaggtcacacttggtctctgctctcacggtcaagtagccaggatggacataaaactaatgaacacatacatcaagagctaattaaaaattgtgctgaaggccatggtggaaaaataacaggaaacctaacaggtgggtaggaagggtgagaccatgagggatgaataggagttcatcagagaaaagtgttgcctccagagggaatggcacagaaggcagccctattgtgggaaagcacttaatgagcgaggagggccatggtggtagagaagcttaagaaatggaggccagggctctggggttacagtgggggttttatatttcatcctaagagccactgtgatgtcatgtggggagcaatataaggccctgtttgcttgcttgcttgcggggtaggcaggagtggaagcgggaaaccagggcagaggctgcagaactgtacaggtgaaagtgatgctggactgcccccaggggttagaagtgaaatgaagataagagatcaggatccaaaaccatttattctctccctttttcttcttggggcacccagtagtattttttcccagaagacatttcttaaaggatcacttaagccaggaactgtcaaatgcacaaaccaaatgcactttctactagtttttgcaaataaagttttattgcaacatagccatgcccattaatttatgtcccatctgtggctgcttcacactacagcagcagagctgagtggcggcagcagagactgtgtggcccgcaaagcctcagagttttattatttggccccttacagaagacatttgccaattcctgacctaagcaaagtgagtgagggacgcattttcaaaacacaaatctgttggcttaaagtcttcctagcacttaaatgcatttaatccctctgaaaaatgctagagtagacacagtttttaaattgacttttgtttttctttaaccttttgctgatattatatataagaaactcaccttatgctttaggtttagaaagtcagggttggaactcagactttgaagatgttgtgtgatattatttctctaaatttctactacaatactaaagtctcctgatgtgttatttcactttttgtcctttctctgaaatgctcattttcctccttttctgtaaaatataatctcagggaagaagtttgtaaaagcagcttttagcctttgcaaagatataggtgggcctcttgtacaataatttttataagagtttgttctttgcaaatgcagatgcatcctactaagccacatacaaaaaaatcatcacaatgatgacaacaacaaagccaattttccagattccacctttctccttcctcatcctcttcatgtttgaatttgtgctgccaaattctatagagcattttcagatccacttgatttacagatttgagctgaatttcacttggaaaactgaccatatgtctggcaggcaccagcgaccattggcagtactatagggttgatactaaacagatgggctttctagttagatgtgctgttttttccacaatacatatgagaaagaaaagaagccactttaataatgtcttgatttttccactggtgtcagagtcatcaatgatgcccatttatgtagtcttaatttcagcatcattgcgtgcagggtgccttagacagctagaagaagcttaatgacttgggaaattttgaggcccaacttctgcctagatcttagagaatcttgttatctttggaatacagatagtggataaaagacttttatagtccaaaaataaattattaacactatttgtcaggaatacattcaaagttcttagtcctgggtttattgctcaaactatttgacagcttttgtggggttattgcagtctaggcagcaaggtgtaaatagcggttgtctgataggtctgtttaggaaaatctagctaaacaactgaatacgatttcttcctgcagaacttctcagagcctatactatgctaatatgcactggggctctcatgaagagggttttagtacagacagcattttctaactactttaatcctctcagcatctccctatgctagagttccatggaaaacactttgggaaacaccggtgtcatgcctagatggtaaactgaagagcagagaggctgcggcagacctgccatttaccagctgtgtgaccttgaacgagtgctttcgtgctctgagcctctactttttaaatgtaaaatggagctgaaaatataggccctgcctgttagggttgtttgcctggaatgaacatgcagaaggttttggtggcctccctttgggcattaaaatataagttctcctaaaattaagtatttattcaattcacaattttccaggggccaattattcactctgaagcttagccaggcttttgtcttttcttctctgtgcttcttagcacctccactaaccagtaaaggagagaaaggagatgccctttgagttaagggctgctgagggggcagccagaagaagccatggccaacatgaggtctagaggtggctcgggaattgcagttaccttccactgtcgggagtcagtgggacagctccaggccattgttaaaaaccattgccctgcatttgattctgcttccatttttgtatcatgggatcaatccactcattcatttattcactcgctcactcatttattcaacccacctgccaggcactgtgctaggtgccggaggaggaagcggaccctaagtctaggaattgcattgtgcagttgttgaggtctctgtttcccctatactggaaaagtcagcagttagtccatcaaacaagggctataatcagattacagattttgatgaatgaacttgcagggctgtagaaaaaagcctataagcttttaggaatagagccataggcatttagcagtattttcttcccttttttgaataaattcactcctttttttttttttttttgcatccctccctgccctccacccaacaccagcaagcagtttattcctccattataagcagtgtgactataagacacttgtcaaatggtctcactttgtccttggatggtatgacccttgttttgtttttattgatcagcacacccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttccgtgtgaggttattgtatgttgctttaaaggttaacttcttcctcctcccagccctatttctccttcctcctcccagatcttagacagcagtgttatcatctgctctgtgtcatctagcacaggactgggagaggggcggagttgtcaaagaggctgtggggttaagatcagggcttttacagcagatgacctgagttctaagctccactctgtcgctaactagcatgtgccctggggtaattatttcacatctgtgtgcctccattgtcctcatctgtaatgtaggtgatgaaaatagttcttcgcttgctagggtcttgatggaatacaatgagcaaattcatgccaggtgctcagcactgagcctgttgcacagcaaatgctcagtagatgcttccgttgctgatgacagtgatgacaaaaacaaaccttcgtattccttggctcttccatatgtgtgagtgcccccatcctctgccttcctgccttcagccttgttccccctacagtctgccatcctcaccgagattccacgtggtcttctcacaaggctgaacttgctccaggtccctcaatgactccacattgtccccaggactcttatcacagccacacagctcttcttggtcaggtccccacacgccttcctaagctcacctatgtcaactctgttccatagaccataagctccagcctaagggtcctcaagttccagtgcacagacccacaccagcaaattaagaacactaagagcaatgcagttgggttttcatttacgaatgtagaatcaattaatttttttaagagacagggtcttgctctgttgcccaggctggagcacagtggtgcaattcactgtaacctggaattcctgagctcaagcaatcctcctgcctcagcctcctgagttgctgggactacaggtgtgcataaccacaccgagctaatttttttttccttcgtttttgtagagacagggtctcactacgttgcccaggctgggcttgaactcatgccctcaagcagccctcctgcattggcttcccaagccactgagcccaggcctaaaaattctgtttgtttgtttttttctgagactatattttttctattatgtgtactaagttgtgatgaacatagatgattgctttgtgtagtgtgtgtgtgtgttggccattactgccataatgaacattagcatatctgtgtggatcccaattttatatgtggaaattttactgggtttctgagccttagagactggggacctcagacctagcttccccaaatgactccccattccccaaacaccatgtactgccatgcatttatgaatttgcacgttttactaaaatcctactcaacctctaatacccaactcaattatcactacctactacctcccctagcttctagtagccttcttagagttatcccaccctcaagcaggaaaagttgcttcctctgctattataatcctctttcttgattcttcctggtggttccaggtaccttagttttctcagtggtcactgagtcccccgggagagagggtacctagcaccactttgtccctcaggcctaacactgtgctttgttcaaagacaatggtctccacgtattggtgttacaggtaaggactcaaagaagaaatagaggtcatatctcagcttcttatttgcttctattgtggctcatgtcacattatgaggttgccttacactttctgtgttccttcttttctcctccataaatacatgagcttcatgcagcgggaaactgcaggcatgttgatggaatttactgctctgtcaaaactcagagcagtcctgacacacagcaggccctcagccgatatgatgaatgggtttgtgagtgaatgaataaaacaaacaaggaaaaaattattttgcaatattatctgatagagatggcacctttcttctctaagaaatcagccatgtagcacatggcactgagtacctgacctcactcccccagagatatggggctttccttccaatatgtttttggggaatttcgtgaagtggaaggataagataagatatcttagtggatgaaagatgaggatgaaaaaatacctgatgtcactaaagggtggacatcaaagtcagatggacgaggaacagaccctggctccagcgtttggcagccctgcactccggattcacagggtcgagcaggtgtttatttgggcagcccctgggtgccaggaaccagcaaagatgcgagacccagcaacaagcacgagagtgacggttctcattgtcatggagcttatgtttgttctcatgggaaatgcagatgacagtcaataaatagtgaatcccagggcacaatctgagagtaatcagagctaggatggaaggaaatgtgaataaagggattggccctgcaccaggcatggaaattagcctgtaagctccatgaggtcagtgttccgtcagtcctagaacagttcttgcctcatagctctgtgtggctgttgatgggggaaagggatggagttagttacccagggacaagtataccagctactgtgagcctgagagaggcctgggagagggctggctggagttgccaaagaggctggagcttgtcccttgagttgcaagcatgtgacatcagcaggggagggccagctgccccatccatcatctgaggactgaggctgtgtgtagcacttcctcacacagatgccaggtgtgacagacatttcccattaattaacctctaatgcctcagaggtggcagaggtgcagtggaacctggcactactgttattcagaggctggggggtggctgctaatgtgtttgcaccttccagagtctctccagtgtgagaaggcagttcctcaggaactgcagggagagacggggagagaattcctggagtggggggaggtgctcccatctgtcccttccctctgtggacaggtgtgcatgggccacatgcacccgcccacagatggcatcccacccatgcaggtgcacacccacccacgcccatgcacactggctccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgcagtgatgggctcatgtcctctgcccttggaggggtttgtaagtagttttctctgagcagcactattttgaagtttctcttcttgggcggagagtcatagctctcacaagccctcccctggcacagtcctgggcttgagccaccccagggaaggcagaggggagagggaatttcctcccaagggggatgcagagcagcacagcctggggcccctgggcatggggtcttcactcctctgatgacagttgagccccttgaggagctgcttagactaaggcatctgtcctggtcaatgcattggatttttggtttaggagcaaagggtcttttgagctgaagaccctctagtggctccctgctgaattctgaatcaggttcaagtccctgactacgaccctgcctgcctccccagcacatccacgcctctcaaccactgtttcctcctgtcttggacagcctgcccctttcccatcatagcccctgtcctgttccccactggggcggccctctggagcacccagtgctgaccctgtcacagtcggtcagtcgacacctgccctcgaggctccctgaggaggccctgggtcctgtccttcctcgcgtctgtggggatcctggttcagggctctctatgtccccctggcacgtgcctgagctgttgctggcactggagatacagctgcaaacatccatcaagggcctgcagtcaggagcttcagctcggggcatgggcaggaggagtggagacaactacaaacaggtaaacaaatgagtgtgtgcgtgcatgtgcgtgtgtgtgtgtctgtgtgcgtgcatgtgtgcgtgtatgtgtgtgcgtgcatgtgcatgtgtgtgtctctgtgtgcatgtgtgtgtgcgtgtgtgtgcatgcacaccagctgatacctgtgatgagaaaaataaagaggaaggcaagaaatagtgaggagtgccatcccacatggggtgagccaggactgtctaaattcatacctttattcattgttcatctcctgcaggtgagtacagccccacaaaggcaggcatcgtctcttttgttcacctctgcacaccctgtgcctattaggatacatggcacatggttggtgtcagtacgtatttgttgaaaggtggagtgagtgagtgagtgagtgagtgaattcttaaagggagagaggagtgcagtctcctcagtggccaaagtgctccctcgccagccctcagctctgctgtgaggaccactgtgtgtcagagacggggtgggaaccccagaacctgctccagccactagggcagaagtggggggaggcagctgattaaaatagtgcaggtagtgacggtggtcctggcagtgatggtggtagggagggggaggcgccactgcccctcctgcccaccttccaccagtggaagcagtcacatagccacagcaagaaggagacaccataccccccagcaaggccctggcaaaggggatgcagggagtcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatctgtagtttattctgtgtgctactccgttttgccttggctgctaggaagctcagggcacacaaataccctcctctggagcccgtgtggtgtctgtcgtggggacccacctaactccttgatgctgtggccctcagcagaccctgattcctccagatccttcctgacactcccttcatccttcagctgtgtatgtgtgtttctggtgattgctgccgatcctttgtgaaggaggtgagatataaataaagcaatgattatgctccatcctcgtctcctctgctcatccctggagatcttcgtcttcatcttcagctgagcttggaggcttggggagacctagcccatccttcccctcgtgcaaagcatgctcaggacagcaggctttcccagggccatgtggagtcacagtcttgctcccatctggtgtctgtaggtggaggaaggaaaggagaggatgagaacatggaatgcattgtctctgagaagagaaggatccctgtacatccctctgcctcccgtggccttggggagagggtggccgggaggatctgtggttaattggtgttctgcagctgccctggttccacacatttcctgggctcccactgggtaccaggcactaggtgctggggtcgcctcaaaaacacagtggaggatgccattgctgtagctcccttaatggtttgcagagcccagaatgtcaaacaagacattcctgggcttgtctttccccatggggctgctttgtggagcatctgtggacacagcacctagcacagttaacacttgtattagtccgttttcatactgctacaaagtgcccccgataaaacaaaaaagaactgcccaagactgcatgatttataaaagaaagaagtttaattggctcaaagtttagcatggttggggaagcctcagaaaacttacaatcatggcagaaggtgaaggggaagcaaggcaccttcttcacaaggcagcaggaaggagaagtgcagggcgaagggggaggagcctcccttataaaaccaacagatctcaagagaactcactcaatatcatgcggacagcatgggggaaaccacctccctgatccaatcacctccacctggtctttctcttgacacatggagattatggggattataattcaagatgagatttgggtggggacacaaagcctaaccatatcagcactctattagtaatgcctggagagaatgacctcatgccccaacccacctagggtgggcctggtttatcctcttgtcttggtgtcccatccttctgtgttctgctttgggtcccctcgatgcagctttggaaggtgagaggggcctctggagtcagggtgctcaaggtcctgccctgccacagcatttcccagctctgagaccaacaaaaaaatggctcagggctctgatcttcagtttgttcatctgtaaaatggatataaaatggaatgatctctagctcatagatttattgtgaaggtaaaataggacaatgccttaggatagtcctggccctgcacaggcagtgaccagcgtttactccatcatcattattctattgctcatatcatagaaattattataatataaattttgac

SEQ ID NO: 194 - DNA, 149917 bp, Homo sapiens
cacataggccccgtttctttaccaagataggttcctgcagaggtcgtgaagctgctgtggtcatttgctggcagcgacgtgaagatagaattctttcctgactcaaccaggggcactctcgtctcctccccgtgagacccgcaatgcaggaagcacccacagctgcatggacagaactggggcctgggaaagaggccaggaaggtgccagatgagagggcgctccatcagggtggcagcaatgccatgggctggcaaatggagaaaggggaacaaagcacccaagtgcatctagccccagccacacgccttctgctgggagtgtgctcagagggaagtgaccgctaggattcggaatctccagtcacggcccctggagaccggcatgtgggctgtgtgtggggtggagggctgggggtgttggcaagtctcacaggtgaggacccaacgagggaatcagacaaaaagtggccacaaattaggcagctccaggaaggacatgtccttgccatagtaagatgttctgctcacgcgtatccacgagaaagccccgcatttcacggggagcatagaaacaggagtccccaactctgctcaccagctcctccggctgctgccatctgctcctgcagcatggcggcctgggaagcctgcactggtgattttctgccactcaagttttgcagacttcgggaagatggatgcatagcctggggcaatgacagtcacaggcccgccttgtcacaaggtccctggagcgggcaatgccttgagcccaaaggctgggagcacaaagccatcttcagccatcctcgatttccagcaagaccccagggctcacccaacagcccgacactccatactacaaggtgggttaatttttttaaagactctgcagaaatataccaactacagagctcaggaaagcaactgatttataaaacccaatccaagttgtttgcttttatagcattagagacatgtctgaagaacttcaagtttttatctatagaaacataattagtttaataaattactaggtctattttgaataacaaattgagtacttttattagacctaagtggaactttatctgaatctgaattttccaaggggccagtgtagagtgacacaggtgtccgaggccacctttccatcttcagacacccccccgtctctctgcacagggagttggccttccagtaggtgttgctcttctgtcttgacgtctcctggaaagatttttatctctattttcctgtggtggtgttttccacgagctaattctttctatctttaaactcattggctgaaaacaaatgtgggaatatttttgcattagtaacaattatattatttttaaatgttaagcaacacatcataccagctatcacagaatgtagatgattctactcccccttcctacagaaggacacatgaggtatccacacttagtgtctctcattccccattttacagcccacgctcttgtgaaatttgggattccaatacatggctgatattgtaaagtcaacagtgaaataaagtgcttgaaactcaattcaaaaatgcataataaaaataattttctacattttgcactatttaacaattgatggtttcaaggcgtggataagccacccattcagttatctatttactcgtacattgccccgcatgcctgtgattaactcaggtcaatgatggagcatgagagaagtccgcgtctcacaggaggctgggcctgtgcagtccaccctgggacttacgatgttttgtactcataggatctgaaaaggctcttttcctacttgtgacaaatgcttggagtagatttctgatcttccttcagggaataaagtgttatctgctcagcagttgctttgggaaagaatgcgaggggataaatcatcttcaggagttgggggcgccttctccatccacatcaacccagtatcagttgctggctgtggactcacgagatttgcttcctgagtatgagggtgacacaaagctgggacaggaagagacacactggctgggagaatgttctaaagaggagctaattttaacaaagaaaaatgtgatagagactgccgagaccagctcggtcaggaagaccctaacccagcagtgctagaggaattaaagacatacgcacggaagtatagcatgtggagtgggaaatcagggcactcacagccttcagagctgagagccgtgaacagagatttacccacatatttattgacagcaagccagtgataaattgtttctatagattatagattaactaaaagtattccttatgggaaacaaagggatgggccaaaacaaagggatgggctctggctagatatccacagcagaaacatgtccttaaggcacagatcgctcatgctactgtttgtggtttaagaacgcctttaagcggttttccaccctgggtgggccaggtgttccttgccatcattctggtaaacccacaaccttcagcgtgggcatcatggccatcacgaacatgtcacagtgctgcagagattttgtttgtggccagttttggggccagtttatggccagatctgggggcctattcccaacaagagacaaaatagcatcctgtactgtggctcccaagctaacagcgccacccctgttcagaggagtccacgccgacaagcagcaggtgcaagaccgcagtgcagaagcagggagcacgggaggctgcgagccctcagactcacgggtggagacagtgccacacacatcacctccgcagcctgcacccacggaaacaaagcccccaagtcccctcggccccagccagacgcttgctgctgtgagtgtactcagagggaagcagccgggaggacttggaatctgctccacagcaagaagtgctaagggttaggatcttgtttgaaaggcatgtacccgtgtccttggaagaacacaggactccagggagcaccatgctcacccagggaggtgaaattgtgtggtgaggagctgatgggatgtgtgtgtttgggtacagaacctctgcttctctttacagatgataagcacaaagggtcacctttggaggagctgaattgttagatgacgatctttgtcccaggagagtggcactctgattcttgtggccagcgtatttgggtattgtctcttcatcagctgacagaggtgaaatttttccaaaagcaggttccaatgcctaaaagacaaaatgcagggaaattcttcacattttcgaaggtaaaataaattcaaattttaatacaatgaagaataattggaatgtcctagaaaaaaatagggtacaaggtagggggacttggactgggttttccccctaatatgttgataagaacagaaaccctcaccaagcgtttgtgaaggaacctttgtggagccgatgtttgctttgtgtttcttattgtggttccttgtttcaaaatgatcacaggatcccaaaggctacagaacaaacaatccccaacatatcttcctttaggctcctgtgtcttcaaccgggagtgtgttaacggaggaagaaaatgtgatactacttctagtgttgtctctacaacttgtctaagatccaaaatgcaaattcccaactttccctgttatcagcagactgacctggaacagggtgatccttcaggtgggatgaggtatattaggtctggaatgctaaattattcaccgttctgccctctgaggaggagaagggaatgagaaggggagagggttgctatgaacgaacccttaatatcagatccagagtggctcacccacacagccatgcccgcgttctgtgggtgctcgagtctcagccttttagatattcagtccctaaaacggcgactacacacagatacaccttcgcatatttaaagtgtgggattcacatatcccatcctgtttcttcaaatcaggtatgctcttgtgagcgtacatcctgttcttataaatagccccacggtgaccagtgcaatgcacagaatggaaaaatatttggaaattcaccaagctctaatctcaaaataagagaatgatcaaaactgcagggcatgtgaagactgaataagacttcattgactcttagggtaattgttatacaatgacccaaatggggcagtagatactattttttaggaactggcatacaatatatgtagggaaaaaaatccctgtgagtcttcttgggttctccccacagaaggtggacaatcccggccagtatttgtggcaatttcccccactcttcctctgacagaggaacagcctgcccagcttctgctcttccttccgcagaaggactcggcgctttgctgtgctgagaggctaaactcactttctttctgaggcagcagaagccatctccatggaaacaaagctctcgcagagctcccgaagagtgggaataacttccaagatttcccgtaatttcttgtagaggaacttgtggcagttttttttgtttgtttgttttgtttttttcagacggagtcttgctctgtcccccaggctggagtgcagtggcgcgatctcggctcactgcaagctccacctccctgattcaggccattctccagcctcagcctcccgagtagctgggactataggcacccgccaccacacctggctaatgtttttgtatttttagtagagacggggtttcaccgtgttagccaggatggtctcaatctcctgacctcacgatccacctgcctcggcctcccaaagtgctgggattacaggtgtgagccaccgcgcccagctgtggctgtttttgctgtgcttggagaacaaaccacagagcagtctcctctggaatgtattcggtgggtgcctgtgtgtgtgtgtgtgtgtgtgtgtgtgtgtgtgtgtgtgttgtaatcactgtgctgtatcggaaatattctaagtcctggaagtaccgatttaaaagttcacacaataaatgcagctaggaaatgttagtacttttcttaatccactaagaaatatccccacttacgtttggagggtgttcatgtggtttcatgtgttgttacctgtatgtataattttaatgattcaagttatttagatccatatgcaggaaacagaacccagacaaggcagtgataacactggccacattcacactctcttaggctggttctttgagcggtgtgatcaaacgtgaaagctcagtgttctgtagaggcaggctggtgctgggaggcacccactacttcagcatgagaatgctggttcttcgttcgggatagagcaggttagtgatacaggatgggggcaggaaagtcctgggtggagaagaacggggtccctggctagggctcgacccctgggcctgtgcccatggacctacgcatttctgcttttgtgcccaaatgttgcatttcccaagaccaccgtggcctgccacactcccatcctatgcctataaaaaccccaagaccctagcgggcagagaccaagcggctggatgtcgagaagaacacaccggcagaagagcacaccagcagacacagcagacgccagcaggccatcgactggcggaatgacacggagtttgcttggggtggtcaggggagagcccggtcactgggcagcccaactcccaaggggaaaactgccttcccactccatctcccttctggctcccccatctgctgacaggtatcaccactcaataaaaaaccttgcacccatcctccaagcccatgtgtgatctgatttttcaggtacaccaaggcaagaacccaggatacagaaagccctctgtccttgtgataaggcagagggtctaattgagctgataaacacaagctgcctacggaggggtaaactgaaagagctcccgcactgtaacacacaccctctggggcttcagctggaaacattcacccccagacactgccgtggggtcagagccccatagcctgccggtctgtacactcccctagaggtttgagcagtggggaaccaaagaagcgagccacacccccatcgcacaccctgcgagggggacaagggaacttttcccgtttcaacaggtctctattgcattctacacagctgtcctagaggatgaacagaaggacaccaggctactgagctggctctggagtcaccctgggttcaaatcccagctctacgttctccagcccgtggccacgatggggttagtaataggatccatttcatagggtcgtcatagagagtaagaccgtaaagctccgtacctagcccatgtaaagtccacagtaagggtttgctgctgttgtcctgagacatcatgagatgtcttagaattctggacttgagacacacggcctgggggcggcaatgcttctgtctgctggagtgccaggtgagaggcctgatgtatccagttcttattaatcattacttacgggaaatggagttgatggaaagatagcaacccctcccaccacccggagcgtgagtgataccgcgtcattcagcaataaagcccacatctttatggggacgctatttttacataacgcaaacggtacaaaaacataaatgcgcttttggtaccagagtgtgcgattcttgccccgcgtgtggggacgctgcagatttcttcctggctttccaccgctgcagctgcagagctctcagcttttctcggagctccatgttctgctccctcaaagcatctatatgactccggagttttccatgaacatcagcccacagagacttctgtctcccaagctcttggtggagtctgatgatctgctgctgtaatggctgttattgggaagagaacaccagaaaaacctctcagatgtcacaatgggcacatttatctgcaaaatactcaagccctctctgatgtaagaccaacactatttctggaataaaagacacccgatgagataaacaggactaccacagcctttttctttcttctttctttcctttctttctttcttttcttttcttttttcagggtctcactcagtcactcaggctggagtgcagtggcatgatctcagctcactgaagcttcaacttgatgagctcaagcgatcctcctgtctcgacctcccaaatagctgggactacaggcatgtgccaccatacttcgctaatttttgtatttttactcgggatgggggttcaccatgttgcccagactggtctcaaactcctgggctcaagcaatccacctgcctcggcctcccaaagtgctgggattacaggaataagctaccatgcctggccatagctttattcttattaagtagtgtttattatgagttagtccacataatataaccagataaagatggttagtgaattatgatttttttgttaaaacactactacagcaaaaagaggctggcattcttttccttttttttttttttttttttttttttttgagacagtgtctttctctgtcacccaggctggagtgcagtggcgcagtctcagctcactgcaacctccacttcccagattcaagcaactctggtgcctcagcatccagagtagttgggattacaggcacatgccaccacacctggctaatttttctattgttagtagagacagggttttaccatgttggccagactggtctcaaaggctgtactggcatggatatatggtcaatagtttaaaaattatggaagccggccgggcgcggtggctcacgcctgtaatcccagcactttgggaggccgaggcgggcggatcacgaggtcaggagatcgagaccatcccggctaacacggtgaaaccccgtctctactaaaaatacaaaaaattagccgggcgtagtggcgggcgcctgtagtcccagctacgtgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaattatggaagccactgcattttcaacctaacatgttagccttcccctgggatccttcactggatcgtagagcctccagccttgctctgagaataagtgggatcgtgataaaggtacagtcctgcactgggtggccctggccacagggacccgtgggactttaatgacagcaagcactgtccaacagggtccaatgaggaagatggtaaaaatcaggaaacttgctgggatgatgtgaggcatgtcaactttctgattttctttaatgaagtttttaaagtctggtgccttctcctggattagaggagaaaagctggaatgttaatattttctttaactccctgccctgcctcccatccaccaagagatacggttgcagagggggaaagagccacatgccccttggagaggaagtacagaatcagtgtcccggggtggtgcattcctacaggggtccagcaagggaaagtccaatgacgggcctcagggacaggaatcagggtcccgcctggtgggactaactctgtccccacagagctcaactcactggcatctccccagtgttgcagtcctccgtgagaacctcggctgccacagctgtcttctccatgacagccccagctcctgggcacgggtcctctgggtgggtgccctctttggggtccctggcctcgagttgacctgccagcatcctggttgggaagggaagggctatggggacacttgaatgcagccctcctaccccgtcagtgtgggctgaaggccccagccccaaactaagggtgagcaggacccgcagccgctccttctccccctgggtcatgtgcacattcccaggcccgaagctgaccaggtgaaaggacaccacagacagagggactgagctgtccacacctggctctccaccatcctccgtggaaaatgctttagatcctagaagatcagcctgacacctaacacactccagtcatccaaagaggggtgtgagtggggtgtgagccggtgtgagtgggatgtgagtgggttgtgagcaggatatgagcggaatgtgaatggatgtgagcggatgtgagcacgatggtcttggggtatgagcaggtgtgagtggaatggtctcagggtgtgagcaggtgtgagtggagggtcgcatgagacaccgagggaattctcagccctttaatcagcacccacctggaggggcacaggcagaccctccaccgtgttgagtatgtgtcttgaaccatcagggtgacatttgtgaattcatggtgaagatgtggaaaggaaacacctttttataggtacagcatttatgccagttctaggaagttcacagcaattagagaacaaaaacgaaagagaaaaacgcaaagctttcctgcaagcctgcagggtcgtctctgaaagctgcctccacccctgccttgccctgtccgttttaggaagccagtggcccccaacgaaaccccgactgtttaattcataaacttctaactgtgtgagaaggaacagtttaaccacagtgatcggagaaatgctatttaaaagagagtctcctgatggaagcgaatcgaaggtctagagcaagacctaccagtaaccagatcactgccattccttccccgcggagactgggaatgtttctgcggaagtgggctggggtcacggtcctcacagccctgagaaagctccttctttcctgctcctctgaggggacaccccagtgtcctcggccccaaactcatgaccccctcagtccagggaagaccctttccttcagccccaccaccagacctcgtcacctcacctggtccccaacagtcactactgccaggatcagatcatctgggccatgtccccacagttgtccccaagccctcctgcctcatatccagagaccagagagcagcggacagttccaacggactttctgtcttaaagggacatgaacgtctcactcagcgtcaccactgtaccagctcagataataattaaacatccccaaacctgcaattcttaatatagaagctcatcgtcagtggagtccatccatccacaaaggacattggagagagtcaaactactcctccaaattgacaaaaaccatgtgttttatatccagtcttcaatacgcaacgtgtagtaagagctcatttctctgagcatacattcttggagaaatacaaactttcttcggatatcaaattatttactagaaaaaacatttttatgaagggaaaataatatatgtgagtttaaataggagacaggattcaaagtttcatcatttcactaaatgcatctccatctgaattgtccgtgtgatttttgtgatagagaagagaatgaggagcaagcaagagtcgatattcctgttaaaccctggctgtccttctcatccatggtgctgcgtgtggacaacatacacctggggctcacctgagcctgcttgggacgtgtgtcacttggatagttctgcaagcgattcgcatgcaataggcagtaaatgccgacgtcatgaatgaatgaagagaatactacaaagaggaaacagaaggcacttttgtccccatgtgtcattctaactgtgagagtgtgtgtgtgtgtcctgaggtgtgcgagtgtgtgtgtgtgtgtcctgaggtgcgtgagaggttgtatgtttgtcctgaagtgtgtgagagtttatataggtttctgaggtatgtgaggggttgtgtgtgtccctgaggtgtatgaggtgtgtgtgggtcctgaggtgtgtgagtggttgtgtgtgggtccctgaggtgtgtgagaggttgtgtgtgggtcctaaggtgtgtgagtggttgtgtgtgggtcctaaggtgtgtgagaggttgtgtgtgggtcctaaggtgtgtgagtggttgtgtgtgggtcctaaggtgtgtgagaggttgtgtgagtcctgaggtgtgtgagaggattgtgtgtgagtcctgaggtgtgtgaggggttatgtatgggcccctgaggtgtgtgaggggttttatgtgtgtcctgagaagtgtgatgaattgtgtgggtcctgaggtgtgtgagggtttgtgtatgagaccctgaggtgtgtcaacattgtgtgtgagaccctgaggtgtgtgaggggttgtgtgtggattcctgaggtgtgtgagggcttgtgtgtatgagcctgaggtgtgtgggttccttatatgggttcctgaggtgtgtgaggggttgtgtgtgtgtcctgaggtgtgtgaggggttgtgcttgggtcctggggtgtgtgagtgggtgtttgtcctgaggtgtgtgagaggttgtgtgtgtgtcctgaggtgtgtgagagtttgcgtaggttcctgaggtatgtgaggggttgtgtgtgtcctgaggtgtgtgagaggttgtgtgagtccctggggtgtgtgagagtttgtgtaggtttctgaggtgtgtgagagtttgtgtagcttcctgaggtgtgtgagaggttgtgtgagtccctgaggtgcgtgaggggttgtgtgtgtcctgaagtgtgtgagaggttgtgtaggtttcaggctttgcagctcccctcctgagcctcagccgggcggctcccagggcagggtccccccatccctgtctctgctgcggctctctgtgtgttgctcttcccggcctggccaggacattttcttcattgagtcttccccagattctcaccctgcagcaaccacgtgcggcagcaggtcagggcggaggctcctgggcgtttggactgtggggcccttctcttctctctgataaggccccggttttctgttcagcctcgcggtgccttagccgcatttcaggcatggtcttccagggccctctggtctgaacattctgtagaggaaaccacggcacacctttcactcatcttttaaaatcagaagccagttcctgagctggctgcttggagtagcagcagatacactttttaaagtagcttatgtgtttaaatttctggttcaaaggactacttctatagtggtacagaccctgacaaaagaaatcaccttttctaaatatcatcactgcaaatgggcaatatgacctgggaactggtgagatgccattgagattggagcccaccccaccagagctgagtgaattcttggatgactaaatgtcggaataagttagggaggggtgcatgtcatccaaagaatgacatgagctcactctgtgcctcaagtgacacagatcatagtagattccagcgaaatacttgcagctgtgttgagttcctcaaactaccacaaaattcttatggcaaaacttgtgagaggtgaagataagagagtgtgagccctgtgatcgaatccaaatatgaattgtaaaatatgccttaatactattaccagtagctgtagtgtacaatgatagaaccaaaagataaagattttcggccgggcatggtggctcacgcctgtaatcccagcactttgggaggctgaggtgggcagatcacaaggtcaagagatcaagaccatcctggccaacatggtgaaaccctgtctctgctaaaaataaaaaaataaaaaaaattagctgggtgtggtggcacgcgtctgtagtcccagctacttgggaggctgaggcaggagaattggttgaacctgggaggtggaggctgcagtgagccaagatggcaccactgcactccagtctggcggcagagtgagactccatctcaaaaaaaaacaaaacagataaagattttctactcattttctagttgtcccgtcagtggtgcatttcagcacactcaaaactccatgtttcttttggattttatgagctgagtctgaatgttataagtgacacactcctttttttttttttcttcttcttgtgagacaaggttttgctctgttgcctaggctggagtgcagtggcaccatctcggttcactgcaaccttgacctcttaggctcaagcaatcctcccacctcagcctccctagtagctagaactacaggttcacaccaccacacccagctaatttttgaatttttggtagagacaggtctcgctatattgcactggctggtctcgaacttctggactcaagtgatccacctgtctcaacctcttaaagtgctgggattacacactctttaaaaatgttctctgtacaatatttcgtaaaggttgagaataaggaaagacattgcccctttaagcaaagtggtaaggcaacatataaaaacgactcaatccacaatagtgagaatttccgttaattacattctaaagtttttttgtttaaaatgaattgagggagtacagtatgctcttcaagataatgaacagagaaaaatgcccaatgactgctagccatcccaataatgtatttactctacgttgtgttattttgtttctgcagtaggacccaactgattagaaaggaaattacatagtcagtgaccagctgagactgagtacggacagaggaagaagctaacttacatctaaagagacctgaagtcaggagacatttctagataaacccctcagccagataacatcaacccatgacttccaataccattgctgaagaggtcacagaggagagagaatcctgagaagatttttaaaatctgaaagttcttgtattaaaagaagtgggaagtttcttggtatgtgtatgaagcctaagattgagatagtggtactgagggtggcatgataccccattgaggctgggagttttatttcttttaagtctttctgtaggtatacctctgtgggttcctgccacttctaaaccatagttataaggccaataaatacataaaacaatcttcctactgctcgcaggcaccatgctcttcctaatagctctataagaaccctttattgctcgtgaccctgtgtccacattatgctatctgattattcataatttttctcggatctgcttgatatgaaacatggatacagccatatttgaaggaacatgttacaggaaaagaaaccccgacctcggaatctgaggatttgtataatttggactttacacaaaataattatgtaattttgggcaagtcccttaatacagtatttgaactcaattttattgccccttttaggtctaaactctcagctgtgagtactaatttgtggcgtgatggtgaggtgaaatggcagaggcccatggcacatcattgcagaatatgcgttagactttcacaagtcatcagtcatgaatttcaggatctggctgcttgtcttcatgggagacgtcaggtacagcttgcaattagctaaggggttcatcttacaatacctctaattactgctttagctaaaagcccccatgaaagacacaagtttaccacatcatatgaacccatggtaaatattttgtgacctgatacttatccagtcagtgctctgttagccagaactaaatagttgccagaaaaatgaaaactaatattcataatactggtcttgaaatactacaaaatcatgggacaaaatcagctagtcgggagactggagtgggaggatcacttgagcccaggaggcagaggccgcagtgagctgagattgtggcactggactccagcctgggtgagtgagtgagacaatgtctgaaaaagaaggaaaaagaaataaagaaagaaagaaagagaaagaagaaagaaagaaagaaagagagaggtagggagggagagagggaggaaggaaggagaaagagaaagaaaaagaaagaaagaggaaagaaagagagagagagaaagaaggaaagaaggaaggaaagaagggagggagggagggaggggagaggtttgaagaggctcactctgcctgaagacaggaagggaccaggagccgaggcgctctcagccccagaaagggcaaggaagcagagcccacctccagcctccagaacgaatgagcctgccaaggcctgggctgtagctccacgagactcagccaggattctgacatacagaactgtatgagaacacgattgttgttttaaaccactacgtgtcggtaatttgttacggcagaaactcttcttaaatgtgcatttctaggcctcacccgtataaattcggattcaatagtcccgggctgagaatgtgaatttttaacaagcgccccaagttactctgatgaggtgccgagaataacactttaagaaaacatggctgacagtaagcagcagaaatatgaagaaataaccagcactactaactctgcacagacagaaatgcaggttccagagattgatgaggctctgatgatgaaggggcatctgagccaggatgggtctcacatttccagccagagaggaaggaggaggctgagtggctgcacagtggggaagcccgcagaggggagagtctcctctcggatgcactgggtctatggcatggctgaccaggtgccctaatgcaggaggcatcggaaactgtgggctcgaagccaagctataagcggcgcactgaagatacagaggaagagttcgctgcacaaggttgatagtcaagggggaaaagttagatcgggtaattggagttatgaggagagcggaacggggcaaggattccagtactggagaatgtctggtttactgtagccaagatattttagtttagggcataatttaaaatgctcccttgactcctccaccccatggaaggtctcaggttgaggggcccagctagtcctgaatgaggtcctctgtgaccaccagctcctcttctctccttccctctgccatagtgaagctctctattgtgggatttgggcatatgaggggcaggcccacctcccctagatgtcacctctctgccttctgagtatcaagtcagtctctttctccctaagcctcccaaactgtggggacttacgtgtcagtgtcatttcagttgttgtatgattatagatacatgaaaaaggaatatttaaaaattgtcctgacctccctcctcccgacccctgtaggaacccaccacttaaccacacaagggcccaactcatcgagcattacagcttggggaagaaacgccagccgcgagccagagaaacaaaaacgaggggctgtccctaaaatgcaggatccaagggcctggagctggagagaaatcaggcagcacctcacagaatccaggctcacagaaagtctgtttcgatcagaatttaaaacaaccctcttcctgctgcaactcttcaggccactgacaaggtgacaggatcacattttgtacaggatacaaacatattccctatgggtggacaaaacgaccccgtagcccatctacaccaaggagctgcacctgtgccctgtgtagccagatgcaattttctattattggaaaatccactttaagttgttccttagcaaattcttcccaagtactgtttcctttcctcaattcctggcctagcaagtctagaaagaaaacaaaaagaatgtaaaatgttcttggttgactttactcttaattactaaaaagcaaacagagaaaattaaaatcaaacacatgcaaaaaattcttctagagccttgcacacaatgccagttcttgaaatatttcataaagcaaagctaatgaaataaacaaagacgtggctgaaaggatatgcattgtactgtgcttatggagccacattgctcactgcatctctcgctccactgccgccgggctcatctgccagaagcctgttcctgagctgattggggttctggtccaggggtcccaaggagcgaggcccaagctcaggaggacaaagaacgaccacctggaaagtggcaaaaatctgtaaaaaaataaaatctgagtgggcccaaggggcacctggtctcaagagcaaacgctgtgtccagagcctcatgtccggaggcccagcccgactccctggctcttacagccccgaagcccagagaccaccccagcccgactccctggctgagacttcccgcccggatgccgtgagatcgtcccagcccatgctgaggtcagtttgtgctgttatctcttttttttttttttttttttttttttttgaggagtctcactctattgcccaggctggagtacagcggcgctatcttggctcactgcaagctctgcctcccaggttaaagcaattctcctgcctcagactcctgagtagctgggactgactacaggcgcccgccactacgcccggctaattttttgtatttttagtagagacgaggtttcaccatgttaagcaggatggtctcgatctcctgacctcgtgatctgcctgcctcggcctcccaaagtgctgggattacaggcgtgagccattgcgcccagcctcgggcaagcctattaaaaacttcctagtgtgcctcctcatttgcacaaggatgtgtggtaaagggttaactcagcaggcttggggtgtccaaaccctgcacattcagagaaaggtctggccctgtccttcttcccagaggataccctttgagcccttggattatcttgcttgataagagtgtttacgtttacctgcggcctccagccatggccaagagttcatggagttcatgttaacagtgatttatgtggaccctagagccacactacatcaatttgacctctgggatagctggactgggtgactaggattagccagcggaatgattcaggcctatgtgaccggctcccaggagaagccctggaccctaaggctcgggggcttccctggcaggtggtgttatgtgcacactggcacagttgttgccgacagaattaagtgcactggtgtctccttcaggtcaggacggcgggcagctcacagctggcctctcctggactgtgtcccaagcacctttttcctttgcttattttaatctgtgtccttttgctataataaacagtaacgttctgtgaatccttctagtgaatcattgaccctgagggttgttgggggcgtcagacacaaaggggataaggacacctgccttgactgcctcagaggggtcacagggagctgagatccagctgtcacagtgaggccatgcaagtctgggggttcttatgacacagaattctagtgaggcaaacagtactttcagactgaataaaggaggggtgttattcacttccagcgtctgtcatctgccgaaagctacgtgccctctccacggaagatacaggggcaggatctcccatccacagcaggcacacagactcccaaaggccctgtgcacagagctctggattaggaacagattccccccccaccgccccccgccgccggggagagccccacactgccttttcctctcaggatgcctgacaccatttagggtgggatgtgggaagctggcttcaggatcagacctgaagacaagtagctgacctgggggttgagccagggctcacacctaggcccttctccaggggggtttaccaaaaccagccccatgtcctgtagacctgacttttgtcaacacacacatatatcctccccttatgcacaggtgtttatgtaaaagcaatgtatgtttatatgccaaggtgacttaaaaattacaaagtgcggtacaaacatgttatttacgttgtgatgaggatgacaaggtttggatttcatgctgtgtgtaatgatgtcagttggagttcttcttgggataaaggagggcaggcggtcagcacagttcctgttctgtgaatcaaggaccttcgttcaagcagtccttactggacacctgtgtcctcatccttgctaatacgccaaccagccacacacactgcaccacagagtccctatgtcataccagccctgcaggcacctgtttcttggcaccaagtgtctttcatgagtgtgaacccatctgatgttagtggccagtggggaaaatgcccatgggaagtggagtgtcgggggagcccgagcctgtggcctggccattctgcacagtgagttgcggccagtacgttatgtgctgatgcaattcatagctgctcagcacgactctgcccagattccgtttattatcctactaaataattattttcattgtcttcatctttttaattgcactactgatgtctttatcttaaaatctgaagaaggctctctccatggggcagactttgtcatttacaagctaactggtgagaaattgaaggggaaagtgcgatcacgttaagtgcctttggaagaccacaatcgggatgcacaatcactcaattataacttggtgggaagggaagcagggaggtttgaggaggtgagaggcgagactctggttcagaaacctgtgctcaggcctgagtccctctcattggccgggggtcttgcagaagacacggcctctctctgagctcagttcctgtatctgcagggaccatgacccatcagccagttggtatgaagagtaaatgggggaacccatgggacagcgtgcaggaaactccagaacgctgcatatttctctgcattttgtgtgtatgacaagccatgtgggggttgttatttccatcaagcactagatgaaatccattctgctcgattctatctagttgttgccttcctagaaacacaggaataacctgcagcaccacccccttctgttctgtggcattggcacaatcaaggaatctacttttgtgcttttacacattgaactgacaggtaaggtcaggcatcgactgtcacaggggccagtggagaggtaggagggacgcccacattcgatgaatcctgcatcacggtgttggacttcttgttccacggtgttggacactaaacttgttcacattcaataacttgagcacgaataaaggcagctcatagtaataacacctgatgggtacaggccctgtgctctgctctaaacactgctcctgttacccctacaagacatgggccctgcatttcacaaacatgaattctgaagaccatgaataactgttctggcccagctctattgggccctaactctgtgcccggggtcgggatgcgggttgtatttggagcccgttgcagatgcggattcgtctgctccacgcagggtgctctgacgtactctgtgtggcctggagctcagaaacctgtgctggactcagtgcctgcagacgctgcccctgggtagctgttttccaggcgtcaggagacatgctccagaggctccagaagcacagacggatcatgaggtcaggagatcaagaccatcctagctaacatagtgaaaccctgtctctactaaaaatacaaaaaaattagccgggcctggtggcaggtgcctgtagtcccagctactcgggaggctgaggcaggtgaacggcgtgaacccgggaggcggagcttgcagtgagccgagatcgcgccactgcactccagcctgggcaacagagtgagactccgtctcaaaaagaaaaaaaagaaaaagaaagtgatggagaaaatgttcactatggagtctcacatgtgggtggtgtccggtgctgaaactgaaagaggtttcagttttgtatgtaatatatacaagggtgaaaatagtttacatcacaaatcagattaaggaaaataaatgtatagggaaaagagttagcaggttgctatataattagattagtcaaatcgtgtttcaacaaaaatcagcaaaaacattctgtgagcatcaattggttatgtggagttcatgatagagagtgcagcatatcttattacttgtaagctgtatgctacatatccttgatatcagcaaaatttataacaaacttacatctgtatttatatgcacatgtattttgggaaagctattgttaaacatttaagagtgtaccactatcatggccaggcacggtggctcacgcctgtaatcccagcactttgggaggctgaggtgggtggatcatgaggtcaggagttcaagaccagcctggccaagatggtgaaaccccatctctactaaaaatacaaaaattagccaggtatggtggggggtgcttgtaatcccagttacttgagaggctgaggcagagaattgcttgaacccgggaggcagagattgcagtgagccgagatcgcaccactgcactccagcctggggggtgacagattgagactctgtctcaaaaaaaaaaaaaaaaaaaaaaaattaaaagagcgtaccactatctacataaatacatacactgaaaatgcataataacttcagctgctctgataccaaatgccaacatccatgaaaatgtcctacaagagagggagggagctgcatcaattgcgctgatgaccctgggccaattgtcctaagatctgttaggtctgtgatctgggagggccctggagatcctgaggcagcaggtgaggcctgaggcctgggaccccaaacccagctaaaactaaaaactaaaaactcttaagtgtagagttcagtgatactcacattcttgtgcaaccatcagcaccatccatctccagaatgtttttatcttctcaaacttaaactctatacccattaaacagtaactctccatccttccctgctgtccccagcccctaacaaccatcattctgctttgtctctggatctgactactctaggaacctcgtataagtggaatcttacagtatttgtcatttggtatctggcttatttcactcagtgtaatgtcatcaaggttcatccctgttggagcatgtgtcaggattcccttccgttgtaaggctgaataatattccattgtacggatacaccacctcttgttgactcattcatcctcttgttgactcattcatctgtggatgggcacttgggttgcctccacgtttgagttattgtgaatcatgctgccgtggacgtggctgtactgcaactggttttgcatttatttgaataggtggatttcaaaggtacaaaagaccatcctgtgaaccgtgactccctcccagcccatcctccaggccccctagagttttaaccacaagcagccatggtcaccagtttcttgtgatctttctaagagtatgtgagcatatgtgctatgccatggtagaggctggacgcggtggctcacgcctgtaatcccaacactttgggaggctgaggcaggcagatcacctgaggttgggagtgagaccagcctggccaatacggtgaaaccctgccttcactaaaaatactaaaattagtcgggcacagtggtgcgtgcctgcaatcccagctactcaggaggctgaggcaggagaacagcttgaacccgggaggtggaggttgcagtgagccaagatcatgccactgcactccagcctgggtaacagagtgagaccctgtctcaaaataaacaaacaaataaatacaataaaattaaaaatctaacaacagtgccctcgttcccatgatctcacagtccatccagggagacagacttgtaaccgaatgccatgattacaaccagctcaatgggagatgaagaaggaggtgtgttcggaaacctgggaactgaggagggagtgggctctcaaccttaacatgggctgcgggagttgggcaagaatcagaaacagattatgtagatgatactggaactgtgtggtttcccatttgcaaaaaaaaattaaaattatattttacaatgttagtatattctgagcattttaagaagtaaagtccactttgataaaaggaagaatgtctatcttccttgtatatatatctattcctatagaatacccatttgtgtcttagtttgtaagagctgccataacgaaataccatggactgggtggcttaaacaacagacattgattttcttacagttctggaggccggaggtccaatatcacagcattggcagggctggttcttcccaaggccccactacttgtgttgcagatggcggccttctccctgtccctttcctctgtgtacatagatccctggtgtctcttcttcttcttttttttttcttttttttttttttgttgagatggagtctcgctgtgtcacccaggagagcaatggcatgatctcggcttaccacaacctctgcttcctgggttcaagcaattctcctgcctcagcctcccgagtagctgagattacaggcacacaccaccatgcacagctaacttttatattttcagtagagaccatgcaccatgttggccaggctggtctcgaactcctggcctcaggtgatccactcgccttggcctcccaaagtgctgggattacagtctcctcaccttgggcaatttaatccctctggactttggtttcctaactcgtgagatgacaatagtagtttctttctaatttggctgtttttaggtataaacgaaaagaatatataggtaaagtgcttagtacaaccgtctgggaaatagcaaagtccccataatgccagctgccgttactgttatgtctagtatcgaacttctcctggaaatcagccacctctctccttgagccctgtccagggccagtgggtttttggtagtgtagaggggcaactcctatcttgcaaggaacggcaagaggtcggggcaagcagctctctctggtcacttcttcaagggggtggttgctgaggctttggaagggaatttagtgagctcagaccctctcaaggctactgtgctccaagtatgtggcagttcatttcaagcttgatggcacactctttgcagagcagttgccaaggaacgaggtaatcttgtgacagaaatactgcctgatgctgtcagtttgatggtcgaaaaggttttaggtggtatcaaattttattactagcattcctggtctccatgaaagaaccacataagaagacaagttatgtcaaaggacaaaaccacagacctagatgggcaccgtgcatacagcagacacttggtttccttttgatattgactcaaacagggactggattaaaaaaagaagaaaataacaacaagaccacagacttaagctgatcagtggtctaacactggcaagattacttttgttgataaattgatttcttgggaaatcctgggaaagttcctggacgtgaccctgtggtcctaccaccactagctacctgtgaccttgggtgagtcagcaagtggatgcaaagggaacacacacagcacggtgccacagcgggcaccacctgccccccgccgtcacagatggcttgcaaataagctactcacgtacttcctgagatctgctgcacccaaacacaccaagctcagagaggcttttgaggcagacaagggcagggagagaggatggttcttctcgcatgggtatttaaggagtgtagtgtcatgcgtgagtgactttttggttagtaagttctgctgattacatgaagcaatgggataactatcacggccaaaagagtattcctactgcaggctcagtaagactttctaatgatattgaagtagtagttccctgaaaagagctactatgatcacatggcttggttaactgtttcttacaagtctgagcatgaatttaacacacacgaactatacactgacaaagacaggatgctcctgaaataaaatcacagcatcttattgcatatactacatcatccaaggtcaaaaccctttcatagagacatttaaaactataaccaagtaaaagagaaaatagatgcaaatttgcttttacaaaatttgaaaatcaaccaaaagagtaaggcacaagatgcagtcagctacaaagcacttcagagaacagcgctttgctctcaggtctgggacccaccccctgggcaaggccgcctggcagcaggcaggaaccaaacccctgccacctccactcactcccagggttcctctttgcaggatggtggggagcgcaggcaccaaggcaggaaggccagggcaggaagatgccccgcgtccttcactttccctcagtgtgagcacaccaagttccctctaaccaggagaacaggaccctaggcaccaaaagtcaagcatgagggactgccacaggcagtctggcaggtgtctttcagatgctaaagtgccagggtttgcaggatacttggatggtttacagtgatgatgagttggagtctttaaactcaatggtgtcctagatactcagttaggatgatagtgatcccatccatcccgtggttggtcactgagctgcgtacgaagctggcctagaatcagaccccgcatccatagggagaaatcatcaccctctaccgggatctggatttgttttcaggatctattctcatgaaggagacttgagaagctgagaaactccagaagaatttaagtttcaaagtcagatgagtttgctactcaaccttcatcatggttgtagctttcgctcccagaatacaaggccagagaggcaccaaccaggaggcaaacttcaccttcaaggccaggcaacgcctggctacagttagaccccgcagcagggttaaagaaggctacagttagaccccgcagcagggttaaagaaggctacagttagaccccgcagcagggttagagaagtctctccagcaaggctgggagttcagcttccaatagatctagagggccaggagaaaaagcatgctgagtgcctggcggcatctagtggtcactagtggtcactgccagtcatcagctttcctccaataaaccagttatcatgagaatataaaacaatcaggaagaaaaaaaagtgtagctttttttttttttttttttttttttgagacaagagtttcgctctgttgcccaggatagagtgcagtggcagtgatcttggctcactgtaagctccacctcccgggttcacgccattctcctgcctcagcctcccgagtagctgggactacaggcgcctgccaccatgcccggctaattttttgtatttttagtagagacggggtttcaccgtgttagcctggatggtcttgatctcctgacctcgtgatctgcctgcctcggcctcccaaagtgctgggattacaggcgtgagccaccgcgcccggccaaaagtttagtattttatcaaagaaaaccatgacatactaaatagtcctgaaacaaaaacgatttacacattttcttctgactaggtatttattaagttctaaaaccttgaataactgctattttaaaaattcacactaaaagaaaactagaaatgttaacatcttttacagagggcagtaagtggccttttttttttttttaaattataattgcctaggagaaaggtgagctaatctctttggaagtgtcatcagctggtgaacttcatcttggtctccactttatgtctttcactccatgaaaatgtcttttcaaagcagtgttatccgcccatggtgagtttaaataggcatcatcatcattttcttccaatctctggaaataagtatgttttattcaggcaggcatttcaggaaagtgttttgcacataaagagactgaagaaagagtccatgactgacctccccctctccctgccctctaggagcaggatactgccatgtctaacaccaggggacacctggcaggaccccgacagacctgcagacagaagctctagaaagacccctccccggcattctgcagagctcactgctccccagcagccccaggtaaggcacacaggctatgtgtgggcgccagcactgcagaaagcccatctgtcccctgctaccttgagctcctcttgtcttctgtgatagtacagcatcagctgcttctgctcctcactgctaataataggctctcgggctggagctccctgtcccctctgcaaagaggagagcagagcaaattgtggattaaggtgttcttagagtgacaatcctgaagttacaacaaatgttttacgattgcctttgccggctactaaagataaacaggtcccccatgtctgatcacccgaagtgaagcatcaagggaagccttggtcttgagcagccctgagccctggactctcactgtgtggagaccagaggctgcacgataccatctctgtcttgaccattcccaaggcagacactgcaggcaggtccagtgggaaagggaggatgctcagagccacggactctggatctacataaggtggagggccccatttccccaaaatcacagcctagtgacgtaggagcacccacaaaaccaaggcggcccctcaggttacagcgctacacgatgtccttcaaaggtctcgaacctttcctcctccccctcctgtacacagcatcagcagtttgaaaaagcctgaaatcagtgacgggcgaaattttacatttcaaggaacatatctgtttacttgcagccctatttttacgcttgaaattaacatagtatatttcctctcccccacatattaaaacaaactctagatattggtactcaatccatattttcttccagtttttgttggtgtgcaggaagaggatatttttagtttaaacccgagccaataagattaaaatatttgtaccagtagtttaaatctttcggattcactgtacatttttatcagtttgaagggaaataacaaaaactactgacacattaaagcaaaaagtacttacttgctgaatcttggcgataattttggttttttcattcttccccacgtagtctgaaagcttcttcgttcttctcagctccttggctgcccaccacagctgcgcctctgcctctttaatgacgttgagccctgcctggggccagtcgtaagaatggcttgactgtgtgttcccacccagggggcagagcccagctgagcccctcccagcagggggcaggggacagatttctccccgtgctcaccatgggaggcctgactcccgcacctcactctaagtccttgctgactttagtaccttccctgttaagtttccactcatgccctgactcagttaacttcctcctctggacaacagggagatcctatctcatttgcaccttgatccatatagttcgtcttagacagatctgtaggccactgccagggaagggcactggcatcgtgctgggtgtttaaatcgaggtataaaggggctgcctgtttacttctgcatatttcatttatttaacatggcttagacaaagaatattgtccaataggataagaagtgagaaaacccaaggaaaatggaacatgagggtcagaaaataacatgaagcaacaggtaagactagaaacacaaatttccatgcaaagggactgacgcatttgggtagaaataggaagaaattaggtagctggcttcctagcagccaaagacagtggaaatgtttgcagtcactcctgatgagcggcctcacaaactgcgtccactgcctcctgtgtgtggggccaaacccctcactcatgagtacccactctcaggggctgctcctgaattcagaactctgctctgaagcagggcatagcaaacctgaaagctgtgtagggagcaaaacactacatccagaagaggggcatcaaatcttaagggctttgggggccaggaactcaacctccagagtacccactcacaaactacgtacctgtgttcccgacaagtcttccttattttcaaactccatgcggatgggatcatacggtggcaaccccatggggtaaacaatcatcaccgcgcctcgaagctggtccaaggcatctttcaccatctccatggtaacacagacaccggcttccacttgtttctgcaagcagaaagccatcgttatctacagtgtggctaatcacttccataaattcgatcaagatcttgtacaagacccttgccagatactgccagagcaacaaaaagaaatcaaacagttcttgctcccagagtgactaccatctatttcaggggctgagcgaagcacaccgtggcctgtattataaagcagacggtgagcagcactgagcatggagtacaatgaagtgcaaagaattctcaaaggagaaagagcccaatgctggcagcacagatggcagtgaggatcgggagatacggcaggcggagcaggcaccgcaggtgggcctcgaaatgcagatgggctgaaaaggtacagatggcagcaggtgcttcaggacaagctgaaacaaagaaaagcaggcgccagccccctcagcatggggcaggaaggagagaagatgaggccagctctagctggatcagctgaagtttgtttttgaatggccacaaaagccaggctgaagagttcacctttcctctgttaggccacgggaagcgactgccttttctgggaaggagtggtaatgttgagagatttatcttgtagctgatatagaacagacctagttggccagatgtggtggctcacaccttatgtaatcccagcactttgggaggccgaggtgggcaaatcacctgaggtcagcagttcgagaccagcctggccaacatggcaaagccctgtctctactaaaaatacaaaaattagctgggcgtggtggcaggtgcctgtagtcccagctactcagcaggctgaggcaggacaattgcttgagcctgggaggcagaggttggagtaagccaaaatcgtgccactgcactccagcttgggcaacagaataagactctgcctcaaaaaaaagaacagacctagttggagggagaccaggtagcaggctctgaagagtacagaggaaggtgtgatgaaataacaaatatatctggtctttgctactcagttccaggcacagagctccaaaactcttggaatttcctgagtgacaggagtgtcttgttatttataacgagccccttctcaccatacctgagcttgtgctaatacagtaacctgtagtccgcgctgggtttcaaggaaggggctggccgtgcctgggagaccaagcacataattagagggttggagctttcggcctcactcccttcctccacctccaggcgctagaggttgggatcaaacacgtggccagtggtttaagccatcatgcctactgaacaaaaacgctataaaaatcccagacatcatggctcagtgaagcttcctgattggtgaagacgttgatgtgccgggtgacacacatcagtgggggcgttgtgggaagctccaaatttgtagtcaagctggacacaagtatgggtggcctggggacctcacgtgcagctggtgtctgaaataagaggagtcttgttggtgatctcaccctttaacttttaggtctgatgctaactccaggcagttagtgtcagaattgaaggatctgcccttgacctgtggggtctgtgctgtctctgagtagttagtgtcagaacggaattgaattgactggcaggacccccagtgggcatcagaatgcaaaaggctacaggagagccttaaagaaagccacagctgtggaagtgaaaggaagaggtggacttaagaggcatcatgggagcagacggtacagaaccccacttcaaacctagaggtgacagaagggagaagtgttgaagatgacactgaggatttgccctataaaaccaagacactgtggttctgttactggaaacagagaagctcataggaggtgctgattctcagggacagaacagagagggagaggagtgaggaagcaaagagctcatttctagaaaactggacttcaaagtgctgactgggtgttcagatagaaccatctcacaaccagctggaaattcaggttggaagtgaagcaagatgtcagggggaaaggatggaagcttcagagttatctgcagagggtggaatttgcatttggcagagtagataagatactgagagaggaagaagaccaaggataaaaagtactttcagaagtacacaggcaaaggggagaagtgaggcgaccgagagaggagttccacagcaaagtgtggggagaagggtgcagaacaacagccagaccactgttttcttgccatggcctgagacgtgctcacatgcctagatgccatcaccacgcaaacgacgggctcaaccagggcctctcctgtagagcttcataaagcctttcctatattaacaggcacagagcttcagggcagcctttgctgaggctcttcaaagattagtcaaaagcttggtaagtttgagaaatattggtttaaaaataacagttctgctgagcaaaccaggagaagcagaagaaaaagtggtgatcagtcaagagacttgcagttgagagcggtagcaactaatatcaccaacacacaaatacaagcaacagatacagataccacttctttcaatagccttaaattctcttcctccagatacacattatctgtatatcaatggtataaatttacgctcctccctctataaactagcctttgtataaaatgctgaagacaattacaaaaaaccatttatatcaaatacatattaagtcaatcaagtgtctggagagctactcgatggccacaatattcaaatctcccctacttaactttgttaagttcttcaaaaaggtaaaagaaatgaaatcaacatttgtattatacatatttgtattatacgtgaacctatatttacataagccaacaaaaatttgtgtctgcctggaggaacggagaggcctctgggcaaccgtcaggattatgaaaggaaaagctacagcctaccccaaatacgcttgtttcctttgcctccggaaggctgaaagagaaggctggctgagaggcaactctggaagccagagttggagttttatctcaaaagacaagttttaggccgggcgcggtggctcatgcctgtaatcccagcactttgggaggccaagacaggcggatcacctgaggtcaggagttcgagaccagcctgaccaacatggagaaaccccgtctctactaaaaatacaaaattagctcggcatggtggtgcatgcctgtaatcccagctactcgggaggctgaggcaggagaattgcttgaacccaggaggtggaggttgtggtgagccgagatcgcaccattgcactccagcctgggcaacaaaagcaaaattccatctccaaaaaaaaaaaaaaaaacccaacaagttttagtgcatcatttaaaaaagccaaccttagatattattgctttggcttcttctatagtcttctttaacacttgcttcatcttctcatttggagctataaaaataaaaaggagagagggagaaagagctgtcaaatacaaagcctcttctgaaatacctcaatcccctctgtctgagtcagggggtaaatgaactgagagagagtgcgagtgtggaatttagggaagagaagcaagaaacctggctgccggaagttaggtgaagacctcttcccaacagcagagacctggagtgtgctttacgcaaagtggcaaaggctacaaaaaacagaaatgcatgtcgttgggtaaacagggccggtgaactttttctggaaagggccagagagtaaaatttgaggctttgcaggccacacagtcttgttgggtgggataactcagctctgccacgtagcacaagagcagacaatacttaaataactggggtagctgcgtctccttacaattttatttacaataggcagctggctaaatttgacctgtagcccataatttggtgacccctagatcaggaaaaaataataacttgaaagcttagaagccaaaaaaaaaaaaaaaaaaaagaagaagatggaatgcccaaacctagggaaaatggggcaagttgaaaccatacattcctagtaaataacagtattaattagacattgaaaatattagaaacacaagattgtattataatagaagtggttaggctgggcgtagtggctcacgcctgtaatcccagcacttcggaaggccaagatgggtggatcacctgaggtcaggagttcgagaccagcctgggcaacatgctgaaaccctgtctctatgaaaaatacaaaaattagccgggcatggtagcaggcatgtgtaatcccagctactctggaggctgaggcaggagaatcactggaatccgggaggcagaggttgcagtgagccgagattgtgccactgcactccaacctgggtgacagagtaagactctgtctcaaaaaaaaaaaaaaaaaaaaaaaaggtggttaatttaagaacatattacatattggtttaatgatgaataatgaactgttaactggttctcatattttttttcctcatcttaccacatcttcttacgtaagaaagctgtggaagacaaccatttttcaggttaacattgaaaggaaaaaatactaggaattcttactatccctgatatttaaaaaaatgtatttttgagctgctaaaggccttgcaggaatactgttcttttactcctaacagtgttttagggctgttcaattacagtgttttaaatggcgcttttaatgcaggttaaaaagaataagctatcaaaaaggattatcatcaattccacatgatcagccaaacactgaaaggagaggaatttcctcagtgttttgccgtgtactgaagtgctctgccccagagagaagcatgtccttgatcagggaagtccatgtgctgacatgctttccctttcctctttcacacagtccatctcgaaagatcccccaacatttgcgaacagtaacaaaacacaactctgaatacattgcggtgaggacctgccaacaattattaggtggaaacacatgaaattgccaatactcaaccatttttgagctacagaagggaaagggtcatttcatctggttcgtcgaatacatataaaagcaagctgcaacttattaaagagcaagacaaaagcttcctttatctacctaattcatcctagattagagttttaccaaaggagctacagagtacagtattttgtaagtctgtagagaaatgacgaggtcaatttttaaacgtaaagaactgctttctcacacctgtaatcccagcactttgggaggccgagaccggcagatcatctgaggtcacgagttcgagaccagcctggccaacatggcaaaaccccgtctctactaaaaatacaaaaattagtcaggtgtggtggcacatgcctgtagtcccagctactcaagaggcggaggcaggagaatcgcttgaacctggaagacagaggtggcagtgagctgagattgtgccactgcactccagcctgggctagagcaagaatccgtctcaaaaaaaaaaaaaggaactgttttcatacttatgcctgtatcaagcatgcacatagaagagaaatcctcacttaccttgcccattccttcgtccaatatcatcctttttaaacactgcacctccgctgggtacgcatttttcaccccattcatccttcaatttcaattcttcaatctgatcatcggtcagtccttgcatattaggagggagaaatatgccatgttcggctaattcttccatttcttaaaaataagtgaaagacagtatcacaatcataacacctcataccccattggaatgtaagctccaaagagtcaggggtcttgcccatctggctcactattttatggaacaaacatttatatgccacttgctatgtgccagacctggcctgggcctttgacacgggggcatggtactggtcttattcatccttgtcttttttttctttgagacagggtctccctctgtcacccaggcaggagtgcagtggcgcgatctcagctcactgcagcgatctcagctcactgcagcattgcctcccgggttcaagcgattctcacgcctcagcctcccgagtagctgggacaacaggcatgtgtcaccacgttttgtatttttagtagagactgggtttcaccatgttgcccaggctagtctagaactcctaggctcaagtgatccgcccgcctcagcctctcaaagtgtcaggattacccgtgtgagccaccacgcccggccccatccttgtcttctgaaggctgagcactggtgcagaataaatacatgaattttcagttcactaatgtgactcttagcattcagcacatttccaatttataacgttataggaaaagaagatgaattccttttctcctcaaatgctttaacttaaaaataacatttaatattgagtttgtgttggaacctcaattaagaaactacacataagtttcatgaaaagaaccatgaccctcaggaatttctccacggtgcaaaactcacatattcatataatgtaatcaatacatttcataataaatcacatattcatgcaatttaataaatcacataaatgaatatactatttattgcaaatagttacgtttgtatattctatatatacacgatagttatataaacagtaatatcctagaccacatcaggaagtatcatcccgtcaagttcaaaaactatgctgtctaatgcggcagctactcgctccacttggcgatttaaatttatttaaattaaaatgacccagacgcgatggatcacacttgtaatcctagcactttgggaggcggaggcaggcggatcacctgaggtcaggcgttcgagaccagcctggccaacatgatgaaaccccgtgtccactaaagatacaaatattagctgggcgtggtggtgggcgcctgtaatctcagatacttgggaggctgaggcaggagaatagcttgaacccgggaggcgaaggttgcagtgagcagagatcgcgccactgcactccagcctgggcaacagtaagaccctgtctctcacacacacacataccatatatatatatatatatataatttatttatatttatatatacatatatataatttatttatattcatatatactatatatatggtatttatttatatttatatatatttaattaattaaaatgcaaatgtaaaattcggttgcctggccgcactagccacattccaaatgctctacggccacaagtggccggcagctgcccaatggacagcacagatgggggcccttccaccgccggaaagttctgcggcaaagcgggtgccctggaacctgcgcggggtagggagacggcgccgcaacgcaacaggccgtttccagggcggggaaagatcaccaaggcttcctcaactgtaaggggccgtcccaaagccaggtggctcgctgctttacattgggcgactaaaaatagtaaattcagcttttaaaagcccacctagttctcatctcacccctcacacgtgattaattgcactaagtctgctgttcagcccggcctttcggctccctcctccctccccagcccatttccacttattcgcagcaccccaaatcctggctccgagaggcacctgggcccacctcccagcccggggtgtcagacaggccggatcttctccggttccttattcatctccggttaaccctagtgtcccgtttcaaccccggctgctgcaaatctcttcaataatcttcacaaacctgacccctcggcccaccctgcccctctttctccatcccacgccggtctctcgatctgtccgggatgggcccacccgcgagccgcacctgagcagaggcgctgcaccttgagccgcccattatagacccgggccacctgcaccgtgagctcctccagctcggtactcccaggcgcctgcagcaggaactggctctcgtcgccccgcttcacgtgcagcagaaccatggcggtcccgccgaggtactgaggcgttgagaaggccccggctgcgtggcccgcgggtcctgccggccgagggtcgccggatcgccagcagctgcgacgcactaacagccgctcacagtccggaatcccacgctccctagcccgcggtgagcgggggaaacggcactcgctcccggaagtggatgttgccaagagcaacagtgaagcagagttaaagagccgccagctcaagctcagaacccgagtgggggaggctggggtgcaccgaggcccagcaatccaagcccgtacggagctgcggccggggaaaccacccacacagtctgagaggacagctgattctgagcggaccgacggaaggagattcgcagagccccttcccggaagtgactgttgtcgcggcaactgccaaaacacagaccaagtcgctgaaggggagggcggacctcccaatcgactggtctggggcccgagatttccactcagggagatacgtgggctgagatgggagttactagatggggaacgggaaatacggcgggaaccacaatcgcgcagttccgcagctgccgccccacaaccgctccacattccagcgtcccttccgccgctttcagtctccacttccggcaacgtttccacgctgtttccggcctgggaaagttcggcggcagcgacccagaactgagtcttgctgttcgctgctgtttgcgcgggtcagcttttcaggacggaggggccagggcgagtgtccgcacttcttcgttcaggttgatttggatggcgttgctggggtagctccagcggcccctgccagagcgaccctcccagaaatatccagccatcctccagcggactcttgctgaaggcagtcggcgtcagtcgctgtttattccgggccccacagatccagagtcactgctctcatggagcttatattttagtgtgacaaaaagaaaacaaaaataaatggacaggccaggagcggtggctcacgcgtgtaatcccaacacttagggaggccgaggagggcggatcacctgaggtcaggagttcgaaagcagcctggccaacatggtgaaaccccttctctactaaaaatacaaaaattagccgaacgtagtggcgcgtgccagtaattccagctactagggagcctgaggtgggagaattgcttgaacccgggaggcggaggttgcagtgagcctagatcgcgccactaccctccagccttggcgacagagtgagactgtgtctcaaaaataataaataaacaaacggacaacacaaattcaaatacagatctaaagaaaactaaacaggttgatggacttcttatgtttgatggtcagggaatgtacaccttctgcgatattgggagtaatattatcgtctcccgccctgaatatttagaaaaatatcacagtggggtgtacacccctgcgatattgagagtaatgtcatcctctccacccaggaaattactaacaaggtcacggaggggtgtactccccctgtgatattgggagtaatgttttcctccccaaacctggatgttagcaacaagataacagagggggtgtacacaccctgcgatattggaagtaatatgatcctctcccccccggatactgggaaaaatatcacagcgcgggtatacatttccttcgctgttgggagtaatatcattcttttcctctctggatatcaggaacaatatcacaggggtggtgtacatttccttcgatatggggagtaatatcatcctctccccgttgggatactaggaacaatatcccaggggggtgtccaccctctgcgatattgggagtaatatcatcctctgtttccccggatattagacacaatatcacaaaaaagtgtacaccccctgcgatattgggagtaatatcatactctccttccctggatattagaaaacaatatcatcaggggtgagcaccccctgcgataatggaagtaatattttctctttttttcttttcttttttttttttttttttttttaacagagtttcactcttgctgcccaggctggagtgtaatggcatgatctcggctcactgcagcctctgcctcccgtattcaagcgattctcctgtttcagccttccaagtagctgggattacaggcatgcgctaccatgcccggcaattttttttttttttttttttttttgtatttttagtagagacagtgtttctccatattggtcaggctggtcttgaactcccgacctcaggtgatccgcctgattcagcctcccaaagtgctgagattacaggcgtgagcgatcgcgcccagccaccacttagcattttcattttacatttgttgaagttacagatttatacacacattgattgctgctttattatacacttgcatatacataaaatgggaaatagaaaagaataaaatgggcacaatatccctaaagtttcacattccgaaacattttttaaatatttgctttttagaaatttgtttcaattaagaaactgcggtatacacacacaatgaagtattattcagcctaaaaaggaataaaatcctctccgctgcagaaaaaatggatgagattgcaggtctgtatgttaagtgaaataagccaggcacagaatgacaaatattacatgtcctcacttatacgtaggaacaaaaaagaaaatcttggccaggtggctcaggcctgtaatcccagcactttgggaggccgagttgcacggattacttgaggccaggagtttgagagctgcctggctaacatggtgaaaccccgtctctactaaaaacacaaacaattagccaggcgtggtgatgcgtgcctgtagtctcagctactcggaaggctgaggcccaagaagcgcttgaactcgggaggtggaggttgcagtgagcctggactgtgcctgtatgctccaatctgggcaatggaaagagactccatcacacacctacaaacaaaaggaatctcaggaaggtggagagtataaagggggttagcagacgctaggaagaaaaggggtggatggggaatgaggagaagtggataattgggtcccaaaatacagaaagatggagtaagtgagttctagtgtttgatagtacagtatgaaaattttagttcacaagaatttcttgcatatttccagatgctttggtaagaagcttcctaactttctcattatgctggtttttaagctcttgtcttctgctcttgaaatcatgctggttttttgttttttgttttgagatggagttttgctcttcttgcccagactggagtgtaacagtgcaatcttggctcaccacaacctctgcctcctgggttcaagtgattctcctgcctccacctcctgagtagctgggattacaggcatgcgccagcatgcccagctaatgttgtatttttagtagagacgggggtttctccctgtcggtcaggctggtcttgatctcctgacttcaggtgatccgcccgccttggcctcccaaagtgctgggattacaggcgtgagcgaccacgcccggcccatgctgtatccttatctgttgtttgttgtggtttgtttgtttttgagcccagaaataacttctcacctatgtgttcaaatgatttttaacatgagtgctaagaaagctcattggtggaaaagcagccttttcaagaaatggtgttggagaaacttgatttccacatgcagaagaatgaaggtggaccctatgtcacaccaggtgcaaaaattaacacaaactggatcaaagacctaaccccaagtgctaaaagtataatatgcctcaaagaaaacattggccacactttcatgacatcagattgggcaatgctttctgggatatgacaccaaaagcataggcaacgaaagaaaattagattccttggattacatctaaatgacagacacttttgtgcatcaaaaaacactgtgaactgagtgaaaagataacccatggattcggaaaaatatttgcaaatcatatatctgaaaagaggctgatatccatcatgtataaagaacagctagaactaagcaacaagaaacccaaagcatcccattgacaatggtcagaagactcgagtagacgtgtccctaaagaagatacagcaatggccaataagcatctaagatgatgttcaaaatcactcatcatagggaagcgcaaatcaaaccaataatgtgataccacacattaggatggatatgataaacaagcattggtgagactagagggaagtaggaatgctcgaatatgattgcagggaatgtaaaaccgtgaagcaacagtgaaaatagtatggcgtgtactggaaaaattagaaacagaattatcagatgttcctgcagttgcatttgtgggtacctaccaaaaagaattagaagccaggagtggaagagatatttgtacacccatattcatagcagcattattcacaacagccaaaatgtggaagcaacccgagggttcgtggacagatgaatgaaaaagcacactgcagttcattcatacagtggaagactattcagccttcaaaaggcaggcacttctggctggtgcagtggctccgcctgtaatcccggcattttggaagaccgaggtgggcggatcacctgaggtcaggaattcaagaccagcctggccatcttggtgaaaccctgtctctactgaaaatgcaaaaaattagatgagcatggtggcgtgtgcctatattcccagctacttgggaggctgaggcacaagaatcgcttgaacccaggaggcagaggttgcagcgagcccagattgtgccactgcactccagcctgtgcgacagagtgagactccatgtaaacacaaaacaaaacaaaataaaacaaaacaaaacaaaacaaacaaaaaaaccagacaggcacttctgacacaggctgcaacgtggatgaaccttgaagacattatcgtcagtgaaataaataaatcccagaaggataaacatgaccaggctcagtggcttgcacctgtaaccccagcaatttgggaggctgaggcaggcggatcacttaaggtcaggagttcgagaccagcctggccaatacggtgaaagctcgtctctattaaaaatacaaaaattagctgggcgtggtggcacacgcctgtaatcccagctatttgggagactgagacacaagaatcgcttgaacccatgatgtggaggttgcagtgagccgagatcacaccactgcactcctgcctgggcgacagagaaagactcggtctgcaaaaaaaaaaaaaaaaaaaaaaaaagaaatgcggtatgattccacttctatcaagtgtctagagtagttaaactcatagagttgtgaactagaatggtggcccccaggggtgggcgagagagaggaatggagagtttggtgaatgggtgcaatttccattttgaaagataaaactgttctggagatgatggcggtgatggttgctaaacaatgtgaatgtacttaatgtcattaaactgtaaactgaaaaacagtggaaattgtaaatgtttatactggccattctataggaaataatatatatttataatttttaatatttatatgtggtatattttcccataatcaaagatgaaaatgaaagcagttggatctttaaaaaggaaagaagcgaataatacgtaccagctttctcctgattagaggaagagccccaaagcttctatggacactcacttttctcttcttcttgcattattatgaggaaatccttagaggttggggaacttgggtgactttggctaatgaggagctctgtgccttgaggcccccaggccacagaatagtaaatactcagtctgtgcctccagccctgcagtgtgaggttccagtcctgtgggctccacacccgtcacctgtatcaggaggctcatgtctcaccctgtcttcttgccagccttgaggacggagtctgagcctccatcatgcaccacgcagggaggacagtggacctgttctccgtggtcacggcctagcagaggggaagggcagttcagtgagtgctgagggaccgctgggaggcttgttttgtttcctcatcctcaagacaaacaagagagtgcggtgggcagatgggaggagaccaatgtgcaaactgtccactcagcagactgtggagtttctgttcttggttgtggtggggggtctcagaaatcttattcaaaattttgctttcctcccccactggttgtccttttcatagacatctcatccatgatagcagggaatgagtctctctaaactattccctaagaacaacaaaaagattatgaaggtgatgatgaggataaagaggatgatgacagacaccatggcaccatgaacccttactgagggcttcctaaaggccagactctgagctctgtgctctatgcagcttgtttcatttcatctgcgtagtctcccagttattagtgcacatttcattattattttacagactagaaaaggagcaacgcattttcatataacttgtaccagatcatgaagtcaaaaagggtgaagtccaatttgaaccaggcagtctaagtccagacacatggcatttggccagtcctctccctgcatccaacctgccctctcaaatccttgtcactcaggccgatgcccctgctcactgtgcccttccctttgggggttccttgtagaccacagctagaccagtgggtgccacaatcactgtgtcaagtatagaaagggcagctgagatcacatcaaggattccagaaagaattagtacaggatcattcgggatgcatctctcccttgcccctgttcctggctttccttacagctctcgacttcctcaaaggagtcatcagttcggagattggcttccattcctattgaggaagctggaaaccgtttcaaaaatgctcctcagatgtgcctgtggttaagacctctgagctctgcttaaaactttttgaagctgggtgtggtggctcacacctgtaatcccagccctttgggaggctgaggcaggcgaatcacaaggtcaggagtttgaaaccagcctggccaacatggtgaaaccccatctctactaaaaatagaaaaaaattagccaggcgtagtggcgtgtgcctgtaatctcagctacttggcaggctgaggcaggagaatagcttgaacctgggatgcggaggttgcagtgagccaacgtcactccactgcactccagcctgggcaacagaatgagactctgtctcaaacaaaaacaaaaacaaaaccacaactttttgagagttggaagaccatgaagtatagtacccgggacttagagtctggccatgaatttggaataccaccctttctacttatctgtatggcaaagggtgagacgtccatcctctgagactcagcactctcatctgagttgatctagttgatccaatggaagtgagcgatgatgaaaccgatcgtgggtgcccgctgcgtgatctctatgtgatggatgcataaagtaaaggcaaagtgaattttagatacattcattaatattttaagcttaaagtccatacaattcaccggaaatatcccctgacctgaagttctggtttccctgcattccaaacaggacattttgttttgtctttgtctcggtaagtactgagtattgtgagaggaacaagtgagtgtcttctgtttctgattccccagagtctatatcttgcttggcacataggagatagcaaaaggaaacatctatgtcaattactgaatcgacacttccttggttcacaaacattggctgtcatcagcgtgacttcgacttacttgattcttttcgttttttgttttttgagacggagttttgctcttgttgcccaggctggagtgcagtggtgtgatctcggctgactgtagcctctgcctcccaggttcaagccattctcctgcgtcagcctcccgagtagctgggactacaggtgcgcgccgccataccgggcaaagtttttgcagttttagtagaggtggggtttcaccatgttggccaggatggtcttgatctcctgacctcgtgatccaccctcctcggccccccaaagtgctgggattacaggcgtgagccaccgcatctggccaaacgttcttatgaaaattctaagtccacctaagctaaggacaggagttatagcttacatgaattttaaaacaagatgcaccgatttgagtaagcaattactctcttgaaggagaaaagtcagaaagcataatgaaatcactaggacctaactggcatgtggaactattttctgcttatgaactatcaactttaatttcatttccagatggcatggtttcagctgttatacagtgtttataaatgttctaaatcaagggaatttgtatcaatctattagaataaaataaaatatttgagttcttaatttcctttaattaggataacctttttcttaaagtgaagagaatggttttattacatatttttcttcggaaaagataggctatattttctagcaattacgaatttgttatatatgatgatctggttcttggaacattcttgaatctagtgtctctaaggcaggtgtgtagagcaagaagtgaataacacagaaatcaatgatgaaagcattagaagacaattgagtttgtcagaactgtaaaatattgctgagtgtggattgctctgaaatctgaaaacatgacttgtgaattgcttatatccaaaatgcagacacaatgctgggtgttggtttacttgtttccggtttttcaaccctcttttctaagcaaaagatgtccaaactatacagacccacagaatctaacagatgtctttatattcctcctcctagaactctcagaggatccagcactgcagctggtcgtcactgggctgtgcctgtgtgcctggtcacggtgctgtggaacctgctcagcatcctggccgtcagccctgactcccacctccacacccccatgcacttcttcctctgcaacctgtccttgcctgacatcggtttcacctccaccacggtccccaagatgatcgtggacatccaatctcacagcagagtcatctcctatgcaggctgcctgactcagatgtctctctctgccatttttggaggcatggaagagagacatgctcctgagtgtgatggcctatgaccagtttgtagccatctgtcaccctctgtatcattcagccatcatgaacccgtgtttctgtggcttcctggttttgttgtctttttttttctcagtcttttagactcccagctgcaaaacttgatcgccttacaaatcacctgcttcaaggatgtggaaattcctaatttcttctgtgacccttctcaactcccccatcttgcatgttgtgacaccttcaccaataacattatcatgtatttccctgctgccatatttggttttcttcccatctcggggacccttttctcttactataaaattgtttcctccattctgagggtttcatcatcaggtgggagctataaagccttcgccacctgtggatctcacctgtcagttgtttgctgattttatggaacaggcgttggagggtacctcagttcagatgtgtcgtcttccctgagaaagcgtgcagtggcctcagtgatgtacacagtggtcacccccatgctgaatcccttgatctacagcctgagaaacagggatattaaaggtgtcctgtggcagccgtgcagccgcacggcagcacagtctcatctcaatatcttatctgttccattccttttgcaggatgggttaaaaaaggcagcaaggtcaaataagaatgacatcccagggtgaacacccactgtgatattacgagtaatacctccctaggatataaaaaacactgtcacagagtatacacatggggtacacccactgtgatattagaagcaatatctccctaaaatattatgaaaaatatcacagggtgtgcagactgtgtgatattaggagtcatatttgccctggttattacgactaatatcaagggtgtacacacacggggtaaacttactgtgatatcaggagttgtatctccctgggatattatgaataatatcacagggtatacactatgtgtgtacatccactgtaatatttgaagtaatatctctctatgagattacaaataatatcaaagtgtgtacacccctgtgacatattaggagtaacatccttctagggtattacagataacgtcacaaggtgtacaccttctgtgacattttgtgcaccctttgtgacattaaaagaaacaaccccctaggatattacgaataatgacacgggcggtttacacacatggtgtacacctcctgtgccatcaggggtaacattcccctaggatattacgaataatatcacagcaggtgaacacacatggtgtacaccccatgtgacattaggaggaacatgcccctagggtattaggaatagtatcacaggcgttgaatacgcatgatatacacccccggtgacattaaaagtaacatccccctaggatattaacaagaatatcacagggagtacaccccatgtgacattaggagtaacatcccccgaggatataacgaataatatcagagggtgtacacgcattgtgacattagtagtaacagcccgctatgatatgacgagtaatatcacagggtgtacaccacgtgtcacaattgtagtaacattcccctagaatattacgaataatatcacaggaggtacagcccctgtgattcacgagtaacatttctatagaatattacaagtcatatcactgtgtgactctgtgtacaccccatgtgacattgggagtaacatcccacaaaactattacgaataatatcacagggtgaacaccctctgtgacatgaggaataacgtagttttaggatattatgaatgatatgacaaggtgtacacaccctgtgatgttagaagcaacatccgtctaggatattaggaataatatcacagggaacacaccccctgtgacattaggatattacaaataatatcacaaggtgtacacgcattgtgacattagtaataatatccctctcatatactatgaataatatcacagggggtacatccctgtgacattaggagtaacatccccctagaatatgatgaataatattgcagggggtacacaccctgtgacttcaggagtatcaccgccctggaatatgaggaatactgtcccagggtattaaccccctgtgacctgaggagtaacatcccgctggaatattatgaataatatcacagtgtgtacaccaactgtgatattaggagttctatttatttttaggatattagggataatatcacagcagatatacacaaatagtgtgtacacctactgtggtattaaaagttatgtctccctagggtattgcgaataacatcacagtgggtgtacacccactgtgatatttgaagtaatatctccctaagatatgacaaaaaatatcaaagggtggaccccgtctgtgacatcaaaaataacatctcttgtggatattccgaataatatcactggggagtgtgtattggggaagggggcctgtggggagaaagtgtatgactgaaggcctggaaatgcccaaagccaatcccggcttcataggaagactgataactgatagtggatagaagggggatggagccttagggggaagatgtgttattatttctagtactgttgagacagggatcacccaaacgctggaacaggcagtactggtctgattggcaaatgtctatctcgccggaaggagaaatgggctactatgttttcttagctcctgactgcccgccataaggtcatgccctttctcttgaatccaattctgtacccatcaacttcttaaaattttacagtatagccttccagatagagagctacatgtccacaaacttacatattttacagggtctcaatataatttttaataatattgagaaatgtagaaaatcgttgcataagaacccatgtactgaccatccagttttgtttaaatatgtaggttagtaatcatctagtgattattaaaatcaccacagatcaagcctgtgcagtatctttaaatttgtcagccctggtattcgttgtcctcatgactttattataactgcattctgttcagcattttcttttttttcttttttctctttttttgagacagagtctcactcttgtcgcccaggctggaatgcagtggctcattgcaactgctgcctcctgggttcaagcaattctcctgcctcagcttcctgagtagctgggattacaggcgcctgccaccacgcccagctaatttttgtatttttagtagagacggggttttgccatgttggccaggctggtctcgttacctcaggtgatccgcccgcttcagcctcccaaagtgctggaattataggcgtgagccaccacctggccctgttcagcattttcttaaggtccttttcttctcatacaggtcttgtcttaaatatctgtggttagctctttcttggtgtggtttcagcaatcataaatcatgcaaagcctgttgtcttgccctcaggcacccaagtgacttctgaatctgaagaccaagatgacacctggtgtgtggtcttgtgagttttggctggttttctcttagtgttttaggtgctgtttctgttctaggatgaagagcatcttatgaccatttgtatctgttaagcaattcatcagtgattaacgtcctggtctggataatttatgagtcattcatgatggctgctggatgtcaggcagccagaaagaaaaagagaaaatttaactctattgactactttttttttgtcctaatacactacagatacagttaaagcccccacatacctctttctaatcccattctcgtcttcttctccagaggtaaattgctattctaaatttggtgtttatcatttccattgcatgttttttataccattaacgtgtatgtacccctaaaaatatatcctcgtgtattttaaatttttttattttatttatttatttattgagacggagtctcacactgtcacccaggctggagtgcagtggtgcaacctcggctcactgcaacctccgcctctcaggttcaagcgattctccttgcctcagcttcccaagtggctggcattacaggcgcccgccaccaagcccagctgatttttttgtatttttagtagagatggagtttcactatgttggcctcgaactcctgacctcgtgatccgcccgccttggcctcccaaagtactaggattacaggcataagccaccgcgcctggccttttaaatgttatataaatggtgtcttactattttgtatcttgctttatggctacaccgtgaggttttctcgtatgttcttttcactcacttattttcactgctgtctacgattccactgtatgactatgccactccactcccctgttgatgtttatttgtggttttcaccattacaaacaatgcctctcatgctccacaggtcctagtttctctagaagtcggatttcttattgatagggtatatgaattttacctaacattgttaaattgttttcttgagctgatgtgccagtttaccctttcaccaaccatgttaagagttcccccctctccatataattggtaatccttgatacagtcagacatttttctaacattaataaattggtgttttaatttatacatcagtttcttgtgagtttgtttattacatgcctatcacccttgctatagtttctggtcctgcagagctcagaatctggctgtgggtcatgtaaaaacgatgaagactaagctacagactggagaagtatctgcaaaccatatatccaatgaaagatgagtagaatctggaatatgtacatagccctcaactgtaaaaacaaaatccatttagatgatgggtaaaataccacagacacttcactgaatataagatggcaaataagcacttgaaaagatcttcaggctgggcacagtagctcacgcctataatcccaacactttgggaggccgaggtgggtggatcacctaaggtcaggagttcgagaccagcctggccaaaatggtgaaacccatctctattaaaaacacaaaaagttagctgggcatggtggcaggcgcctataagctccactacttgggagactgaggcaggagaatcgtcggaaccctggaggcggaggttgcagtgaaccaagattgtgccactgtactccagcctggttgacagagcaagactctgtctcagaaaacaaaacaaaaacaaaagatttttatcattagctgttagggaaatgcaaattgaaactacaatgaaacatccactactataatggctaaaataaaaaatagtgacaccaccaaatgaggaaaaggatgtggagaagctggattactcatgcattgctgatgggaatgtaaaagggtaggcactccggaagagtttcagtttttaaaaaactgaagcatgccattaccacataaccaagcaattgcactcctgggcatttatcccagagacatgaaaacttatcttcatagcagctttatttgtaatagccaccaaactggaaacaacccaagtgtccttcagtggatgaatggttaaataaacggtggtacatccataccatggaatactattcagcaataaaaaggaacagagtacatgcaaactagatgaatctccagagaattatgctgagtgaaaaaagccaaccccaaaaggttacataccatgattcaatttatgtaacattcttgaagtgagaaaattatacatgcggagatcagattagtggttgccagaggttaagggcaggggaaaaggagatgggatgaaagggcagtgggaaaagggcaacatgagggctccttatggtgatggaaatgctctgtattgttcatgtctcggtcatgctctggtactgtagttttgcaagctgttacccatgggggcaagtgggtaaaggggtacacggggtctctgtattatttcttataactccatattaacctacaagtatcttaaaatggtttttgtaagccaataattctgtaacttcttaataaaaggttaatgaacattaagaattaaagtaagaatttcaaatatcaatcagacaggtctgaaaaaaggcaatactagccttggcttttttttttttttttttttttttggtgagatagggtcttggtccgatgcccaggctggagtgtggttgtgtgatcatagctcactcactgcagcctcgatctcctgggctcaagtgatgccccacctcaaacttctgagtagctgggactacagggacgcaccaccatgcccagctaatttttttgatttttaccagagataaagtctatgttgtccaggctagtgtcgaactcctgggctcaatcaatcctcctgccttagcctcccaaaatgctgggagtataggcatgagccattgcaccttgcctagccttggcctctttttcttttttttgagacagtcttgctctgtcccccaggatgaagtgcaatggcgtgatctcggctcactgcaacctctgcctcccaaattcaagctattctcctgcctcagcctcctgagtagttgggattacagacgcctgccaccacgcccgtctaatttttgtatttttagtagagacagggtttcaccatgttggtcaggctggtctcgaactcctgacctcatgatccacccatctcggcctcccaaagcgctgggattacaggcgtgagccaccacgcccggccctggccttttaatttgggtctctttaggcagtccctttttctgattggctatttttgtcccaattcctctttgccccccacttgttccttctactttgggtaagaaaaatcattcatatttcttgtattattttcaagtcagcatgtttttgcgtgagggcctctcttatggaataagtgcatggacttttttttttttttgaaacagagtttcgctcttctcgcccaggctggagtgcaatggcacaatctcggctcactgcaacctctccctcccaggttctagtgattctcctgcctcagcctccccagtagctgggattacaggcctgcaccaccacgcccaactaatttttttttcatatttttagtagagatggggtttcaccatgtgggccaggctgggcatggactttttaataatgattagtaatctcggaaaatcttcttagttttagaggaagcactatctggagaaatgaaaataaggtcttgaattaaaatatctgattcggcaataagggttaagcttattttgtttgaacgtcaccaaacttgtgtatgtaaagtacaaggaaaatggctgagaaaaattcttccctttctaacaaagaagtcagcatggtaaagacagatatatttatttcatatgacagcacgtttcacaggatatgtacagaatgtctgtgtaccactgactttaatactgtacttctataaagtttatagttataaatattgtatgccacataagcaataaaattcttacatataaacagcaatctaatatagagaacacagagttcacaaagagatccttagtgtctaacttctgctctgcttttaacagaactagtaaatatttaataatacatagaataatggctagttatttgcagcatacctttaactttcataactttgtgcattttcagcaacttgccaagtataattttcctgataaaggctgggctgctgatatgtatattttagacagtagtttatattcaataggaaacattgctcacagatctgcaatttgcactagtgaagtttacctaacaatgaattattttgctaatggagagcaaataccatatacactagtcacatggatgttaaagccacagtttcaacaagttaattcacattttgaagcaactgcttatagtaatactgctgtttaagacgctactgctgaaatgattagaacctccaaaaagcacaatataaaactcacaagagttatttctaacagcaaatcttggctgttaacagagaagattacttctataaatatagtattttgataacatttgagcatttagaaaaatgctttttttctaatagatttgctttataagtgcagtgcagtttgctgtgcttttaacattctacatattcgtagccatgaacgctattttttgatattccctcaatgtacatctttaaaggttaagtgtggacataggaatttaggtggacatatacaactctttatataaaaggaatgttaatgtaagtcttaatgggtaaagatgattgtaactgaaactgacaaagaaacaactattgctcaaggagttttctgattggtttacttaatgatatcaaaatactacattctgtaaaaattctgtgtacttcttcaaaaaattaataaaagcgggatcagttgcatattggcagtgcaggagacaaaatccgcagctactttgaggtatagcctctaaaaacttaaagcagcatcatagatgtgttatgtagcctcgtaagaggggggagaacacacactgggtatattcccaattcaaagcactcaggggacagctgctttccctgctaaaagcaaagttccagagcaaaagcagcaaaaagaaaatatgggagggatatgggcaacgtatactcgaacgtacgcagagaagagagtacggttagctctaatatttctcattgaacttggtggtatgtgccttccctgcatataaggccatagtgcttttttgggagcgctagaatatccatccacttgacagtgaccacaaaataggctgtttccagctgcaagaacctcctcctggagaaaagcgtatgaaggtgctggagtgaaaagtaacaaggttgtgtgtatttgaaggggttgggtgtggaacggtagaaaattctgattctgtggtgagattattctagttttgaaaacaaaattaatgaaaggtccaaattacatttgcagccatctttttggtaatgtgatattgaaaaagggactttgttggaacttttaggtataatttggtctgagttatagcctagaaattaaagtatgaattgtaaaaatatgtaaatgtatacagaagtacatgtgtttgtatgtattatatatgtacacatacctatacttttttcctttaaagcaatgcctttcaaaactctgttcactgtaaccttggcagctctttggtaaatactcaaagataccaattgttaacaagtatgagagggctggtggaaatgtcagctgaaagttgggtgggctttttgagattcttcagaagactgaccgaaaagtttctgaataaggactgttttctaaagtataagtactttttatggctactactgtctcctattcatccaaagagaaatacatcaaaactccagttaacaatgagaagggtttttccttatttccaatatacacatagtccaactctgtacacatcaaatagtggtgttttgtgaagatatcagtgcacttacaatgacttattgcacataatgaaatactaatgcccaattctcttagctctatcctgccaaaagcaagtacccactgttttctattgcatggcgttatctttctgtaaagtccagtgtgggtgaagccttagaggccaaggtcgtgaaaggatctactggagggctggtgccgggcgggagcagagggacaggaggtggaggaggtcttcttgacggcaacacacagaaggagacatttgtacctttattccagtcatcattcaatgtcaggttggagccagaaaatgaacttggctgattacccagtaagtctgaacaagctgactttgacttccctttcacaccaaaatcctcttcttcctcgaaggttacccatcctttcgggttgctaatttttaatgtagactggccctgtagatcaaaactgtccttaaagccatcaagtgaagatgaagccctgcttttgttatgaccaagaggctgcagagaagggaaaggactgatagtaacgggctcttctttggagaaccatgaagttgcctctgattcttcagacttggctctaaatgggtttccaggagcagcagtcctgtcactgaaaggatttgtcctggtcaagccagtaataaatgggtttggagaacttcgcatattttcctgggattgactccgagctggaattggaggcattgttggcatgcaacttacagaactcaaaacattactttgcgttgcagaaggcaactgaatcaacctctttgggtctggggtgggaacaggtgacgtttgaacagatagctgagcctttgatacagcaagcagattaaatgacagatcttcaaatgggtcaatctttaatggtgattctcttttgccatcagagattccatttgtttttacctgcaaaagaaagggagcactgaaaaatcagtttatatttactcttaataccccctattcttcctgtctcaattattcttcccttttaggggcaagcatgtaaatttagaaactaaaaagtagctttgtgtagtttgttactccggtggtttaaataacatgaaacacctacagtctttaaaaacttctttctaaataaatcctttctaattaaatccatttttaaatccctcaaaatcaaagagcttatttcattcatgcaagttttgaaatggtaagaaggagaattgtacagaattaacaaatttgttcatgcccagttctatcacatttcagcatgaacttaagaaatccatacttataacttatgctaaatctatataaataaaattctaacacccatctatgatgatgatgtggtttcattgttcttttaagtgtgttttctaaaattaatgttactatggaaattcaattttatagataaaattaattctattagcatattttattcctaagacgaagactccatctttctgtcttctacttggaaaaataaattttgagagttctttgcccaccccctcttttttttttttttggagaccaagtcttgtgctgtcacccaggctggagtgcaatggcacgattttggctcactgcaacctccacctcccgggttcaagtgattcttgtgcctcagcctcttgagtagctgggactacaggcgtgtgccaccaggtctagctaattttttgtattttagtacagatggggtttcactatgttgcccaggctggtcacaaactcctgagtgcaggcaatctgcccaccttagcctcccaaagtgtcaggattacaggcgtgagccaccatgcccggcacagctgacttttaatgtaagctctcctttgttgaataaactgagtaatgtgaggctgggcgcggtggctcaagcctataatccctgcactttgtaaggctgaggcaggtggatcacctgaggtcaggagttccagaccagcctggccaacataatgaaacctgtctctactaaaaatacaaaaaattagctgggcatggtggtgcgcgcctataatcccagctactcaggaggctgaggaaggagaattgcttgaacctgggaggcagaggttgcagtgagctgagatcgcaccaccgcactccagcttgggcaagagcaaaactccgcctcaaaaaacaaaaaacaaaaactgagtaatgtgacaactttccataaaaaaattgaccctcctgtcttgtaaaaatattccaaaacagatacactattagtaaccaaatgcaaccattgcttaaaaccagaggaaaaaaagttccattttctatttggtttatgaagtctacaaccacaatgatgtgcctagagtggtgcctggtcccttctatgtgacagagttggctgtgaactgttatcagtaggaagagtgcttggaattccttcactcctgccctaaatcccttggtccctactccataaagaaggtggttggagtggagcacagccaagggactgagcaaagacaaatgatcggatgaaggaaaagaactatgattcttgcctcataagcaaattagcttatcaggcatacattattaattttgaaaaaaatgtatataattcttaaaactagggtagatgacttggacacttatgctaacttaagaaaacttcagggttggatacgatagggcaaaaaaaaattcagttcaagactggcaatgtaataaaatgagcactgcccaaaaggaatttggatagttgttaaagcaacataactatactttcatgaaatatattggaaaaaaacagcagcagtctcaataaaatgtaactgcatactatgaaacacttagttactgcttaagaatatggaaggatgttcacttgtaaaaggaaatggatgacttaagtgaataactttcaagtatctgttttattcaactatcctagaatatgctttataattggttgaaacagtatatttttcttcaaacttagtgtgataaatttgtacaaaactaaagagaaaacatgtcacagactttaaactgtactctaaatgtcttaggtaagtagacctatatgtggaaatgtacttaaaaggaaatttatatagatattataaaattaactctatattaccaaaaatctctggactatttatagttaatacaaaatgaaatacttctgtctgagacaaaattctcctatggcagatagaatcgtctgcaacacagacattataggaaaggagaattttgtgctctgccagcttagaacagaagtcacctgctgcatcagtgctatacatttaaacacctttatttgcatatataagaaaatttttatttcaaaataagttaatttgatagaatcaggatcatttttcccagacttgaaattacaatgacaaccacatcaccattcatcacattagaattaatttgtaatctaagcaggatttgtgatgacaatattaaaattggtgctatttttacagagaaaggtgttggaaggacctttagataatcttgttatactggtaactttcatctttctaaaccatcaattcttccttaccaataacaatcttgctactaaaaccatttgaaaaaatatttcccccaaatattttttcctaaaaaacatactgaattttgtgtttatgtaattacataaatgccattgttaaaaccaagaaccgatctggttttgccaaaaaggccttcatatacctaaatcttactttcttgaagttacactttttagttttgttaattttcataaaaaaatgaagcaaaaagtggtaaagcattagcaagaacaactacatggttcctaaaatccaaaatactaagaaaaagaaaaagcaggttttatggtatgatagaatttattaatggagacaggtggttttaaaaatgggtgaaactttagatgtatgaagcagagattcatacatctaatgtgttgagacggatgaaaacacatgtaagattgataaattgtcagatacctgttaccctgatggttgctcctgctttgagaaaggaaacagacatcaaaggaaagagttaggaggacaatccgagatcaaccagcaaccctaacaattcagtcaacaaaatgctttctaagttacagacagaacccaagagcagcaatatttgcaggttgtaacataaattcaaaagacaattccaattccttttataattttgttgaattagggtccagactttagttttgtctgaggttgattactaaccagttcagttttgttattccaaaaataatactccaaatgatttcagagttctaaaatattttaagcaacctgttatggactgaatatttgtgtgctctcccctcccaaattcatatgttgattccataagcccctgtgtgatggtatttggaggtggggccactaggaggtaattagagttagatgaggtcatgaaggtgggaccccatgatggaatcagtgtccttatgagaagagacaccagagagcgtgtgcaagggtgtgtgcatgctctcattccaggcaccacatgcaatgaggctgtgtgaacacacagtgagaaggtggctgtcagcacaccacaaagagtgccctcaccagaactcaaccatgctggcaccctgatctcagacttccagcctccaaaactgtgagaaaataaatttctgttgtgtaagccacccagtctatggtatttcatatgtcaacccaagcagactaagacacagccttaggatagcctagggatgtcattattagagaaaatggcaatgtaatggtacaaaatggtaccatttttggtacatactattttgcaaaaagactaccctactgaaaattagtactcatccagcttgttttatcttactcaaattttctgaaggatgatactcttaatatcattaatttacttcataatgtattagttggaaggtacaagaaacttgtaccttacaagaaatttggaatttacctttgtttaaaaatgaaatcataatccctctataatataccattattttttaaaatctagtatcctcaagcaagttttgaggtaaatcttctccaatatctaaacctattactaaatagcaaaactaattttgacaattcagagacatcacccagaaatatattaagtactttagaatttcctgcctagtaaacatgagactcttatttaacactcagagttttatgtatcagctctggcagtggacaggagatcaggaataggtttatactgagaggtacaaggttgctgtatcctccattaaatgggtctagaatgctgtgatttttctaccaggtctcacagtaacagtatagcagtgagttcggttcctttacttccagttgcatttccttatttctggctctcagctgataaagatgactaagatgctagaagtcagatagataagtgaggattttttatactttgtaaaggacgtataacatgttatataatcactcgaattaaatgaatctcttctatacaaaattataaagtcaaaggataaataataaaaagtaaaactgggtcatatacattatgttttaaataccttgtagatttggaataggataagtaaagacttgtaaaaattacaaatgttcaattctaaaactatttcatgtcattacaaaatatcaaacttgtcatatttaaaaatctcaccatcaggtttgaaaatcttgtaaattgttcaacttaacagctacttccaataatttaaaattttttttattatttttaaaataggcattattttacggttcaaaattcaaaaggtacaaaaagatagaaagactcctcctcacctgcctcctggcccccagcattgggcattccctggaggaaactgtaaccactttgtgatccctcacaatgacactctgcatgtaaacaagaccccaccctccaagaaagaaaagtgtgtctgtgtatctaatattaaggagtttgatatcaatgactgaggcaaaaagatacttcaggatttgaaacaaatatctttgtctttttgatgaactgacaaccatgagattcaagaacacaatctaagggggcacacacaaagcatgtgcccgtcggccaccaaatcgctatactcacttcaatgaaaaacataaaacaatggaaagttttctgagaaaatgatatgtgtcttagaatgattttataatgataactacaatctcagctaacagtttgcacctccggaagtttttcagagtactttatctacttttgtattggtctaaggacacttaaaccatcagagttttagtaattatggcacgcaactacaatgagatggatgccctaaaacagtcctagaaagctcagagtggctagttgaaaaagttttttgcccttcaattacattttaaaaactacaaaagagtatacaagaaaataagaaaaattcacgattcactaaaaatggattagcagaaaaaaaaaatcattatttgaaagagttctaccattattatatattttcaccatcctcaatttttcttttttcttttttttttttttttttttgagatggagtctcgctctgtcacccaggctggagtgcagtggtgcgatctcagctcactgcaacctccacctcgcaggttcaaccaattctcctgtctcagcctcctgagtagctgggactacaggcgcacaccaccatgcctgggtaatttttgtatttttacaaaacaaaagagacagggtttcaccatattggtcaggctggtcttgaattcctgacctcaggcgatcgacccgccatggcctcccaaagtgctgggattacaggcatgagccaccgctcccagacttcatcctcaattttctaaactaaaaaaatatagaattctttttggtattaaccagcttaagggaacatttatttttctgtattatatatccttcaacttttacaaatgtgacttaataaatgctaactgctaactttattcatattgtattgaatcatatttactttaatatctgttttcaccctgtagacacttaagaaactgctcacttctgccaactagctggacatacctatatatctgtaaaaataaatgtaaactattacttataaatgtgttaaagggacattgccaatacgtattatttctgtatttcagatctttccaaagtgtaaaagaagactttttatttatttattattatttttggaggtacagggtctcactgtgtcaccaggctggaatgcagtggagcgatcatggctcactgcagccttgatgtcctgggctcaagtaatcctcccacctcagactcccaagtagccaggaccacaggtgcatggcacaacacctggatagttctttaatttgtagagacaaggtttctctatgttgcccaggctggtcttgaacttgcaggctcaagggatctgcccacctcagccttccaaagtgttagggttcactcatctcacagttttttcaaaagagtttaatgagatacttttaaggaaagatcactttgaaaattcagagtaggctgggcatggtggctcacgcctgtaatcccagcactttgggagactgaggtgggcagattgcctgaggtcaggagttcaagaccagcctggctaacatggtgaaaccctgtctctaccaaaaatataaaaattagccgggcatggtggcaggcacctgtaatcccagctactcaggaggctgaggcaggagaatcgcttgaacccgggaggcggaggttgcagtgagcggagatcatgccacttcactccagcctgggagacagagcaagacttcgtcttaaaaaggaaaaaacaaacacacaaacaacaacaaaaaacccaaacatatatatatatatacacatatatatgtataataacaaatataaaaagaaaattaaaactcgtatttatttttacttcttataacaggcaataattaaaataggtatgttcaaagactaaatcatatgcatcaaagataatattttgtgtaacaaatgagacttacttgcggttgtgaggaagcttctgaaggcaagctatgggatgacctgcttcgaggtggtggttgtggtggggtttccaaatttggctgggggccagactgaggcataggtgctgccacagggacaagaggctcttgcaacctttgagcaggcgggggcaaagaagactgcggaggaaaagcagcctgaggcttcagtggttcaggaaggaaagttgaacctaaaaaaccagtggttgtcagatgttaggtatattctagaaaaccatgtttttttccttctttagtgaaatgttaggagaacattctagttatttcttcccccaataagtagcctcatttcttgtggtataatgaaggaaggatatagctatctgaatatatgttgtagaaggtgggagatgacagaaggaaaaagagaaaaatatacaacaaaaccagtacagtatttctaatatagtatctacctttcttttctctcaatttttaaaaatttttgatttttgagacagggtcttgttcttttgcccaggctggagtgcagtggtgtgatcacggcttaccacagtctcaacctcccaggctcaagtgatcctcccaccttagccgcccgagtagctgggaccacaggcatgtgccatcacccctggctaattttaagagtttttaatttttttacaggcgggtctcactatgttgcccaagctggtctcaaatttctgggctcaagtgatcctcctgcctcagcctcccaaagaggacctacctttcgacgtttctgatgttttgctttggctttcaggagtcagtcttccagcagatgcccgcgcgtggctctgtggggcactgataactccagcacgaggaggaatcgtctacagataggaaacataacacttgagacatttacttaccttccacaggtaaaattctgtgaaaacatttgcttttgcatctcatttactttcttctatggtattagtccctaatttgtcattttaagtgctctctacttgaagccattataatgatgaattttaaaatcttcctgtttacttctgactatttactatgtgccagacattatgttaattaagtactgtacaggcatttccatttcatcttcaaaatatccctcagaagtaggtattattttatcatctctattttaaattaagatgaagaaatatatacaacttgcccaaagccacacagaaagcagagccaggatccaaactcaggtctgactggctgcagggctagggttcttaaccatgtgcaatgctgtctttatggggaaaactgggatgattttaaaatatacaaggagatagagagatacatacctgagcaactaggagactttggggaaaaaacaccctgagatttgttttttttttggtttttttttgagatggagtctcactctgtggccagacgggagtgcagtggcacaatctctgctcactgcaacctctgcctcctgggttctggcactttcctgcctcagccttccgagtagctgggactacaggcgcccgccaccacacgcggctaattttttgtatttttagtacagatggggtttcaccatgttggccaggatggtctcgatctcctgacatcatgatccacccgcctcggcctcccaaagtgctgggaccacaggcgtgagccaccgtacctggtcaagatttgttttttaagagatggggtcttgctatgttgctccagctagacttgaactcctgggttcaagcgatctttccaatgtagtcccctgcgtagctgggactacaggtgcatgccactgccacccagccatatatattgcttttaaacacagaagtacaacttttgaatgactaactcaatattccgaattaaatacactgaaagactcatcagtgaaaaatattttttctattttcatatgtttgctgaaggatctaagctaacaatatttattttaagcaaaatatgaacttttaaactcacaaaaatcctgactttcttttcctatacttatggtattcaacagaatcaagaaagttcttgtgccaagtgtggtcatgggatcagtgaatggcaaatttccctttttttgaaaaaaggaggataaatatttgaagagtaatattacatataaaaaagaaccttcagattgttaagtggacagctacaacagaaaagacaaaaagcttctatcttcataggaagtggtttcctcagttctcacaatcttaataatcttaatttctaggtacagtaatagctctcagtttcctactcttcagatatgggcctctcagtagtcccagctcctactggactagcctaagtcactgattactggtttctatttgctctttctctctgttcttgattacctgttatagtccagagaaagttttcaaataataaaaaacctatgtgtataagagaacatataaacatacagaaaagacacattcatcaggtagggaaaaatcctgtaacaacatctactctcctatttctaatacctttacggaatatgatgaacctgatcaagaaaaaaaccaaaaagagaaaaaaacctttagaaccagttttactatactgaatttatcatttttttttctgaaatgtaattaaaatcctttttaatgaaggattactttatatcttcattaattactcaggtaaaatgataaaaagctgcccaaatccatcatttcctcatatactgagactcttaagatatttatttagtgaccataattgttttaagtgtatcacttttatccaaataatgaagtttgttatttttgaagagtatgttaaaataatgttagagtcggaagatcatcaagtgcaattccctcattttagagatgaggaaattgaggccttgaagggtcacatgatttctccaaggtaacaaaactgactagtagtaaacaggacttagaaccgagaccccttggccccaggcgaggttttacctaccggtctggctgtactgtatccagcaggtcctgggcctgcaagtcctgcttgaggtgaaggctgactgcgtcctggaacaaagacatcatatcatatatttaagtttaaaaaaataaacaagaaaccatgtacttatattccaagtgtctatttcacggtccagttttaagggtgaatagctacattcaagtgtttttacctatattatctttccttgttgttccagggcttttgggtgctttgaagcaagaagggaaaaaaaaattagttgtaagttaacaattaagcaatattgcataacatcagcttgctgttctgcttcattaccagcagaaatgggggcatgagatggtaacaaaacaaagcactttgctttgtataatgatgaagggtattatcagtcctgaatgaaatactccaaaagagagaaaaattacaatatttagatagacctttatgggagacaagtggtgactttagtttgatatctcactcatgggaccacttttagggtggcattccccatagaactctctcgtgaaccttgaaaacatacagtcagctgtgtgaatggtcacaagatgcggcactgctgccccttagagtctggcagacaagtggcttctgagcaacagacaggactgcatttgtcaaattacacaagaggctcctagtagcaatactttagggcttcacgctgtagatgtcactgtggataaggttatcttatgatgagatctttcggatttctataacaaaatcccatcattaagacagaagacaggcatatgttattaccaaatatctgccttatggaagacagtgttaaaaatatgttcaaactcattagaaaggtagctgaaggataaaatgaaataaattactcttggagccaaaaggagtaggagtgactatcaagggcagcatcttaaataaactctcctttttgtaaagaaattcaagtacaattgttataagaaatacatcagccttttaataactaaaatcataacaaatggcctctagtcttaaaggtcttttaaacaaatctggctcagtgctaatctataaaatagctatgttatctgaaatcaactacaaaatactatattcttggatctgaattaatagggtttaattataatcattaatttttaaaacttcagattagtaaagtacatttctaaatattttacttattctgaaaagaattttgaagacattcttaaacagtaatttcacaacctgggcatatataaactatatatgaaacagagtacaaacaacattaaggatctcagggaaattaaatggatatccattagaaactataggtgacatagaatgaagagaggaaaaaatacaaggtatacataaggaggggaaagagaagtttacagctggaccaagaaaagatttagtatgcctgcaaacactgcggggtggggaggtggggcgctgacactgagaaataaaatgagagaaccacttctataatgcaagagtcttgttaccttccatctctctcctagctaccccaggactgggaggggctccaatacctttttagagaaagaacagaaactatatattgttcagggcccacagcacagaatgaaaggcaggcacacaagacaatttccatagtaaactcacttttgcaaaaaggctcttttattgctttaaatttcttcaaagatatcaatacaaaccaaagtgactttagatgcttggcccaaatctgaatcctccctttactcaaacagaagagtagaaacaggatgacagttttctttttatgtatgcaattactaccagtagggaatttaaaaaatatgtttaatgaagacctttgctttaaaaatcatcttactccttatatccagagcaagtaaaaactctgatatttgatagtcaaaaggaaagaaatcataaatttctatgagactacgtaagtcttttgaagttagtttttgatgcattaattttaaaaactctaatgtactataatgacgtaaaggaattattgtttataggatgaaaaaacatgttgcaaacactacttacaaaagaattatgaaggggagcaatttttaaaattaagacagatttcactgtaatccactggcttgcctaacttttgacagattcattttaaatttattttctacaggatgttttcctaattaaagcagaagataagcaaaaattatcatggaaatttaaataaaagcaggagcttgaaaagggaaaaattaaatgttttctataaaagcaggagcttgaaaagggaaaaattaaatgttttctgtaggtcaatggagaaatgatcacttagctgtattcggcagaagctgtaatgctgaaataatttagctattcttatcacacgcagtcattaagatctacacacaggcaaagtcagtctgtagtaagacctgaattgctcagccatgtcactaggcaagctacaatagaaacagaccaggctacacatgcacagtgagccttagtaacactggatttgtaaaagttcttctgaggaattgtgaaaactcatctcatcttttcttgagatttagattaaataaacttgtcaaatgtataactccaactgagctctgtgagttttcatgtaaaccaaataaactatacttcaaacaaaaagtgaccctttgtgaataaaaatttccttatgaagaaaggaaaagaaaatcatacagttctttgctaatccaaaagcttttccactagaaaataaatgtatcactaatcagatacttgggaaatgttctgtatttactgtacctgaatgacttttaaaattaatataacttttgggtattaaatctttgtaaatgaatcgaccacatttattaaaaaaaaaattaggcctgatgaacaatcccagcctacctgggaaatgaaagcctttattagttttatttgtggattagttttaaactagaatgtcattcattttgacttttatcaaacaaatctaaaatgtctttcaggtgtaaaacattaatgaaccacgattcacacatgctaacaaatgtaaatggttacctccaaattcctttctagtgggtgcaggactcctagccccttatagttcataagaaaataggcagcagaaaggaaatgacattaaatacagaagtgaaatgtcaaagattgctatagtatccatgacatcaagtatcatgcaggaattacatattatctacgtactacaaaaactattattcaatgcatatgcttataattgaagtaacagcactatatttaatttaaaagaacattaaacaaatacatacaattgtacattaatacgtatgctctccagttttattatacttttacagaaattagtacattttaattattttatgcttataaatcatccagaaatgaggattttgaaaaaaattaaacctaattttacctaagaacagtttacatgcctaactagatcaaattagcaaaaacaaaataaacctctctggctggctggtgagaaggcagctaaaggcagctgtgaaaacaccttagaggaatctactctgcaaacactctaccttgtctgttgcgcctaccatgttctttagagaaaagctaagaaatagcaataatgatagaaaaaactgtaaaatccagaagctagagattggaaaacatgcaaaacattttaaaatagagtgaagaattttacatctagcagaaatggaaataaaaggttgtcacctgaaggcggaggaggtctctgtgggggagccgggcgtgtgggaggggcgaccgggcggggcggcggcggccgcttgggctccaagggctgggcggggtctttctgcggcagcggcgttgctggctgcgcgtcaataggagaacctaaaaagcgcacaggaggtaagaagatcagcttctaagtagctgttgacagaagggaacagtccttcatatatatgtgtaatgttctataaaatgtgcacaatggtgtaaagaaagggcatgtattttcagtatgaataacaaaagcagtctactattaaactgccctttggtaccatggcagcaataatgctacctctgtgctgacttcttacctaggcctcaggtgctgaaagctaatttactaagtggccctattgatatgcacaaagtattgtttgagttaagccattttgtagtctggccagtagagagaagaaaaagctcaaatagttaacgggttcataccatagaaaatcatcagttataagacatagacaaacctaaccacatagaaaaaagattaagaacaattgtcatctagtgacagttatagcaagtttcctttccattgagagcttatcatctacaagttttcctattctgtaccggagaaaacagggtgcactttatcacctaggtatgaaacttaaacgatgactctccaacatcaagcacattggccacaggaagccatacaaaactttcaaataaaatgcatactctgtgcactgggaggcccaggagttcttgacggtgctcggcttggtctgatgggaagggaaggtacaggaccctctgatattgtaggtgactggcagggactagttcggggtgaagagctgggggaagtaccaaggccggaacttgaagatggctggagatgctgaggaagaagttcctccacttcagcactatagtcatcaacatcacctaaggaaaagcaggcttgatcagagataactccattttaacttgctcagagatttttttcaccttaggttttaaaaagttaaaatacacaaaacaaatatgaacattatgtcattgcaaacacacatggattaagcatgaaggcatgtataaaaccacaattagtagaaatgcttgtttcagaagatgtaaaggtatctattgtctctgagcaataagatgtcaggtgaccaaccacttggagctggggtgacccaatgggctttcaatatgccccagagcagcttctccagtgcaagccaactcaagtttcctgctctccttccaaacctgtccactgtgctctgtggaactgccccactcccttgcctaacccaggtccagcctcagagtcaacaagctctcaggagccacacagtcttcccccagaaggctcctccctgcaaccctcaccccacaaagacccgctttgctttaattaagtaaacactggttctcccccagggtctcctcatctccacttacttctgggtaggaaagtgggcacaaggtaacccttgcaacctaactgccattccagaacattagtcttccaaccctgaacaaaaagtcctactgctctgaggctatgccatcaggaatttatgtaacatcctctacccccacttgctacagtcatctccaacgtccattcttccatttcctgaacccactcactgaggactaagcagagagcaagactgtaagtcaggtcccgcaccatctttctgcgtggcatcaaagtccatgtggacaactcgttcaatagcaaaatgccttggtcctatccttatggacattcgccttcactcctaaccctcacccctcagaactgcactcttctgaaataataaactcaaaagcttcactctgactttggcctcccagcttttcagttctctcccttggctactccttctcttttgatttcttcagaagccagggtttgatccctctaacttttacctccatctgattctgctttcttctgtacctaccttcagattctatggttcttcatctcaaacattaccctacttcactcttcttccattgcacgtgcttgacataaccccatccctgcactgattcccctgtttaatctttctgtgataacacttggattgctgactgcctctgctaaagaaaaccacccagtcctgacaactgcagtcacatttgaaattatgcttttcagtctcttctggcctaaagtgcctggcaattccatgatttgctggtttgctcttcccctcaccctttgctcttcaggagctttactgcaaaactccttaaccctcctgaaactgtgagctgtcccactcctgcagatcacttcaacacttcacagagaagagggaagtcttaagatgggaacccctacttcaacagcctgcccccaagctggagtctcattacatggttgtcacttgggtatctgaggatggaacaaatgggccccacccagcctaattttctcagtgacactgctctactattctgccttgcccttcccccaaaccatcagccctttctcctctacttttccattagcactgtgcattctcaagcctgtcccatccaaaaccaccaccctaggacctccaatcttcctagagcaattgccctcttctctttccccccaaactttcttaaagagttgtctacagacacttttctccacttcttcaccttccatccatatcaatttaccactatctgacttcatcacttctgagatcactctcatgaaatgtcaacaacagcttcccttcctgttattaaatcagaaggacacatttctgtcctcatttcttctcatctttctgtgttacaagacaccactgactactccccttccatgctccactttctttccttgatttttaagccatgaatttctcttggctctttgacatttctagaaacaattgccattgtttcttctcattttcttttcacgggcagccttcttctgtctatatttaaactctgtgtttccacatactcaatcccaggtctgtatttctccatattcgattcattctcttctgtctcgtcataatcctattggccaaagttatattaacaaatgcccatgctttgcaggctattagagctgccttgactccagagctctttcctgagcaccagactcatgtttgactgactccatgaacatctcaaattcaacatatccgaaacaaaattcatcttccatcccacacctacttctctctctgcatttcttttcttcatttactccctcacaaacatccctccataatccatttggatcctctttatccccacttagactgtgcacatgctttcttcttggatcactcctctatagcattaattccattctccctgagtctttggattctcaacttaaatttcaattcctctgggaaagcttgcccaatttcccaaatccaggttaagcaactttcccatgagctaccacaaaaccattcattatcacatttatgtcactttattataattgcctgcttacttacacgtaacacccaataagctatgagttctggaaaggcaagaaccacagctgtcgaatctccagcacccagctgtatctggcataaaggtactacataaatatgtgtggactgagtaaacaaatgaacagataatgtgaaaatgagataaccttgtaagacgttcaactcttaaatgtggtacctagctatacagggcattacaatattattataatctaaggtatgcattttaatgaaaaactggctagaatagcatattgtgttagaaaacaaatgcatttaaaaattttttcttttgataatgttgccatcaaacaaatgcatttttaaatcatgtttaaggaaattttcggcgtaattacttaaattcatttctgttcttagaatacccttttggaacttctacttttttacctcaactttaattattgggactaaaccatacaccaacaatactaatttgggtatttatccaataagaatataaattaacatttgtaaaggtcttaatatttgaatggaagaatggtaaatacatttaaagtatacgcaaaataaacacaatatgatgtgaaataaatttgttttgttttgttttgttttgagacagcctcgctctgttgcccaggctggagtgcagtggcacaatctcggctcactgcaacctctgcctcctgggttcatgcgattctcctgcctcagcctcctgagtagctgggattacaggcatgcaccaccacgcccagctaaattttgtacttttagtagagacagggtttcgccatgttggacaggctggtcttgaactcctggcctcaggcaatccaccctcctcagcctcccaaagtgctgtgattgcaggcatgagctgccgcacctggccaaaatacattctaattaatagtgctatgtacgtcccaagaagaagaagaaagatgaacttggaaaataagactttacagattggaagaaaacatatctagaactacaagaagtaaatgtgtttaagaaacaaaccttccatatcaaaatctgctgcaacctctgcatcttcaccaagcagggtagagcttgttgatgatggcaatgcaatgctaattttctctaaactcatttcttcttccaaatttttgatccagtctggactttttaaagcaatagttatagtccgattcaataactagcggagtaaaagagatataaaataaagattaacatgaaagctaactaatttggaataaagaggctgacttcgttaaactatgcaatggtatagacagttaatttagttagacaattcagctaactaaagaaatagttctttcacatatactaaatttcaaactagtttaaaggttgttcccagttctccctttaaacacctgtggtgataaataaagatcttttctaggatgcccagagatgcaagtttcctttgctacaaccactatgttttcctggccagatgtaaattcaccaacaactctgctacataactttatactttcttaattttgattcacagattaagtaattgttcccacgtgaaacaactacaaaagagacagcagaaaatctttaaaatgcatttcctgttcctgttcatttggtctttcctaacttggcatatggtcctaagagctgctatattgtcagctgctaagtgctaacctatacagttttagcatttcaaatgtcagaagaatattaagagaactgaacaccattttaaatcttcaacaaaaattaatcattctaaaaacagaatgacttctacctgtgaaactggcactctgccttctctataaatttgggtgacttttagactaaagtataatctaagacaaccaagacattataatcaaattatagcagatcgtgtcaatgtatttaaaaaatactctcaaaaaaacttgctgataacagcaagactctttggtcaaggacaaaatgtgcactagaaaggagttctcatttaaaacccatattcttataacaaacttgctttctaaatttaatctctctcccacatagtttcaatttcctttgtttgaagagtttcttaatgtgaacaagatgtgaatatttttggtatttgcaaatgaactgtgtagctgtgatcaatatgctgtgctgacagttggcacctttgtgggtacagatcttccttggctcaaagtgttactgatattagaattccttgaaggcataataatggagaggttgaaagttgctgaactgagtggcacagctgtgtttattagtaatttagcatccacactgagctttaaagtcagaatcctaagaattcataatcctttacttgccaagtagatatgagtactaaaatcaatccaatttcagaacttaacacgctttacaagtcatatattacttttcaaagtcaacaaaattcttttatattcatcaaaaaatactaacaagcattcttaaatacctatcaccataatggccaattaagatgtaattccttaggactatccccttggtagagaccagggccaaatgaaaaggaagaaatttagaagaccaaaaaaatattcaaaaagatacatagaggttcactggaatattggctttaataattaagaataggaaataatctagatgtctataggagtttggtttaataaatgtatatatttattcacaaaatgaaattaatgaagccattaaaaatgacatatttgtttaagatgtccctgacacagtcataagaggtagtaagaaaatagctttataacacggtttcaatttgtgtttgcgtatatgcatatcccatttgtgttaatgtgtttgtgtgtatataaaatcccatttgtatttacatatgtatatgctaatattaaggttaagagaaattacttcagaatggtagcattatgtgagtggtcttatttttaattcttttccatgtttcctgatacatgattttacatgagtatactagtattacatttaggaaaacaaacaaaactctacaaaacctatttcaaaagcaatacacacaaagaattttttttttttttttgagacagagtctcgctctgttgcccaggctggagtgcactggtgcaatctcggctcgctgcaacctctgccacccaggttcaagtgattctgctgcctcagtctcccaagcagctgggattacaggcgcccaccaccacgcctggctacttcttgtatttttagtagagacaggtttttgccatgttggccaggctggtctcaaactcctgacctcaggtgatccacctgtctcggcctcccaaagtgctgggattacaggcgtgagccaccgcacccagcctaatacatacaaagaattttttttctccaaagaagttgatgtgacagaagaagcagctcaggacagtgctcacagagttgctcagtgctgcaggaatcaggcctagagtacaatccatcttgtgcactgactatatacttagaaatttaggatttgggtctaaaggagttcagaaaaaaatgacagatgaagcacttcagagaagtaaaactattccaggccaacaatgtaagtttccgtcatcaatgacttttcaaatcacaggttaggaatatctccatttgttaaaaatttctaaaatacttcaatgggatggatctgttatctctggaaattaatttagttatgtttgaagaagataactaggtaagccaagccaatgaaacaaattcctaggaataatgagcacctctctcccttgttttctggtacataatgcattttcttcacttgatagaatgtttttctactatacagataagccagactacccccaattaaaactttaaaactttttgcatcataaaatgtaataaatcaaattaggtgctaaacatgtttccttcttagtctatatcaacagttaatatctctggggaggggccaaaataagcctaggctagtcagaaatccagtctaaataaaaaacattaaataactcctcgaacataccataaggtcttttcccctcccatttagataatcttgctgcatgtctataaaaatatcataccatcttcagacatttaatttcagaatggtttagaatcaacaaatgctaccttacctctttaccatttaggctcagaacattcaaggcagagcttccctccaaaaatgtaacccacattttatcttctacaaatctttaagaaaaacaataaaaaaccataattaataccatagacataacaagctcagtgactactcccatgattattgatcattaacaagggccacaagaggccaggaagtaaaaagtaaaggagggagcgcaggtagggctggtggtgacctggagagggcactcttcccctaaaaacactctaactccaatttcaaatactatgttaatggaacagccacaagaaatgagtctgtgcacctccatttgtgatcactgctaatccagtcccatccaatcctccatttcattgacaaggcaaaaagggacagaggttaagtgacttgttcaaagtgactctataaggagaatatgttacagggctgggatccaagtctccggaccccacaacccagtactatgtattttcactgtctcagtgacttccctgaagaaaatttcctatgatcaaaaaagatgagagttgccagtgaaagaaaacaaaaccagactggccccaagaagccttagataagttatgctccttgtctttcatcattgacaaacatttactcttttgggacttcaatggtctttgataggattccaagtttttacttttgaaataaaaaaactatcaagaggaaaaaaaaaataaaaaggacagaagaagttctgaagagggtcgcaggtatgtaatgaagttattattcaaaaaagaacaaattatgatgttatcagtcttattacagaaaatttggcgagttaaaccacaagttcagaaatctttacagatttttccacaatgagaggaaaacatgtacacacaaacacacacacacacacagagtatcactctccccctaaccccctacttaaactaggattccaaagtatgaattatgaatattaagaggaaaaggccaaaacaaaagtgtgcataagtacttcaccctggtaaaatcaagggcctggagggaaccgatttctacaatcccacagatatgaccaaggcaactgactcaatttctttggcataaaactaaattgcaggatgctatcctttgaaatacacagggagaccattcttacctaactacacgaaggtatctttttcagattgttggcaatggagactatccctcctccaaaggttataatcaccactgtaagcatacatttatgctgcaccagtcccctaagaccccaaacattatttgttctttgataggtaccaacacttttgtggtcctgggttagggctaatatctttgtccttattctcaatcagcaatgtgccccttacacatttctaactttaacaagggattctggttcttatatctattgatttatgtaagttcttttggaagctatattttcttcctgctttcactcactacagtaaaagcttctagactcttccttcaattaatgtaagcatctatatgtatttaaatttatcccatacacatttccagggaacctcttatttaaaaataaaggggttcacagggtttactcactccttaatggctgtcttaatctagactaaaaggtaataatcagtttcttctcactacttatagagatcctctccttgttgactttcagtgtttgctttttctcttccaacttagtcatcttggggtttaacaaccaatattccaggttggagacaccccatggttttataatgttaggttaatgccttagtttcttaccaatacttttcctaatgatgacaaacatttgtgggaaaccttctggcttcaatttaacaagttctttagaggttgggttataaagacaggtccctttcctgtatcagagtctttcatcccttatacagtttggattctttgtagctcagtgcagtattttacatttgctcaggaagacatttatctgctactctgctgcccactcacacagtctacatgatgcttctggtggtttggcatttctgtacttggcaaagtatactgtcatctgtacacttgcagatttcactgtgtactttcaagaaccttaagatttttgaaatgttttgttttgtttaatttgaaagctttgggatagacctttgtcaaaagatttgaggaaagtctaaacacaatttcttctccatttgttcatttactctctgaaaggacttgaggtgtctttgattttcactctgtagaagccataccatcttaattctgtggactacgccctttaggatctgggggtgtcattacacacatgctgactttccctactagattacaagcaggagttgtatcttccatttctcctctgctcttctacagcaactagtatagagatctgcccaccaaatatctatcaaacatacctaactaagcaaatgaatggtatttaaagggatttaatggtacctctttccctatgaaatccaaacacatgcacacatgcacatcattcagtctctcaaaactgctgtatagttggaagagaacatttttaaaacaaggaaacaggcatctggttctgcaaaaggcagatggctagatcaatgagggaaaccaagactagaaggaatgactcttgactagtcatcacatctctgttagaaattaaacatacttaaaattactcaaatttctttaactgaggcagggagggagtcattcttatctctccttaaaaaaaaatagcaatcacagcttcattttgttatagggttttgttacatgttctattgtataggaatcgtgagagttcatatctgaacttgcacctatttttgttttcaattgttcacataaagtttcactgtttagctgggtatggtggctcacgcctgtaatcccagcactttgtggggctgagctgggcagatcgcttaaggccaggggtttgagaccagcctgggcaacatggtgaaaccctgcctctacaaaaacaaaacaaaacaaaacaaaacttagccaggtgtggtggtgtgcacttgcagacccagctatttgggaggctgaggtgggagaattgcttgagcctgggtggttggggctgcagtgagacatgaacacatgactgcattccagcctgggtgactgggtgagaccctgtcttaaaaaaaaagtttcactattcatttaaactttctaagttgagaattcagttataaaaacctacagaataatatccacagtatgatcttgctttagtttggaaataaaaatactcatatactaaacactaaataaggtggtatctttcttttttaaaattctctccttccccaaataaggtgatttctatatagaaatgattgtttatgaatcacaagctacttttgcataataaacatcttaccttataagtataacttcaccaaaacttgcaaactgctgcagaagctcatcaatcaaggcatcatcaaaaaaattattttctggtaaagaacttttgattgagaccaatactgtaccatctggtggaccctgaactgcaattacttctttataaatgttttgcctctcttcagcttcaacttcaaatatatctatatcaatcagggcaacgacaggccttaaggcataaaggaagatagatgtattagaaatgtttttaaaagggtgtatttcaaacaaatttcaaacactattagaaaaactgagactgcttaaacctgtggtcagaagtcttcagctcagctcttccatagtgcagcaaagtgcctggagtccacgtgtacagaattttgctttcatcttgaaaactagcatttagaagatctagatcttcagctgcagtcagaagaaatgaaaacacaagagaagctgtataagcaggacagatcgtgtagagcaaagaggcattctccttcctttcatgagcttcagtggtttgaggctggaatgccagaaacacttggtaataggcaggcagtctaaatacctttaaattcgaaaggttttggtaaagttatcattttatgctttatttagtaaaaattaagatctggctttatttccaagattacttaaaggactgggactaaatggtgtttcataaacaattcaagagacaagtggcagttcaaaacatatgcaaaccactaaagttagcttaaaaacctaaattagcttcaattaaaaatttcacaaaaatatttccttgcttctctttacatgaaattatatgaaaataggctgaaaaattaaataagttattataaacagatctgatatttctaaaaatctgacatatttaaattttatttattctattccagttaatgtttcttgaaaaacaatattctcctcatttgatattatgtcattccctgcttcctcataagtttacattagttcatttaaataaagaagcccatttcccaacctgatctatcaaaaggccatttcctccttctccaaaggacacggtctgtccaggcaggggtgcggcacttttcactggtgtcatagtcgtcagaaaacaagtcatacttatatgtcggagcaaaggttacctttccttctaaaaatcctctaaaaacctaaaataaacatatacaaagtaagttattcccaaacagcaacaagttctgttttcattcagacagtcatccattaaatgtctattacatgctggatgctctcagaagaaatctgtatgcgtctgatgaacacttctagctgaatggaacaaagcttagaaaaataacctgagacatagcatttttcatacccatagggacaggagacagggaaattctgggcagaagtgggtgggtccctttgctgggtcccaccctcaagccaaaaagtctgttaccacagccccaaatgagaacttatatccctgttttctcgctcgaatgttgctttttccaaaaccacccatggcctgccttgcccccaatcctgtgcccataaaaaccccaggctcagctggcagagagaggagaggcagctggatgtcagagagaagcagcttgacttcaaagggacagcttggcagcacagttttggagaggagtctggccatgggatggctggatttcaggggaagattatcttattgctctgtccccttttcagctccccttcctgccaagagccattttcatcggcaataaaataccccatatttaccatcttcaattcgttcatgtgacctcattcctcctggacaccagataagaactcgggtgccatgagtgtgggagcataaggctgtcgcactgaccccccactaagctgttaacacttaagccatctgcaggcagcagagctaaaacagcactgtaacactttctgtggggcttcaggggttggaggcaccctcccctagacactgccacgggcctggtacaaagttcgctcttgccggtgcccaaaagcgctcaccccagctcctgcactcacttaccagaactccccctcctacaggggtggagtgcagtgggtcaagtgagcagagttcgccccgccagtgcccatgcactccagttcccacctgcgaagcagtcagggaaatatcctgcttcaataccacttgtttgacatttgattaaactaactacatgaataagggaattctgcctgatctttgagctatatgagacatttggaactgtaaatgggattctggaaacatctagcctgatatcttattctcaatgaggtgctgaggcctgaaaaggtaatgtggtgcccaaagattcaagtctggtgatcaccaggcaccataccagatggccactgatccttttacctaaaaaaaaaaaaaaatttaataaattcttcccaaattttgtggtcataagctttaagaagtgtttcaaaagtcagatgacatagaaacaaaagaaaagtcaataaccacaggacttaacccaaaaaaaaaacagccctaaagatgaagattctaaactatcaccaaggaaaaaaaagtttatccttctatttgaaagtgaatcttatagatacataatatatttttctttatgggaattattatgggttttctctttcctatttttattacttttaagggaggacaccaccccacatattgtcttatgcccaatttctgcctccaaagaaagaagaagtaaaaactaaaaggcagaaatggaagccacaagcagatagcccagcactgcgccctgggcctggtggttaaaaatcaacccctgacctaactgtttgtgttacctatagatttcaggcctgtatggaaaagcatcatgaaaatccctgtcctgttctgttctgattactggtgcatgcagcccccagtcacataccccctgcttgctcaattgatcatgaccctatcacgcggacccccttggagttgtaagcccttaaaagggacaggaattgctcactcggggagctcagtttttggagacgcaagtctgccgatgctcccagctgaataaagccctttccttctacaactcggtgtctgaggggttcttgtctgaggctcgtcctgctacatttcttggttccccgaccgggaagtgaggtgattaacggatggtcaaggcagccccttaggtggcttaggcctgccctgtggcacatccctgtgggggactccggccagcttgagcaatgcggatcctgagagcacttccgggtaggtaattgccccggtcgaacgcctcaccacagcagcgcatggcaggcccccatgagttaaaggaaaaacttatgttggccccagccctaggactaccagatttgacaaacccctttacactctatgtgtcagaaagataaaaaatggcagttggagttttaacccagactgtgcggctctggccaaggccagtggcctatctctcaaaacaactagatggggtttccaaaggctggcccccatgtctaagggccctggcagcaatggccctgttagcacaagaagcagataaactaacccttgggcaaaacctgaatataaaggccttccatactgtggtaactttgatgaataccaaaggacatcattggctaacaaatgctagattaaccaagtaccaaagcttgctatgtgaaaatccccgcataatcactgacgtctgtaacaccctaaatcccgccaccctgctcccagtatcagagagcctggtcaagcataactgtgtagacatgttggactcagtttattctagcagacctgaccttcgggaccagccatgggcatcagcagactgggagttatacatggacgggagcaacttcatcaatccacatggagaaagatgtgcaggatatgcggtggtaactttgaacgctgtcattgaagccaaaccattgccacagggcacttcagcccagaaggctgagctcattgctttaactcgggctctagaactcagtgaaggtaagactgtaaacatctacactgactcttgatatgcctttctaaccctccaagtgcatggagcattatataaggaaaagggcctgttaaactctaggggaaaggacataaaatatcaacaagaaattctacaattattagaggcagtgtggaaacctcagaaggtggcagtcatgcactgcaggggacaccagcgagcctccacctcagtggccttaggaaactcccaaactgactcagaagctcgaaaagcagcatctaccccttactgtgcatcagtagcagcccccttactccctcaaacacctgacctggtacctacctattctaaggaagaaaaagactttttccacacagaagtggggcaagtaataaaagaaggatggatcagactgccagatgggaaggtagctgtgccacagttgctgagagccacagtcgtactggccatgcatgaaaccactcttctaggtcaagagtcacttgaaaagttgttaggccggtacttctacatctcacacttgccagcccttgccaaagcagtagcacaatggtgtgttacttgctgacagcgcaatgtgaggcaaggccccacggttccacccagcatacaagcttatggagcggctccttttgagggtcttcaggtggatttcacagaaatgccaaaatgtgaaggtaacaagtatttgctggttcttgtgtgtacttactctgggtgggtggaggcttatccaacacaaactgaaaaggcctacgaagtaacccgtgtgcttctccgagatcttattcctaggtttggactgcccttacgaattggctcacataacgggccggtgtttgtggctgacttggtacagaagacagcaaaggcattaggaatcacttggaaactacatgccgcctactgacctcagagttctggaaaggtggagcgaatgaatcagactatcaaaaatagtttagggaaagtatgtcaggaaacaggattaaaatggatacaggcccttcctatggtattgtttaaaattagatgcatcccttctaacaggatactccccttatgaaatactgtatcataggcctcctcctatactagggggacttccaggcactccccgagagttaggtgaaattgagttacagtgacagctacgggctttgggaaaaattacacaaacaatctcaacttgggtaaatgagaggtgtcccgtcagcttattctccccagttcaccctttctctccaagtgatcgcatgtggatcaaggactggaacgtagtccctttgcggccacagtggaaaagacctcacaccatcatcctgaccacccccacggctgtaaaggagaaggaatcccagcctggatccaccacagccgtgtgaaacctgcagctgctgaaacttgggaggcaaaaccgagcccagacaactcctgaaagtgactctgaggaggatgacaagccctgctccagtcacacccggaagctgactggtctacgcacggccgaggcatgaggagaatcatcgtgggactcattttccttataatttggacttgtatagtaaaaacttccactgattttccctgcatagaagactgctctcagtgtatacatcaggttactgaggtagggtaacaagttaaaacaatctttctgttctatagttactatgaatgcctaggaactttaaaaggaacgtgtttatataatgacactcagtacgaggtatgtagcctaggaaacgactgcccagatgtgtgttatgatccctctgtggcctcccaggtccacagtttttgaagtaagattaaggactgaagactgatggggacttgtaaatgatacaagtattagccaaaacagaagaaaaaggggtgcccaaacgcataatcttgaaatttgatgcctgtgctgtcattaagagcaataagttaggaaggggtgtggcttttgattgggaaaaaggctatatgaccaaaaataagtatatttgtcatgaattaggactgtgtggaaatcaatgtggatactggtgtcatttgggccacttggataaaaaatgaaaaggatccagtgcagcttcagaaaggaaaaagtggcccttcctgtactaagggacaatgtaaccccttagagctagtaataaccaatccccttgatcctcgctggaaaaaaggggagcgtgtgaccttaggaatcaatggggctggactggatcctcgagtaaatatcttagttcgaggagaagtttacaaacactctcctgagccagtgcttcaaactttctatgatgaactaaatgtgccagtaccagaaattccaggaaaaacaagaaatttgtttttgcaattagccaagcatgtagcctagtctctcaatgttgcttcacattatgtatgtggaggaactgtaatgggagatcaatggccacgagaagcccgagaattagtacctacagacccagttcctgatgaattcccagctcaaaagaatcaccctgataatttctgggtcctaaaaacctcaattattggacaatattgcatagctggagaaggaaaagaattcactcaccccgtaggatgacttagttgtctgggacagaaactgtataatggtaccacaaaaacagtcacttggtggagttcaaatcacacagaaaggaatccatttagtaaattcccaaagttgcaaaccgtgtggacccatccggagtcccaccaggactggacagcccccactggattatactgtatatgtgggcatagagcttgtgccaaattatccaaccagtggacaggtagttgtgttattggcactattaaaccatctttcttcctactgcccataaagacaggcaaactcctgggtttccctgtctatgctgcccgagaaaagagaagcatagctataggaaattggaaagatgatgaatggccccctgagagaatcatacaatattacagacctgctacttgggcacaagatggctcgtggggatactggacccccatttacatgctcaaccgaatcatacggttacaagctgtcttagaaataatcactaataaaactggcagagccttgactatactgccctggcaagagtctcagatgagaaatgctatctatcaaaatagattggctctcgactacttgctagcagctgaaggtgggggtctgtgggaaatttaaccttactaattgctgtctatacacagatgatgaagggcaagtagttgaagacataattagagatatgacaaaactgacacatgtgcctgtgcaagtgtggcatggatttgatccgggggccatgtttgaaaaatggttcccagtgctaggaggatttaaaactcttataataggagttataatagtaataggaacctgcttactgctcccttgtttgctacttgtacttcttcaaatgataaaaagcttcatcactaccttagctcaccaaaatgcttcagcgcaagtgtaccatatgaatcactatcaatctgtcttgcaagaagacatgggtaatgaggatgaaagtgagaactcccattaatgagtgaagttctcaaaggggggaataagggaggagaccacccctcatattgtcttatgcccaatttctgcctccaaagaaagaagtgaaaactaaaaggcagaaatggaatcacaggcagatagcccagcactgtgccctgggcctggtagttaaaaatcaacccttgacctaaccgcttgtgctatctatagatttcagacattgtatggaaaagcatcgtgaaaatccctgtcctgttccattctgattaccagtgcatgcagcccccagtcccataccccctgcttgctcaatcgatcacgaccctctcacatggactcccttagagctgtaagcccttaaaagggacaggaattgctcactcggggagctcggtttttggagacgtgagtccgctgctgctcccagctgaataaagccctttccttctacaacttggtgtctgaagggttcttgtctgcagctcatcctgctacactttaaggaaagataattctattatctgtttacctacagatgcatatttaagtacaaaaagaccccaagaaaattttaaaacatcttgatttaaaaaggcatgtttcacgacccaaaatcttaatgcaagtattttctcaagtatagatatacctgtccagcatttttctgattgataagttgatctcctgctataagagaatcccaattttgctgtcttatgagctctttaacttcttcgttagggagatcgattcgatagttgaaatcaccacaccaaaatacatagtcatgggaaaatagcatccttccctgaaagcaatgagatagaattttaaattcaaaacaatcaatgttcaaaaatgttttacaactatttctttgcctgagatatgcttgtctcctcccatgtcctgtttctttgacccaacagtaataacacatgtgaaacgaaaataaatctcaggaccccaaaatcactaagcccagagaaaaatcaagccaggaactatgacaggtaaacctgcctcccattttactcctaaataagatagctccaaagataagaagctacataactccctcacaatttgcccacaggaaattccttgtggacaaagtatagactgaactcaaagtcatccctctgagactcacctgagacaaatgcacatctgactgcttcctctgccctattgtttatgcaaaaatgcagattcactgagccacactaaattgtgtattcagtggaaggctgatctaggacttaaaagaatgcaaccttttgcgtcttatctacttctaacctggaagcccccacttcgagttgtcctgccttaccagaccaaaccagtgtacatcatacacatactgactgatgtctcaggtctccctaaaatgtataaaagcaaactgtacccccgaccaccttgggcacatgtcattctgaattctggaggctatatcatggccacatccttaaccttggcaaaataaactttctaaattgactgagccctgtctcagatattttgggttaatactcatgaaatatctatttaggtgaatattcttaatgtttctaggaactatcttaaatttccaaaaacattgatgtagaatttggggcaaattaaaatatatttcaaagctttatcttcaagaacaagcagcaagagcttaccataggaaaactcaattttcgtgctatttctataaaatcttcatttctttctttgacttgtgactgccctgcagcaaagtggctacagacgaagcaaaggctggttgtatggaagagcattcggattgcaactgctcccttatttccagttgcacctcccattccagtcttcacagtatcaactgcaacatccctttgaaacaaagaattctaaatcgcagatttgaaatttcaagagttccatgtgcataggaaatgaggaatatacataatcatttaagtacacatggtatggtactttgagggcaagcctttgaaatagtacagtgaagctattggtgagtctttaatcaaaacccccaaaaccccattttaaaacaagaactatggatagtttttgtttgaagaactgaaacaataaacattctaggcttttttcttgttatttaatggtaggaagtagccttagaggagtgttctgtttactgacctgataaaaggagcatgctgtggtctgataaaaacaaacaaacagacgcccaccaactgttcagaagccagcagcacatacttgttgtctctggagattgtcttctgaagttctacagcccagagcttctgatttgttgtgctacaagaaaatattaaaaagagaattttttaaaaaggtattgacaatagcctattttatgacaattgtcaattatacctttatctacccaaatatcctaagactctgaaggaagcttaggctgtttttgtttcctttaaaaaggaaaatctacaatttagccaaaagaaaaccacatttcaaaatctaatctattacttctttacaaagaaaatataaagacattaaatggctactcactgggtgagtaaattcaaacttatacattttactttttccttaagtattcattaagatcacagagaagtatagaagtatctgtgggagattggtttcaggacctcccatgataccaaaatccaaggatactcaagtcccttacataaaatggagtaatacttgcatataacccatgtaaatctctcgtatactttaaatcatctctagattacctataatacctaatacaatgtaattagttgttatattgtaatgtttagggaataacgatacaaaaaagtctgcaagtaaaaaagacaaaaaaaaaaaggctacacatgttcagtatagacacaattttaaaaaatatttaatattttgatgagttgaatccaaagatgtcagacccatggataaggacagctaactgtgcacatatatgtgactatatgtgcttccaaatacatttccccacttttcaaaatttttctaaattataactaatgtctttttaaaaaatcttgctatgggaaattagaagacataatcattaaacaaaccaccatatacccatttcaaaattaccaacattttgccaatctattttttccatcctcttcaccttatcacatttaaacattaataattccttaatatcatctaatagtttatacttaaagttccccatttattaaaaaaaaatcttctaacagttggtttgtttctttaaaaagggtccaaacaaggtctacatattgcatttgcttgtcatgtctcctaatctctctttttttcttgagatggggtctcactctgtcacccagggctggagtgctgtggcaggatgtcggttcactgcaacctctgcctgagctcaagcgatcctcccacctcagccccgcaagtagctgaaactcattcctcatcttctcaatgaaccttatcttgatcattcatttgagacttccaacacttccctgtgtccctatagttgatctccttttcctctcttttccattgcacttttctaacatgctgtataatttacttattgttgttattgttcactgtccgtttcttcccactagaatacgaagtccatgaagatagggatttttgtctgtttgattcattggaggtacttaagagtggtactcagtaggtactgcttaaataaatgaataaatattcactactttattaaagaagaatatatatgtgtgtgtgtgtgtgtgtgtgtgtgtgtgtgtgtgtgtgcatgtgtgtatatatatatacatatacatatttgagacagagtcttgctctgtcactcaggccggagtgcggtggtgcgatctccactcactgcaacctccgtctcccaggttcaagcgattctccctgcctcagcctcctgagtagctgggattacaggcacggggcaccacgtccagctgatttttttgtatttttagtagagatagggtttcactatattggccaggctggtctcaaactcctgacctcaagtgatccacctgccttggcctcccaaagcattgggattacaggcatgagccaccacacccagcctaaagaatttgattaaacctagcctaaagaagaatttgattaaactctatttagacaaacaattgatccatgcacttagtactaggaaccctcagagttatagtctagtttaggacctgaatatatttttcaggaaacataatcaaacaacaaaatgggtgaagttgatttctttccaattttcctgatgtgaattgtttttcattttgcctaataaaatatttgtcacttgcaagattgatgactatttcagcctataattttctcctaaaaatctttaaaaatgtcataaaagatgggaaactgctgaaatttaaaagcaagcatactttgttaaaataaaacactgaagttttaagcctcactcatataatttgtatttataatatggattcagaacagcgttcccaaagtgtgatctggagacatctttgagggttcccaaagcccatggggtcacaactattttcatcatactattaagacatctttcactgtgttgactaacatttgcactgatggtgcaaaagcaacaatgggtaaaagtgctggtgctttcactcgaatttaggcaccaaactatactagtcatcattacaatccccactgccatatacttgcaggaaaaaaaaaatgccacttcgcctaagaatgtccttgatgaagcaacagacattattgattttattaaagctcaacccaggtcacatctttttaatattctgtgtgatacacaggaaatacatacaaagcacttgtgttgcatactgacttatgatctgtaacaaaaaaagaaaatgctttaaattgtgagtcaaactgccactttttttttggaatacaattttcccttaaaagaactaatgacagacggtggttattcagatttaggttatgtggcatttttttcaactaagcctgtctctttaagaaaaacaaccaagagcatttgttttcaatggaaaaacttgcgttttcaggcaaaaattagtattctggaaaacttgtatctgctaccatgatccttacagcttcccaacaattattttctgatgcagttaccaatgctggtaattaaccaatatgatgctttgatattatataatgaaatgtgttaaaatttggaagtgctacataacttagggaacccaagtgaccaatacatgatgttacaaaatcacgcaaaggtaaaagatgaattttagataatagagcagaaaaagttcatcaatatggtttcagattccattttgcaactaacctttaggacactaccatttggtatagtgtcttatccacacactacaccaagataatacttctctgttatctatactacagcagagaataaattatctgttttggtgtagtatcagagaagaaattatctagaaaggttattaaaatatttccttttcaaactacatagttatgtgatttttcttcatatacttcaatcaaaacaacatactgcagcagactgacacagaagtagatgtaagaatctggctgtcttaaactagacattaaagagatttggaaaactacaagacagtgccacccttctcagtaaattttttgttttgaaaaagttatttttcaaaaaatttattttaagttagcatgtaataggtttattattgtttttaagtgaattaaatgtttttaaattttcatttttaattcctaatataacaaagatataaacaacattagcaaaagttatttaacattctcaatatttttaagtgtgcagagagatcctcagacccaaaagtatgagaaatgctcttttacagttttacgagcacccttccatttattatttcaaactatccttgtaacaattacttaattatctgtcctccatagtttccctcaactggcaaatttttcagtggattaatgtggctagcttaccttgcactcacaatgtttccagcattcaattctaccatttcttcaaaaccaattgcaaatatatcagttggcttacttcttttatctaaaattaagcatccaagaaatacttttaaatatagcctcaggcaaatagcaaccccatccaacacaacataacaccaggtctcataaagactgatttctgtgttttgagtttaaccaaattcatattaaaggcaaacactcttgagtggaatgaaattattaaaatttactttctattagggtgtcctaagtttgcttctttaagacggttatccttgaagattcttaagccctttcagaattcactttgaaaaaactcttgctaaagtttttaccagggacagcacagaaacaaatcatttctcaaatcaaaatctcacataaaactggagagagaaattattcagaaaaggcacaaagaataaagtgactgagaaactacctcaaattgctggtaacagttgggaggaatttttcacattcatatttgaaaaacataatcttgatctttttgctattttctgggtgaaagaaatccaggaaaactaggagagatccagaaagtaagacacatcactctgtctagctgctggcactctggaaactacaaggactaacggagaacagagctgcctgagaaagcagcccagggagacttcgggtgccccaagtttctagaaatgaggacaaatagctagaaagagcctatatggccagatgctacagcccctgcctgtaatgccaaacactttggaaggctgaggtgagaggatcacttgaagccaggagtttgagaccagcctgggcaacatagtgagacccccatcactacaaaaaaataaaaataaaaaaattagcttagcatggtggcatgcctagctattcagaaggctgaggagggaggatctcttgagcccaggagtttgaggttatcgtgacctatgatatggagactgcaccactgcctgggcaacagagaaagaccctgtctcaaaaagaaaaaaaaaagaagagcctataaatagtctgaactaacactgaaattaaaaaaaaattattgactgctattatgtgcaagtctcatgcatacatcatcttatttaaactgccataaaaacatcttctaagaaagattatttttatcttttatttacaaacaggaagcttgcccaagttcacacataaaatgcagcctggcatacacactctaaagccaaactgcctgagttcaaatcctggctttgccactactgcacaaacatgggcaggttccttccctttcaatgtctcagtttcctcatctgtaaaattggaataatggtgtctatgaaataataggtcagctctgaggattaaatgaacacatgtaaggtacatagaattatagtgttagctgttattttattatcattactatcacaacttcaagttaggttcaattaagtaagaaagggcattttaggccaggtgcagtgcctcacgcttgtaatcacaacactttgggaagccgaggcgggtggatcacctgaggtcaggagtttgagaccagcctggccaacatggtgaaaccccatctctactaaaaatacaaaaaattagccgggcacggtggcagatgcctgtaatcccagctactcaggaggctgaggcaggagaatcgtttgaactcgggaggtagaggttgcagtgagccgagatcctgccactgcactccagcctgggcaacaagagctaaactcaatctcaaaaaaaaaaaaaaaaaaaaaaaaagaaaaagaaaaagaaaaagaaaagaaagaaaggtattttaataaaaagtttggggagaatcccagggtttaagatgaaactgatgaaaaataactaaaaaagaaaaattttatctcacaccatttcctatacacatcaccctcacatataaaacttggtaattatatactattttaaaaaggaattaaagttaatttttaaaaagaagaaaattaagttcatgattctaatcaaaatctttttctttctttctttttttttgtttttttgtttttttgagagtttcactcttgtcacccaggctggatgcagtggtgggatctccgctcactgcaacctctacctcctggattcaaacatttctcctgcctcagcctcccgagtagctgggattacaggcgcacaccaccacacccggctaatttttttatttttagtagagacggagtttcaccatgttggcgaggctgatctcaaactcctgtcctcaggtgatccacctgcctcggcctcccaaagtgctgggattacaggcgtgagccaccgtgcccagcccaaaaccttaacaaaagtatcctctgctaaatgtttggttctggctatttattaacagtttggtgcagagaacccaaactgaatgccaacaaagtttttcaaggataaaccagtgctcttaagttattacataagtaccaataaatatcacaagttttataaggctgctcaagacccactctgacatttcttatcttagtaactaaatagaggattaagaattgaaaaatgggacatagtaggtttgaaaaataaaactcaagtgatcaattatattttaattatgtaattttaattaaaattaataaatgatcaatgttaaatggacataatcttggtttatgtccataatcttggtttatgtccatttaaaataaaaacaaaactagattttcttatatgtgtggttgccttcaaagaaatctatgtgtgaattcctatttcctgagaatcaattatggaaaaaagattttttgttttaccatcatatatttttatgaagtagaaaataatggtctagaaattttaaaaagctgagattttaatagatgtgatctttaaagatgttgttggtcttcaaatgtatagctccaagtttctttcatcaattaatgcatcctctgaagtgctatatttgttttctagatcaatacaacacagtcaggatttattaactaaatccatattataaaaagccaaccttgaaactcctggatgccagctaacttgggtgcatcaagaagccagtcagtgagtgtctgattcttaaaagctatgctgcgaaattgcttcccaccattcacattccaggttccgacacatactcgaattttcttaggctttgaatatttgtagaaattctcacacatgctctttagtactttagaagatgctaatcaagagaagacacaatagaattttagctgcatcaaaccatttataaaaattgattttcataactgagatacgatgtccgctggaaagcacaattattatcacaagcacaaacaagcaaaagatacaggcacaggcacaaaaaaagatcagccttcaatgcaaagcctggtatgaggcaattaaccaacacatctttaaaaaaaaaaaaaagtcaacattaaatacaatagccaaagtaaaaaaaaaaatactacacatacagaattattgcagcaacatgcagaacaaatagttctgtttcaatgaaatggtacattaatgtacaaatccaatgaactatacatttttaggaatatagcaattaactttctacaattttcattaagagtctggtaaaaatataaattttatttttctccaaacaaaaacatttaagaacatttacatttaagattgtagctactgacaggcagcttgatgaataatggctccttgagaaaaatacaagctgatatttctgaaaatgaaatcactactaaatgcttcccatctcactcagagtggaagccaaagtgcttaaacaatggtccacaaggccctcaacaatttgtcttgtttttccaccctcatcttccactctccctggtgcactcactgctcagacactggccttcctgctgtttcaaaaacatatgaggcctgcttccaccacagggcctttgcactggctgtgcccacagcctgcaacactcttcccgcacatccttcaagtctttactttccaatgaggccttctctgaccactttatttaaactgcactctgcccttaactttccattatcccctccctgctttatttttctctatagcatttatcacatttataaactatgtattttatttatttatcctgtaactgtctcccctcatgagaatggaaaatccatgagggcagacatgttagtctgttttctttatgggaatactcctagtaactaaaagactacctggtacgcagtaagtgctcaataaataattgttaaatgaatgaatgttcaatacattttgaatcctcaatctctcccgtttttttttttttttggtctacaacccatcttttccctttctaaaccacattctatcctggttaaattctcagcatagaaccttaaaagcacctcaacctaaaaatctgtacttcattggtagctaaccggtaacaggaaaaggacatcaaaactactttcaccttttaccacatgatcttattttattatgatattctcttatgataccaagatatagcagtcttatgaggaaatgagagtgaaaaaggcgagtgatgtcttagtattcttgtaaagataattttgacctgtggaactgctgatttagataagtatatccccattgtttccaggggcagatatgcagatttctcaccacctagctgtttgctttgattgcttgtatagaggtgtctgggtggtaatgaaagcagattacttgtctggcctgttggtatggttaattcaaagctgactgtacctagataaaaataattctctataattatggtttatcattgctcttaaaaattgaagtcactgcttgttaccaatgcgaacatagtgtctataatccattctatatcaacacacaagttctataataattacacggcttaaaatattcagcaagacaatgaactgtgtgaataaaaacgtactgcctcactgtatgaactaataaagtcaagtcagtttttaaatgaaataaaaagataaaaaatagtcctagtttattcttaactggtgccaccttaatgtgcttaaagaaacagagagtcaaaaaaataaaataaaataaaaaattttaaaaaagaaatgagtctatgctcaaacaacagatgtccatccctaaataccatactatttcagaaaatggtgttcattatataactcaaaaatatatctaggtgctctcttcctctacccttctcgagaaaataatcaacagcttctcaaaacattcagaacaataactaagccaaacaattcttaagtgatagcaaatccttttcaactaaatttctggcaagagttaagctttcattccttttgccacagattcatgtttaaagacaagatcataaaccttgcccagagaatgaagacgtgagattcctaggaataaataggcaagaaaaataataaatagtctttaggtctcacacacttaactattctttgttagaaatcttggcactttttaaaattaaaagatttcagatcatattttagtgcaagtctatagttttgaaactatttcattcacaataaggaaatgcaacaatgccttcttaaatattatatgtgagaaacactgtttagtagttgtaaatatcacggatggcactcagaaattaattcaaagtagttacatctggatttttttccatcagcctattaagagtaaggcataacactaataatatttgttcaatgaaatgtaaaagtgaaattaaaactagctgaattatctttaactggaattaagcaattgctacaggaagacaaagagcactgcacattttcttcagaatgaagtacttaattttctcaagcttgaaattcttttctcagattaaaacaagatatcaatttatcctgttaggatctgatggcaaaatgagaaagtttccaattatatggctttatttgtttacaatatcgacttcagaaaaaataagaaaaaattgcttttatttatagattgattttctatactgtacctgactgtaatgtctgctcagaaactatggatgcaacaagaagaaaacaaagaatcattagtaaaaacaagttacaattaaaatgttgagtatagtgacaaaacattttgagaagacctcacttaagtcaatttgatgactttatttttttctgatagctatagaacaccaagtgttacaaataaacgacaatgattgatacaaaccttctgcacctaagaagaatcctacagtgactcagtgatatccaccgtttcaccatcagaagctcctaggcctgcgcttctggctgctcctgtgtgtatgttatgcatgcatgcgcacatgtttgagaatattatgaatataaatatgaaaacctaagaagatggaggatgttgaagatatggaagatactgccctaatacacaccttttagtattctttctgggacttagcagttgataagtataatcacttcagctataacaagaaaaatgcattctaaaaacatcaccatgctatgcaaattttgcaaattcccacagccacagggcttatgggaaaaatggggttggggtaccacgttcaaaaacttcaacaatgacacatcaaaaaagatgggaacctcataaaaatagtagcaagacattatacatgttaaatggttatgaaatgcatgaatataaccattaataaggcacttcatcttgaatgaagttggcttgtagaaatgggcatcaggcagagtgcagcttgtaatatgaataatggagaaagggatatctgaaattcaatgaaaagttgaaagaacagatgtgaatgtgtatggctcataacacacatagtgaactgaggcaggggaagatgtttgaggtgtgtgtgcatatgtgtatgtgtgttttatatgttgtacatatttctagccatcttagttctgctgggtgcacttttctgcatttacctagtgttgcttcccagcaaaatcatgcataagctcatgcaaaattggccttatgctcaaacagttccctaatatatcatattggaacaaattcccattctcagaacaagcgttacagcagaactgactgtacttttttttaaaggtatgattttacttatagtaaaatgcgcaggaaactaaaaacactaatgctgaagtttgaggattacataggtcccttgtttctcctcttctttccttcaaccacttactttcaattgttgcttattaatgcctccacatcaatgtaggcacaggtggaaagaggtgacaaaacacaaatcagtcaagtctctacttttggaagccaggaagaaagcctgaagttgaaagtagtagctaagatcagacattttttggagttttagtaggtctaagttccctagcccacttacaggtccctgaggaactgtccgtaattaactacctttaggcaccatgcaaattctaaaataatccataacttatttgaccaagtaattacccaagaatacattacttgatgcagaaacaattttctcccacttgaacagggaacattaaaaagtttggtttagggctaacagaaaaaaaatttctttttcagagtgctaaaaagttaaaatggaaaaaatttattttgtcaattatacctcaatacattttagagaaagaaaaagtaagtctaatctattaaattctacaatgaatgttgagttttcccgtcatgctacttttatgtgctcactgataggagaagtttttttttaaaagacacagtggaaggtgaaaacctattctgaaggtcatatatttatttcaaatattaaaattggtaatagcagttagtgcccaataattagcactactttaaattattaatatgatttaatgcttattcaaacaatagcaattaaaagttaagaccaagttacagaaacttttgggatagtgatttaaaaaataaccaatataggcattagttttcccagtaaagcatttttctgcataattagattattaaatgctgtattacaagtactagctgaatattctatgaaatactgccttgtacaaagttaacaatgcttaattatttacccctcaatcataatctatagaagaaaccatgcaagggcctcagtttacagcttagtaataccactgattgtacaaatattttaaaacagacaaacttcccttggagaatgtacttttcaaaaattacctttacagaaatcccttcaaaaactattttaaccaactaaaaattctgtgtaaataagtttacatttacctcttggacctttaggaatataaataacaaataaaatataaagtgcacataccacgcaaacttccagtagttaaaagtgctcgagctttgtcagctaaatcactattcagagtatttcccagtagcaaaacatcaatggcctcttgcttggagctgtcaaagaagttattctgaattgttcgggtaacagagcgagcaccatcttttaactttccagcctgttaagaaaggagcgcagattttcattttaaatattactgattttactcattaggttttttgaaattttaaatcagttttatatgattttagtataaaaaaggacctaatcgttctattttgaatatatagtcatgacaattaaaatgcctccaacatgtcactgtttcctttcttcttttggattaaagctctgcacaaagaaatgaaaaagctcagtgctacaacctcatccagtaattacatctagggcaacaaatgtttaaaattgcttattacaaaggaaataaactgaagtgaacttatttaaaacaagaaaattccttcttacaaggtaatttgtaaacttggggataaaatgggtaaggagaaatgggagataaaagaagatacactgagcttaactgcccctagaaaaacttcaaattactttggtagtagaaaaagaaaatggaaattgctcccaaatagcttacatgagttaaaattaaaactaaacctaagaatgaaggtctagtctcaaaagaaatttacaagtacagttcataaacgaatattacatgtaaactacagtttgtatattttgagtcattttattgcccatgcaaaaatacatcataagataataaacttattcctatagtgagatttgattataacttttaatgaatatatattttacttaggcatgttagttaccataatgatttattttgatcttacagattttgatgattgtcaaaacaaaaaacttgcgtcttttaggaaataacttcagtttgcaatatgtaatttttattctttaaagaaataacagtaactcaaggcttctttttagaataaagagccaattttcttaaatgccactaaatgaagaaccagttttcttcaatgccattaaatgaatgctactatatttaataagcaattaatgtttggcattaagtgttatttctttctatataatagcatatgcaaatgacattatttgaaaagacactcaccattcacattatcaggcaattaatcaaaaggaacccagagaaaaggaaaagaaagagcagttcagatgttagattttagttcaattcaggctagcatatttaatgtataaaattttatatctatatattatgttaaagataaaagaccactgaaaatatatgtaacctctgtacatatattgtagtcactgcagaaatgaaaaggtagaagtatataaaagaatattttaagcaatagtttgagaatcagcttttaatagcaagaattatgttgtttaaaaggaataaatcaaagtttaacaatttgatgtttacaaaaatagggaccacttaagaagtaaatatttgtaaaagtcaatacaaattatttctatgagttgaacaaaagaaactttgcaggtaaggccaatacctctgggcagaggcatggcatattatgagacacagaagaggaagacttggaaattaaaagaagacttggagaccatgaatggtctttaaagaatttcagttgctgtatggaagaagctgaatgagaactataaaagtgataaatgttctcatttctattcttgaaataatttgagaaattgtggagatttagaaagttgataaattcaagtgaggccaggatccttaaaaagttaaacaatatttaagaatataaaataatgaaaactatctcaagtattgttccaaactccctcaataagggacaaatacttgagaagaaagtagtctgtagataataccaggaaataaaaagtaatgatgaaacagacaattataattaagtccattcttttttttttttggaacagagtctcactctgtcactcaggctggatggagtgcagtggcgtgatcttggctcactgcaaccaccacctcctgggttcaagtgattctcatgcctcaaactcccgagtagctgggatttcaggtgtgcaccaccatgcccagctagtattttctattttcagtagagatgtggtttcgctatgttggccaggctagactagaactcctggtctcaagtgatccacctgcctcagcctcccaaagtgctgggattataggcgtcagccaccacacctggcccatatctcacacttcgttggcacatcttgatagccacctttctaaggtaagataagtaaagatcaattatgccctaatcttgggttcctagtaagcactgcataagctgttgatggacttacttgtccaagtggcatacgtcacacatctattaacagtaggcactgtgttaagtgcagggaacgcaaagccaaataagagagaaccctttattaagaggtctatggttttaaaaatcatatttgtaatcaaaacaaacaatacaaaaagtaaaacagatatacaagggaaatcatgaaaaaaagagcaatatatatcatcttagtggattgtcactaaatgactagatacgttatatatacatacttcccaaacttagggaaatacctatcttccatttattcactagtatccactgtgaaaggaagtatcaaagaaggcataaaagcacattaaacagaattctaagacacatctattaatttaaaccatctattaacttttaaaaggccatttaaaagctttatgaagagaggaaaaagaggatattctgtaatgttatgatagatctagatataccttcgctttcccttcaagagctccagttcctgcatatatcttactgattgaatcaccattcacggaccacattgaccgaaaaacttcttgaaagcgagtcaccaactgaggcttttcagctaaaccaagagcttccaactgtttagctagcatcttaaaaagcaaacaagaaatttttataagtacattaatatattaattgtaatatggcttttaagaactaccagaatcaaaccaaaaatttatcattatagcactatttgggactagcttctgaaaacataacagtttactaggctgagttatttcccatcatttcaatttttaaaacaaatactgtatcaatggaaactacaagtattgataaggacttctttctggttaaatgataaaatttatcttattaaagtatccctataaatcagagttgtttaccttgcccacctaaaagaattcatcaatcaacagcctgcattagaataaaaaaaagtttacttagtcctaaacataaataactaggtctctttaacttttggatttggctttataagtttaagtaattaaggtaaaaaaaatgaaaaaaaggagttgctcttaaattgtcacaaaataaagaaaataagtaaaacttctgaatgaagtcatgacagctttttatgcataaaatccacatcggtaatatatataagggaagaactagggggaagagcatgcaagaaattcaaggacctctcggcttccacaagtccttatcacatataacaataaaagtgttccaaaaagttattgatctttatatgcaagaattctagcctataaatctgacagagtcaatgttcgatctttatccaatctgtgtatttggaatctagtcatattctatgccttgcattttaacttaactctttccaatttacgttttattttatcatgtaagtatggtgatcatccataattatagaagaaccaaaagctaaaataagattaaaaaaaccttaaactgggttcatttaattacctagagacttacaccagagctgttctttgctagcatggagaataaaacaaaatgagccccagggcctcctttatcatttaaatctttcttcaaggaactgggcaaaactgatcttattcctctactagtttggctttgtctatcttggtgtcaaactttgtaacctgtcaaccaattgctatcctagggagttttctaattcctaactatcaacagtggagaatcagctaagtcagatcctgaaaactaacatctgttataattttgatgaagaggtccaagtacttcaataagcttattatcagaatccatgtacatttattcagccacttaaaacttgaaacaaatccaaggcatgtgataaactcttatctaaatgaccaacatgcttgctttcattttcttgtttctgtcaaattttctaaataaattacaaataaacatcaaaaacatactcaaaaaatccaaacagtaaaatttatttagttacatgaaaaatatattctgtagtagagaattttatacactgtactttcatttttgagataaagaacctcagctgcaaagtaactaattaaccaatactcaggtcaaatttaagatcattaactaaaggaaataagaacatgtaacttcctattgctgtttttttatagtatttgagaactatgttaagttctgatggaactaaacgaagtttagccacagccttataaccttaacttgcagaggagggaagacttagaaagctcagcattgctaaatagtttgtcaaagagttgagactatgtttatcttaggctgaatctgatggataagtagtaaagaaaaaaaaaaaagaaaaaacgttgcaaacagcgaccttatcagagaagttgaattgcattcattttcattctcactaactatggcattttcatctgatcctgtttttttatagctactaatttgaaaacaccaaacaaactggattggtatcagagaagttgaattgcattcattttcattctcactaactatggcattttcatctgatcctgtttttttatagctactaatttgaaaacaccaaacaaactggattgggttacaaattgtcaaaaatatagtcctatataattgtacatatgaaaatagacccttcttatcctaaaatagatttttaaaagacaacacagagaataaaaggccaaatacacacatacacccacacccacacatatatatttcctccaaaagacagggaaaaaattgttgaaatactataaacagcagattttaaaagggagaataaggaacaacagaagtagatagagagctacctaaagagaatatgaagatcaggtaaaggaaatatttaaatcaaaagaaagtttggccaaaaaaagagacagagattagaagtacaaaatgaagcataacattacatacactttctggaaggtaataagaaacataagtattcaaaaagcacttaaagaggcagatgatacaaggcacatacattttaatttattcttttacctctaagccaagaaatgcctgcacactatttgttctatcaagacaatccaagcagtttgttcgaactgtaccactctggcatctgtaaccaataaagttaaatatccagtttggaacaaaaataaagctaaaacaaacagtgaataattgaggtaattaaaatgtagcatccaccttccctctccaactttttattattacagtattcaaatatacaaaaaaaattatactgtgaacatccatatacccaccatttaaatttgacaactgttaacattttgtcacatatgcttcattacattatctatcacacacttatttttaattaggccaacaattagaaactaaatatacattcaggtttatgctcttacagttctttgcacataaaataaaaatatttatagaacaaaatttttttaaacctaagatctgttatctctaatgactgtgtctacagcattgatgctaaataaaatacaaattgaaaaattaaaaatttgagctttctgcactaaagtttcccttaacctatattctgaacttaactctcttaacatttacttttctcctctatttcacatacaaaaactgaatatttaaattatactaaagcagacagtaaacaaagcctttcacttctatttgcatttaataatctttactggcatcaagaaatattaaaacgtaagttttaaaagagaagcaaaacagtttcatatataacagcatgaagtatggagccagacgaatcccagttctaacacttgctaattatgagacttgcagcagatggaaatgggcataataatagagtctatccctataattgttattgatacatgttaagacttaagtacggccgggcgcggtggctcacgcctgtaatcccagcactttgggaggcggaggcgggtggatcacgaggtcaggagatcgagaccatcctggctaacacggtgaaaccccgtctctactaaaaatacaaaaaaaaaacagccgggagtggtggcgggcgcttgtagtcccagctactcaggaggctgaggcaggagactggcatgagcccgggaggcggagcttgcagtgagccaagatcgcaccactgcactccagcctgggcgacagagcgagactccgtctcaaaaaaaaaaaaaaaaaagacttaagtacactgcctgctccataaaatgcgctcactaatgtaacctctcattattatttggtgaattctaaagaaagaaaaacaagtttaaaatcaagtataggatgggtgagatggctcatgcctgtaaacctagcactttgggaggctgaggcaggtggatcacttgagcccaggagtttgagcccagccagggcaatacagggagacccccgtctctaccaaaaaaaaaaaaaaaaaaaaaaaataagccaggcatggtggcacacacctgtagtcccagctactcaggaggctgaggtgagaggatctcctgaaaccagaaggcagaggctgcagggagctgagactgcaccactgcacaccagcctgggcaacaaagtgaggccctatttcaaaataataaaaataaaaataaaatgaaatatttaaaagatatttaattataaactttaattttaaaaagaaaatttaagagttcaacgttaagaataatttttaattaatgttccaattcaaagaacagagaaacagaacagtcaaacctttgaacttcacttccattgaaataaaaaaatccataatctagaaacttctggacttgaggtttaagaacactatgtaatttttctgcctttcctcccttaaccatttgatgatagtcaaaattcaccatctggatatcagcagcatgttcagaagctttcaaatgactctgaaagtaaaaaggcaaatattcatctaaatgaaagtaaaaaggcaaatatccatctaaatattcatcacatttcattgacactggcaataaatcttttccctaaagcctcaaaaactatccctgagagatacggtgacacaattaacatcagtgtacttaaataatattctcatctggcttaggaaataaaaaattatttccaattgccagcattttatttttacaacacaaacttactatttagacctattatagaatctcaaagtcatctaagacaaagcctatcaaagactgaaagattcatattttataacttcattcaatacatacaaatattcttaaattttaccataaagtcactctgtaaagtataatctgtttattaacaatatttatttcaccagattaaaaaaatagctataaaatcaggatgcttttggacttaggagattgaactttagaaaatgttttctaacaatcttgtttaagtttataatcttatgtaacaacataatttatattaattcattattaattcaataagtgttcattaaaatattttttctttagaagtcaggcaattttggggttctttttgacatgaaattctcaagttttctctcatcagtacaagaaggtatagcgttgcatgtatataaatgcatcattcacaattccataggtgaaaaacaatgactatggttctaggaagcaggcaaagcaatcaacagatgaagaaggaaactgctatttctctactagtgacagataaacatttttggcaaggagggtatttttctgtttctctacaaaataaaaaagcagattagaaaacagtgtcatttgcattgaaagctttttagaatcccaatttcagcaacattagcctaaattgtttcttaatagacccaaagagttcaagtttccaacaagtacccaacctttttcttggaagtaatttacttcctggaagaatctgattactgtattattttattttttaataccattctaggtgtccatgggccagaatgaaataagaaatgaccatacttacctggaaagctttacttagcatatgttcaccttccttagatccaagcaaatttactattatttgtttaccatataagttcttaagtgttctaaaatgcctatttaagaaagaaaggaaataaatacatgtcaaataagaagcccaattttttcaataaacaataatccattattaaatataacttacatggcagtattttaaacacagaattggaaaactgggtgcgaattcattgtacatggtctcaaagccgaatttacgaaaactcatgaatgcaacttcctctctgacttatgggtactgagacttccacccctgttggagctgtggaggcatccagcttctgcccactctgtgaggctggcaccagacaagacagacaccagccataagcttgactggaaaggcagtaagggcagatggcaaagggctgctgctcacatgtgaggacatcacctactccgttgagtattcagagggacctccttactagctccagtcttcagaaaaatgggccccaaatacgagtcttttctctttccagcttctaaccattccagaaactatgtagagcaatgccacacaaagaaatgtaacataaaccacacctataatgttaaattttcaagaaggtgcatttataaacatgaaattaattatactttctttaactcaacatgtctaaaatatcatttcaacatgtaatcaatataaaacaactacagttaacctttcaacaacacaggtttgaactgtgcaagtccacttatatatggatttttttcaaccaaagaagaatcaaaactacagtattcctggcatgcaaaacccatgaatatgaatgatgacttttcataagcatgggttccacatggccgactgtgggacttgagtatgcacagattttggtatgtgagggtagaaccaatactctgagtataccgaacatgattttactaatgagataccttacattcttttttattttttaaggcagtctttgaaatctagtgtgcattttatacttgcagcacatctcaactgagactagtcacatttcaagtgcccagtagctacatgtggctagtggctgctatactggacaatgcgcccacagaggaagttttaaggtcaagagatcaagacccacacttccagcactaccacccccagaagtcgtaacactaggtgtcactgtctttcaattaaattaggagtcagaggaattttatttaaagccaaaaaagtttgaagtgaatcagtaaatacaagcagtcccactgcttagcaatatcaaaacttaaagcactatgtaaaaattgtcttacctgtcaaaagcaggtgcattggcttcaaatccccttgacatacggacacgatgagatcccaccttagacaagaaaaatatatttaatcaaaccaaaaaccaacatatagacgaaagaaatatcactgcttacaatatctaacaatttctttgctgaacacacagtcgttaatcaaataactgatttccattcatgatatgcttttaaaaaaacaagttccagggaatttccaccctccacctttatttttaaaaaaccaacctcatcaaaaaaagaagttacatcattatgaaatactcgtaaactagtaggaatttttattgatgaaaactatttttaaaggtgttttcatatatggtactttgttttaagttcaaactacatgccctgtgtaacagatactattaccatttgggtaattaaaaaaaccaaaataccaacaggtaaaataacttgctatctgagatcaacataaccaattccaaaagagattcagatgagactttatgtctctgacctaaattcctactcctccaagctgcctaccaatacaaatgtctatgtgttttcttctctactatgttgaatattctattcacaccaaagttccaccaaattgagaatatcattccttcctggaaaagcagactttccaagtcaaccttgccatcacccaattatagtatttgcacattttgcagaatcaggaattttgggttaagcaaattaaacaagatggaaaatatctacctattgtatattgttataatttttcttttcttacacaggagaatagcagagagatgaggcataattgagaaagatataacatgccaagaagaaatatataggtgagaccagattatttccctgaacttcaatttaaacatttctctctgagacgttggaatgaaggttgcccaatcacaacaaggatcactgagggggggcaaaaaagttgcccaaaattcattcttgctaacctgtgaacaaagtgcttttttttgtgggggacggagtctcactctgttgccaggctggagtgcattggcgtgatctcggctcactgcaacctctgcctcccgggttcaggcgattctcctgcctcagcctcccgagtggctgggactacaggcgcccgccaccacgcccagctaatttttgtatttttagtagagacagggtttcgccatgttggccaggatggtctcaatctcttgaccttgtgatctgcccgcctcagcctcccaaagtgctgggattacaggcatgagccaccgcgccccgcgcaaagtgcttttaaagagggtgtaaaaggggggttgtcaaatcagtcatgtaattggacaagtaaaaccagaaaataaactctaatatgctcatccaattccaaaactgaattaacagtacagtattatcattcattaagcattatccctcactgcactaagtcagataatctaatgagtattctgataaccaggggattctctctttaatttttaaataagaaatcaattagcctaatgtcacatctgtgttcaatttcattttatggtacttaataatattcataaaagtttaaaatttgaaagacgtatgtcccaggacattaagcattttagactgcagaaaactcacaagttgatactttttctttggagtaatcccagattaattgcctatcactccatacaagttcaaaacttagcatttttgtttactgattaacatttattttgcatagtactgcaacggtgcataaggtgaaaaaaatccagttttcatgtcttccaggtaatgcctatggttgttttccaccactctgttccccaacacatatatacattcagctatgtatcacagctctcatagcaatatactggctagactagattagatttctgtttttgtgttattagagacagggtctcactctgtaaccatgctggaatgcagtggtgcaaccatagctcactgcagcctcgacctcctgggctcaagggatcctcccacctcagcctgctgagtagctgagactacaggcacacgtcaccatgcccgaatgatttttatttttttatttttttgtagaaatatgggtctatgttgcccaggatggtcttgaactcctggtctcaagtaatcctcccatcatggcctcctagactaggttttattactcaatgttgaaagaaaagttttacaataacagagctattgccaatcgtgataaaagtagcactccagaaagtgttaaggctttaaataaccataactttacccaattaaaaaaaagttgcggccaggtgtggtggctcatgcctgtaatcccagtacttggggaggccgaggcagctggatcacctgaggtcaggagttcgagaccagcggatcacctgaggtcaggagtttgagaccggcctgaccaacatggtgaaaccttgtctctactaaaatacaaaaattagctgggcatggtggcacatgcctgtaatcccagctactcgggatgctgaggtaggagaatcacttgaagccgggaggcggaggttgcggtgagccaagactgtgccattgcactccaatgggcaacaagagctaaattccaacttgggggaaaaaaaaagcttgcattaaaggtatttttaaaaatcatttaattgtgtggtatggtatatcattttccatcaatattacttctttaccttcacatatttctgaaatttcaaccaaaaattgggggtagaccttacaatgtttaccattttttgactgattgatacggtttggatctgtgtaccccctaaatctcattctgaattgtaacccccaaggttgaaggtggggtctggtgggaggtgactgaatcatgggggtggagttctcatgaatggtttggcactatgcccccttgtattgttctcatactagtgagtgagttctcatgagatctggttacttaaaagtgtgtagcacctcgctcttatctttcttttgctcctgctcccaccatgtgagactcctcgctccccttttgccttttgccatgactggaagcttcctgaagcctccccagaagcagatgctgccattcttcctgtacaacctgcagaaccataagccaattaaacttctttcttcataaattactcagacttgggtatttctttacagcaatgtgagaatggactaataaactgatatatactgtaaatgtagtataataatatatgatctgagtattataagttataaatgctaaacaacttcagggaaaggaaatcataagtaaaaggaaaatcacaagtcaaaggaaatcataagtaagttgccagcactaaaaatgtcattcttacttgtgtaacaccttatgacaattcttataatgcctcaaacaaattcatcttggtatttatcttttccataaaaggcctgagtgcccaaatggcaacctctctatgaagcatcattatatctttgaatctctcatagcacctagcataaaataacatacacaggaagaactcaagtatttagtgaagagatctgagtggccactgaaggacaataaatcttaattttggaagtagaggattcctgctagaaaactgcaaggcctgaagttggacaggctgagtaaaccagatcataaggacataggtgcctagtaaatctgacacgcataacatatatatcaaaaataagaagacctgtcggagctagtaggaagcagggcctagagggacaagacagaaaactgtgagaatcttccaggctagaagaaattatgaaaaccttaactcagaggatagtagtgggaataaaaagaaagtcctactgcctagaacaatgctgagactaatggtaacagggctacttttcacttggtcaggactggctgcttcatagccattagagtaggatcttataaaatagaagttcttgactttgagtggtagagaacttggttaaaaatgaggattcctggccgggcacggtggctcatgcctgtaatcccagtcctttgggaggccaaggcaggtggatcacctgagatcaggagtgcaagaccagtctggtcaatatggtgaaaccccatttctactaaaaataaaaaaattagccaagtgtggtggcacgcgcctatagtcccagctctcgggaggctgaggtaggagaattgcttgaccctgggaggcggaggttgcagtaagctgagatcgcaccactgcactccagcctgggcgacagagcatcattccgtgccaaaaaaaaaatccataattttccacctatcaccacataacattagccaaccagaccgtataggaaggaaagcacacaggagaaggaaggcacaaggaagtcccactcaaggaagatccctcagtgtaactactcaggacgcaaccttattggatcatcaaaacactgtaattcagaacttattaaaataacacaggccaagtacagtggctcaggcctgtaatcctagcattttgggaggccaaggcaggagaactgtttgcccaggagttcaagaccatcctgggcaacaaggtgggaccctgtctctacaaaaaatagtggtatgtgcctgtagtcccagctacctggcaggctgaggtgggaggatcacttgagcctgggagatcgaggctgcagtgagccatgattgcaccagtgcactcaagcctgggtggcagagtgagaccctgtctcaaataaataaatatataaataaataaatataaataaattaaacaaagaaataaaataacataaaaacagtgtaccatagggctcataaactggttattagaatctctaacactagcctgtccctaaaacaaaagcattcacctcgcatcacatcagggtttcagcaatgttcttaaagcaaatactccaaacacccactgttgatcatgaaagcgtaggagaagtggggttctgttggcattctctcctaagggaaatttagggaaagatatatctatttacgttatccctacaaagataaaacaagtcaaatcgtcttgacaagaattcaagaatttttgcagagcagtagaagtgttaatccttgttaactcttagactgtcttaaataaaatgttactaaaaaggttcaagtagtctgtaatttttctctgcaataaccagtctaagatgtaagagatccagcagtcaaataaaggaagaaagatttttttttctttcccttttctcaatactataggctgaagcaccaaacttactagactatacatacccagatcctaaagtaaatatgatatacttcaaggactaataaattttgaataaaaataaaatgtcaacaatagttaacccttacatggtgctgactgggggccaggtgctattctaagtgcttttaatttaatccttacaacaaccctataaagtaggtactattaatattattcccattatacagataaggaaactgagacacacaagggttaaattatttgcccaagatcacacagctagtagtggtagagtaaagatcccaattaagaagtctggttcccaaggctttgttttatctactacattcttctgcctaaagagactaaatcattatatactaagataagaaggtaataaatatggaatcacattgcaaatcaatacactataaagacttcaaaatttttaacactaaatacagcagctcaatttcaatggctatttgaaagagcattaaaagaaaaaatatctaagataattccagaaactctgtactcgtctagacccttatttgcaaatccagctaacattattagatggaataatggaaccatcaatgaattaattaataaactatccagaaagtttagaaaatatgaaaattgttcaaaaaacaaaaataactgaatgtcaaacacatacttgcaaccctggttgctcccagaacaatggaacagatcctcggatttgtatgaaggaagaaactgagtcatctaagtacacaacctacagaaaaaaaaataatatgtaaactatttccacagaaaagttgttacacttacattagaaaaacaaatttactaaaatctattgcatactagttacattttatgatctaactctcatatacaattgtccaaaacaggccactatacaggtttgacttttttttctgttagcgatattaaccaaaaaaattagtaaaattataagcataagattcacaactttaaaaaataaattccttttaaatcttaatattttacatacatatctttatatttcattttgtttagctctttataacctaatttgaagatctgtgttgggctgggttcatggcctgaatttataatcatatagtttcatagccaaaaatatcataatttctgatttttagatggtacacatatttgccattaagagctgggtttaatttcacttcacaaaaaaacaagttgtctaactctacagctgaggattttaaaattcattaaaattcaataccaaaacacacaacactgactatgtcatgctgattagtgacatcttcttacctagatgaagagccacaccaaaataagttttttttagggaagcctttttttaaggcccataagtaaccaagaacaatcataaaacattatagatgttaaaataagctccgaatcaaataaaaatctgttattctagtattttctgtgcttctcctataataaattaattaagtaatataaaacactatatatacctgttctgtttctacaaaattggcaacatgaccatcatcatttgttccccggacattaaacctggtcccagctcgttcacagcttaatcttgaaatgaggcaagccttcgcctgtttatgagcagcataaattgttctgatttctactcctccacacataagacgtaataaccagtcatcacaattcacgccatagtgtttgagatgcaaatgcaaagactgattcctaataggaaaagaaataaatgattagcttatggaatactaagtaacaaagtatgacttttaaaataatctcctggaaaattaatttaatattattaaatttaaaggcacaaacaacaaatcaattcatttacatttactatgctagggatcagaagatagggctataaaacgagatccttcaacatgtgatctatgatccacagaaaaggagtatttttgtgtttttagtatctgtggcccatttctgttatgtctttatatataatgtgtttataacctaacttgttccaaaaaggaatacatatgcatgtccccaccccaatttatgaagctctactttttaaaaaaatatttatttatttatttatttatttatttatttatttatttatttttgagatggagtctcggaatgttgcccaggctggagtgcagtggcattatctcgtctcactgcaacctctgtctcccaggttcaagcgattcttctgcctcagcctcccacgtagctgggattacaggcatgcaccaccaagccgggctaattttttgttttgttttgtttttttttttcttttttgagacggagtctcgctctgtcgcccaggttggagtgcagtggcgggatcttggctcactgcaagctctgcctcccagttttatgtcattctcctgcctcagcctcctgagtagctgggaccacaggcgcccaccaccatgcttggctaattttttgtatttttggtagagacggggtttccccgtgttagtgttagccaggatggtcctgaactcctgaccttgtgatccacctgcctcggcctcccaaagtgctgggattacaggcgtgagccaccgcgcccgcccatgaagctctacttttaaggcttgacttttataaggctctattttaattaatttaaatttaaatagcaagatgtggctagtggctaccacattagatagtgcaggcatagggtttatcatcgctccaaatacttttagcattctaggtaacagatgtggcctggtttccaaacttttttcagagaaacaaattttattcaaacaaacatgcagaagcccaatgattatgatacagataaaagctgctatggctaaagtggggattgggactgaactttgctgggttggccttctcaccctgattacccctcagggatctctcctggaaccttagacctccacagaacatataaagaagctactaacaatataccactaaggaaaatacattgttaagtggaaaaactctatcaatttgaaaatgagttttctatattattgaagcttgactctttaggttttaagtggaattcttctacttaagtgctccgtactctctctctcttcctgtcttaaataaggtataaaagatgtaatagcattatcttgaagactcacagcaatagccccaactccctgccagcccctcagattacaggctgcaacagagataaaaagggtggtcagcagttctggaaaaccagctatgaccccaacccctcttatccatccaggaaatcacacgggaatataaatgagtgatgatattacaacagggataatgttaaatctgatgaccattacttattttaaaaatacactgacttaaacttccatactttactattacccacattgatctgaggcaaagttcaaactggttgtgacccagtatgtccaaccaccacagctgagacctacgccacagcaaagttataagaaacttacttgtcctcatttaaatagaccttaaatcctatgcattttgtgcaggcagagtttctctctctgctgtcagttttcatttttctttgctgtcagtgtgtcactgttttagcatttaaatttatacatgacttttgactggcagcagcttagaatttccaatggagtaaagctatctgggctttgtcacaggtatctgccactctttggctacaaaaattacatggttgtatcctggaaaatattgctactaagtgcaagggtatgcacaatgaattccaaaagttcccgtttttctatataaactgaagctcaagaatgccaatccttagcaaaattgtaaaatgagcaaaattcacctttggtgctctagctgtccctttgttcaacctgtctcctgctggacaaatctcaggctttcttttatctgactttgcccccatctctactcttaagtgaattaaaaaaaaaaaaaaaggaggccaagtacggtggctcatgcctataatcctagcactttgggaggctaaggtgggggggatcacttgaggtcaggagttggagaccagcctggccaacgtggtgaaaccccatccttattaaaaacacaaaaatattagcctgcgtggtggcgcacgcctgtggtcccagctacccaggaggctgaggcaggagaattgcttgaacccaggaggtgaaggttgcagtgagccaagatcgcgccactgcgctccagcctgggcgacagagtgacactcaaaaaaatcaatcaaccaaccatccaattaatcatgcctattgattaaacctaggcaatatatctgcatctgcttggacttctaattgttgtatgaaagcttttatctctcaatctaagaaactttgggtaaaaatgaggagggaaaaaaatgtaaggacagctgcaacacatttaccttttcaagggacttcaacatcttctactagaaaaaatgtagtgttggcatggttttaactcttggaagcctatttctcaatgcttcacaaaagtacatcccatcactgctagcttctttgggcaggcaggaactcatgtccattcatctgccctgttagtccctgcatcccctctctcctttcctctccctcatggtctcctcctctgctaaacccaagtctctaacacataatgctataaaccctgtttttattctgtccactcttctccctgatgccaccactctgggtcaaaacacttccatgtgagctacaacgtgaccaagctgttgctctaaagttaagtttcttatcctaagtttgttgttgactttgagtcttctgacagctagggcaaatgggtgacacccgaatgtgctactcaaggactatataagtgacagtgaaagtgtgagagagaaaaagtacacaagaggaaaccatcttgaatctgaactgttaagggaggccaagagcaaagagtcctgaactttggccttataacatatgtcaatataataatacataatttgcacatgatatcaagagaaaaagtcaacatcaatgctggctgtaaacaacagaaccactatactagaaatctggtctgctgcaatagaacaatgctaattatagtcccatgtgttctgctcaccatttgtgcctacttagaatacagcacagttatgcataatcatgaaatacatcacacttacctacataagtcctaacttattatagtactagattttgtcccagtatactacttcttcacaatctgttgctcttgaatcaagaccacctacttataaccttaaaatttagaataataagggaatgttggcttagaaagggaatgccgccagagacaagatctcaaaaccaagaataggaaacgtgagtaacacagttttgttacaattaaattcatttctaaatatacacaactattttaaatgtattttggaaatgaaagttcagtgtagactggggggagcacaggggttttatgtcacatgccaacttcaataaaccgacattggctgcctgccatgctctgctgaggactccagagaaggaaagatggatacactcaattagcaatgtctatcccttgttatctctagacataacaactgctgaactttttttctttgtaaagcaagcaaaagttttattgaggaagtacaagtacactccaagaaaggagtgggctgaccctgctggaaacacccccaagacattctgcattgtgatcttctattgtctcagttctttctttacccagttctcaccaaggtttgggggatcctcccttactgtgcttaatgcacatgcacgggaaccagtgatcaatatgaatcctatctaatggtggcactgcttattaccaccaccccaggaaggtatagccatcaattttgtactcattatgcctgctcagctctcaggaattcccctttgcctttttccttccttatcaggatctacttaacaacattctgacagttcgaccacggagtgagtactgagcatcctaagaggagttccggggcattctttccaacacgtataccaccccctcgtgcctgctcatatctgactgtctactcttacattgctccctcaaggcgttgggacccagaaatcttttgggagatgaggtagaggtcattctctgtagctacttgctgctgaaaaggggcatcgagggtcttcagggttcttcctcctttcttgctgtcacggtgaggaggtttttgatgactgaacaactgctgaacatattatgtcccaaatcaccaaaagggaaaaaatgaactcaccagaaaaatctattatcagttgtctgttcttgcatgctacgatgcgcattaagactcaaatctaaactgatgccagatgcagaccatgcaaaataaaagtttcctgaattcaaaactttccgcacttctgaaatgcgatcctcatctgaagaatcgattcgcagtgatataaactcagtggaagtaactcggaaaacttcagattcttgaatttttccaacagacatacatccagtgactaggaccagataatgtaacatagtatcacctgcaaaacccaaagattttactggatgaaaaatcccaacattttcaagctattccatttcttcttgcacctctattttttaaatctgacattgtgattattttaaacttatcatggatgtgttgaaattcactagacattttagttgaaaaaaatccttgtttaaatatattaagtataataaagcatttaaacattaacaggataatctcacacgaaattgttcctgaacttattctgaggctaaaaaaactttatcgaataattggctgggtgcggtggctcacgcctgtaatcccagcactttgggaggctgaggcaggtggatcacctgaggccgggaattaaagaccaccctgactaacatggagaaaccccatctctactaaaaatacaaaaactagctgggcgtggtggtgcatgcctgtgatcccagctactcaggaggctgaggcaggagaatcacttgaacctggaaggtggagtctgcagtgagccaagatcacaccattgcactccagcctgggcaacaggagctaaaactacgtctcaaaaaaaaccacacgaacaaacaaacaagaaaaaaactttatcaaataaaaaagtatgtgttaccttctctacttttgcttaatgattgtcagaaaattcaggtaagataatgaattcacactcattttaacaagttctttgtaaatagtaaagttgaaaaaatggtatactattatcagctgatgatgttgatgacaaatggacaaaagtctctggtaacaacttataaagcaatttggtttacaaaaactttcacagagatttttttcatgtaattatgacaaaaagcctatgaaattagtataaagttgaaattgagcaatggtatactgtgagcatgggctctgacacaggtagaagcggccctgaatcttggctccattacttattacctggaccaatttcagtatgtagcataacgaacctgagatatcatctcttataaaaagagattaaagcaaatacctcattatactgtgaggcttacccaggagtaatcagtaaagcacctaagcgcagtgctttatatgtgatagattcataacaaatgacaaatctccattttatagaccagtgctactcaaagtatggtccatgaactgttaccagctcacaatgagaaaggacacttacaccagaatggaaatcaactatattactaagttcaccctttagttgagctgacttttttttctagtaagactttatcaatgaaggaagccacatgttgatttgtatcatagtgcaagctccttatcttatcacggatcaataacaaaatgatttatggaccagtaccaatgttgaagaacactttgagctgcaaaattacagataaactagtaactgcaaaggttactctgcagctcacggtgacattacgtggcaaaaaaaaaaaaaaggctcaagcagacactttctgaattcaaaacagatgtcttttccaatacaaaccaagaaaaatcagtgtagttctcatgcagacactttttcctaaatgcactgaatcaacaaaaaggagaatgttctgattttctcttttgacaactgatacttatctcttcaagtggtcaaaccagagactgtctccgaacttccactcacatgagtttgagcatgtagcacgcctttttgggcaacaaacattatcacaatattagctacattaatgtttaaaagatgttagcacatgtgtagcttaaatatggagtctacaataattcatagctagtccctctcaaatccttagaattacaaaatagaaatgaaaaaatggatgaattctactgaatgataaacttaccaagatttaaccgcagaacacctaagagtccatatgcatccagtactttggagtatgtacccttgattgcctctttttctgcagatgctacaaaaaaaagttttagtttaagaaaaatgacctgaaacattggattctatttagctaagtataaatccagagtttcaatcaaaagtttctaaatctgatattcttaaaataaatgtactgcatattttcttaaactagtaacattagtattcttcccaaagagttaataaattattccaagaccatctattaattaatccatcctgtccactgatctgaactctgtcttcttacccttttattcttgacagaatagtgctcgacacttagaaactgacaaaacatttaaatgataaaagctaatggcaacacttgactacacaaatgtagggcaagaatagggaaatctgattctgaaaggacaaaagtctggtctttgccttgatttatttcttctgctataaagttaacgttaccttgttaatgaatataaaccacagaataattttcctaagacaggctattatgattattctattgagaagaaaaaacaacaaaaaaaaatcaaatcctgaaacgttaaagaaaaaaccttcctagcacttagcaattacacattaaaaatttcacaaagaaccaaagaaatattaacaaccagtatttcaaaggacaaatacaaataatacatcccacagtctacagttgatccttgagaaagataccttcctttccttccaggtttctttccttctttgcttttttcccttttccattatctacaccacactcaactcacctcctggctgactggttcataccttatttacttcttatctcttacacttatcccctttcctttatctacaaaataggatgtttggcaacactgacgtgttccacgttagaaaatcacgtaagtagatacttatgactgtctcatttcctgtccatctttattgccaacaaaagggctcttctcagcctactgctttgcctaatactcctttgtactttgcattagagatcttctactttgcctgaagctcttctccagagtcctatagaacatctcactttccctgcctgcttcacctcttttcagaccacgtaggcttaagccttcttcctagtgatctggcttctgccttctgatgagttttgctctgctagttgcagcacaggctaagactaactgactcagtcactcaattagctgatattttcacgattctctaacatgttcattattaagtgtgggccattatcaaaccacccagtatgaaattagggagtggagattcgccaacccgttaaagtgatggggatttatatttcattctgtattccttgagttcctattattattacatcttatgtttatccaacagttgatcctaacattccatgacaagcaacccaaatgtaaaacattacaatataaactttaattacattttataaagcaaaatagaattgccttctaaatactgcctcgttaagagtaccatatgtactgtaaacattagagagacttgttatacctctcaggacagaaggcatgacttccaggataaatattattctagaggtttacaagttatatgccatatacatttaaaatacaatcactaatatagtaatatagaaagtactagatatatccatttcagcagcaatcatcatttgggttcaaatgccaggaggcagtaggagttaagaagaaaatatagttttatttttatttttattttttttttttgagacagaggctggagttcagtgacacaatcacagctcaatgcagccttgacctccagggctcaagtaatcctcccacctcagcctcccaaggagctgggactacaggcatgtgccactatgtccagctaattttttttattttttatttttgtagagatacagtttctctacgttgcccaggctggttggaaactctcgggctcaagcaatcctcctgtctgagcctctcgaagtgctaggattacaggcatgggcaaaaaacatattcttaacattaagtcaccaccttcctttagaaaacagagaagtcattctataacttaaattaccatgtaacaaaatgttctctcttctaataatgcataataactatcttctcattaattacactccaaatacataaacgtatgtctctcaggactgatgaaggcccatctattagactatcatctaattcaaacatgcaaacaaatgccttgcagtttagttatttacatgtttgtattctattcggacactcaggaaacaggatacacacacacccacacacacaccttaaagtgcatactcttagagccaaaggtacttttaactccagacactccaaatttcttaagagaaaacagtatcttcttcataaatacatttgtatctgaaggacagtagatgtttccctactttacgatatatgcttcaaaggttttgagtagactggagggaggcccagtaatggccactaggagaaggatggcctgtgcaagaagctgaagctagaggcaggggaaaagggcgtccacttgtgggaggggccgcctggcatgagttcctgaagtctgactagggtgaggagaggactgtccacccatgggtgttaggggcaccccggcatggtaagttagagcttgagagggatgggaaaggcagggttttgaagtgccagtggggtaaggagggcacctatgcagtggaggaggctacactggcaataggagagtggttatctatggggtatgatcaaggataatgagagccaggtttctcactgtcagagaaggtactcacaaatgcaaacagagaaactagaatggacagtgttgattagaattggagttaccaggccgggtatggtggctcacgtctgtaatcccagcactttgggaggcccaggtgggcggattatgaggtcaagagattgagaccatcctggccaacatggtgaaaccctgtctctacgaaaaacacaaaaaattagccaggtgtggtggcaggcacatgtagtcccagctactcgggaagttgaggcaggagaatcacttgaacctgggaggcgtaggttgcagtaaaccgagattgcaccactgcactccagcctggtgacagagtgagactctgtctcaaaaaaaaaaaaaaagaattggagttaccagtgttttctagatagactaaagacagacaaaaagatagaaacacagatataagtatatatgtcatatacatatatagttacatatactccttagcactagccactgagcagacccaggatctacaatactctgacagcaatgcgcatacctagcatactttggcttctacataccattctccactaaaaggaactactagcattccttggagaaatggttgattccagggcaaaggcagggacaaaatgagcctaaaacatagtattgtgccaaaaagtaagcaagtgttcaaaggataattgagatatgtcacaaacatgcagaaggcagcttgaaggggcttctactggtgaaatccaggacaatttgagcatcaaaataaataataagagtaatgggttataagcctatgaattgaaagtctcatgaggaatgggcaaaacaattataaagggaaaaaaagtcttcccgacatgcctagcaaaccatcacctttatcaagtaatcaaagtgaacaccaacaggggcctggcacagtggctcacgcctgtaatcccagcacttcgggaagctgatgcagaaggaccccttgaacccaggagttcgagaccagcctgggcaacgtggcgagaccctgtctctacaaaaaaatataaaaattatccaggtgtggtggcatgcacctggggtcccaactactcaggaggctgtggcgggaaggttgattgagcctgggaagtcaaggctgcagtgagctgagatcatgccactgtactccagcctggccgacagagtgaaaccctgtctcaacaacaacagcaaaccaaagtgaacaccaacagtaagaggacaagtcaaaactgcgagccacttgtcaagacactatgaaaaaagcaccattgctgcaatactcctgccagaggtgaataacctgaatctacgcatgagccatcagacagacccaaagtgagggagaatctacaaagtaactggttttcactttcaacatttttaaggccacaaatgtcacagatcgagaaatttttccatttaaggagactaaagagacatgacaacaaaataaaatgtacacatctgaactggatccttttgctataaaagacattgttggggcaattggtaaaaattgaagagaggataaggattagatagccataatacatcactgttaattttatgatagttttacaagagaatgtctttctaggaaatacatagcaaagtatttgggggtgatgggtcatcatgtcagcaacctattcttaaaaagtccagagaatccactcagttctggggcaaaaaaaaaaaaaaagaagtccagaggaaaaaaagttatttgtactatacttcaacctttctttatgttttaaattgctgcaaaattaaaattttttcaatgtaaccagcaaaaataatttttaaaaatacatatacttattcccagataaagaagcttttatctctgacgttaataaggtaaactcttctaaataccttgttattccctccctgtacatttttttaatggggaaaaaagatttccttattttatgagactccataaacttcacaaaaatacatgatggaagggggatgaacctaattaaatttctgccccacttctctgataatttaattccagaaaattattttagaatcttctactataaagagattatttaaaataagaaaggctatatacaacattacataaaataatatgtataatctttagataaaatacagcacttggaaatattttacaatcatcaccatcattctttttcccttaataatctcccttgcatcccatgcttcagccaaaatgaataattttgttgcccacatgttccacattctcttccctttctcccttttttcatactgttgtttcatctggaccaacctttaatcatctttgtgtttccaaatattacctatccttcagttccaaattaaaacaccacttcccttcccaaagattttccctgatcactctagctggaggtaaatctttctcctattttatactatagttacatgtaaactagtaacaacagaaactaagtcttatttctttttcctttttttttttttttttttttgagacaggatctcactctatcacccaccctggagtacagtggcacaatcatgactcactgtaacctcaagctcctgggctcaagtgatcctcctgcctcagcctccttcctgagtagctaggactacaggcactaatactacaggactactactgagtagtattaggactacaggtacgtgccaccatacctggttaatttttattttttgtagagacagggtctttctatgttgcccaggctggtctgaaacttctggcttcaagtgatcctcctgccttggcctcgcaaagtactgggattacaggcatgagcaactgcacctagcctcatttccttatatctcaacacaatacctaacctaacacagagactctgaatggaacactgcaattgctgattaaatgttcatctaatagacaaaaacaaatggaaaggttgtgcattaaagaacatgttttgctaatataaaaataatatataaagtggatcacctgaggttgggagatcgaaaccagcctggccatcatggtgaaaccccgtctctattaaaaatacaaaaattaggtgggcgtgatgatgcatgtctgtaatcccagctacttgggaggctgaggcaggagaactgcttgagcctgggaggcggaggttgcagtgagccaagatgtgccaccgcactccagcctgggtgacacagtgagactccgtctcaaaaaagaggtaaaacattttactttatcattgaaagtatttgaatgccctcattactgagattcacattcaacaactcctcagttacgtctggaaactttcaaatgtgtatgcctgtggcagggagtagtaaggtgggggtgggaaatataggcattgttaaatggttgctaactagggtttaaaatactgaagtttatgaagtggcagggtgtgtggggagctcagaggaaacaaactgaaagaatgagcggaaatgaaagttcggaagataccgtgttagggaggaagttcaggtcactttcctgctagtgcagtctttcaaggcatccactgcactttcaacgaatggaataaactcccttttgtgaagaggtattttttttcccctcctattcatggtggttattaaacaaacgagatgctaggcaaaacaaacctttctttgtaagttactgatttctaaccataagtaggtaggaatgtcccagaagagaattgctttcggagtgattctgagcccatcaagatcgacagcagttcaggtgaggtaaggcggcctgcaccgcattagttcacatgctgaacacataagctaaagcaaattccaacttctaaagtttctgctataacacctcaggaataaatagtacctaactccctctatagcttattttaaaggaaaagactatttttcccatgtcatactcaacaccatctttcattcataccttttcttaggtaccttttttttttttcatttgataccagctctttattagaaaagaaaaacttctttgtgggcccaaaaagaatcattttgctgggtgtggtggctcacgcctgtaatcctaacactttaagaggccaagcaagtggattgcttgaacccaagagttcaacaccatcctaggcaagatagcaagaccccacctctaaaaaataaaaaataaaggtggaacaatatgtaacaggtgagggataaccaaaacttgccatataaagacaataagaagattttaacaattaacaagattcatttttcaatggcttgttaatcacagaacaattaaaaagctaaataaaaaccaatcttacttatgtattagaaatatatttcaattcacccatggatccaacacgcttttagacagtaaaatttttactgacttaagaaaaaacactgccggttgggcacagtggctcacacctataatcccagcactttgggaggcccaaggtgggtggctcactgaggtcaggagtttgaaaccagcatggtgaaaccctgtctctactaaaaatacaaaaattagcagggcgtggtggcgcacaactgtagtcccagctagtcaggaggctacggcaggagaatcacttgaagccggcaggcggaggtagtagtgagccaagatcacaccaccgcctttccaccctgggcgacacagcaagactctgtctcaaaaaaaaaaaaaaaaaaaaaaaagaaagagattttatggagtgtttttttttttttgagacagagtctcactcttgtcacctaggctagagtgcagtgacgcgatcttggctcactgtaaccttcgcctcctgggttcaagcaattctcctgcctcagcctctcgagtagctgggattacaggtgcccaccaacacgcccagctaatttttgtatttttagtagagatggggtttcaccattttggctaggctggtcttgaactcctgagctccggtgatcctcccaccttggcttcccaaagtgctgggattataggcgtaagccatggtgtccagccaaaaacactgcctattaaactcatgtacttatgttatgcttaaagagtattgacagaattctcactgccatgtgtttcatgtgaaagaaatggaaatcaggtggggtgtggtggctcatgcctgtaatcccagcactttgggaggccaaggtgggaggatcacttgaagtcaggagtttgagactagcctggccaacatggtaaaaaacccatctctactacaaaaaatacaaaaattagccgggcatggttgcagacacctgtaatcccagctacttggaaggctaaggcataaaagctcgaacccaggaggttgaggttgcagtgagccgagattacatcattgtactccagcctgagtgacagaacaagatgccttctcaaaataaataaataaaaacataaataaataaataaataaggagggagagatagtaggtagaaatatagaaaaacaaaagtgtccatgagttgatattatggaggctaggtgacatatgtaacagttacactatttctccaaataaaatgttaaaaaaattattacattctttgaactattggataaattcagaaaggagagagataactctggccaattatcttgagacagccagaagctactggaattctaagggatcagagaagaacttttctctaattaccctagaccaggagtgcattagccaaaagtttaacagacatttgaacttttttttttttcccaaacaggatctctcactctcacccaagcctgagtgcagtggcatgatcatagctcactgtaacctgaaacccctgggctcaagcgattctcccgcctcaacctcccaaagtgctgggattataagtgtgagccattgcacctgattgatttggacttttataaacttcaaagggacttgtaagtcctacaatctttagaatggccccatagcccacacttcccaaggctctcaaacactcatcaaatagtaaatatataataaattaagaaaggaaaagatttagtaattccagaatggaggccttaggaagggtaaatattgttataccctgccatcaatgttttccttatattcttcctaaataatttagttttaatattctaactgttgaaatggaaactatacttggaaaataataagtttgtttttgctcattatcacagaagttaggaaatatttaaaactatataaagccatgaggtagtaatatcctacaacttaattcagataactcaactccttccttattttagttttgtgcatgttttcaaacttcttttaactgaacaaattcatgcatgactgaagggagccccaacctacaacttttcctcgttaagctactggaaggtgacaaaaatagaaacggtagaggtggtctatttatagactacagaaaacactcagagtataaatatatcaattgttctctatcaaaatttaacatatcaattgtgctctatcatattatttgacatcctccacctttttcttttttctggagtgacttacttttttttttttttgagatggagtctcgttctgtcgccaggctggagtgcagtggtgtgatcttggctcactgcaacctccacctcctgtgttcaagcgattcttctgcctcagcctccagagtagctgggactacaggcgcgcgccaccatgcccagctaatttttgtatttttagtagaaacgggtttcaccatgttggccaggatggtctcgatctcttgacctcatgatctgcccacctcagcctcccagagtgctgggattacaggtgtgagccaccgcgcccagcaatgacttataatactatgtcatgtgacataactggcattattcagcattgttgtattacaacctcgtttctcaaattagaatttaaggcaaataatgaagtattaggatcaaatataaaaattcagatgaagacataatcatatacctatttcttgattttcatgagttgtggctctaaaagagaggcttgttaaacataacatagttgtcgcatgataatcacacctgcattgctaactccacatctgaacagaaaagaaacaaaattaacttcttatccaagagcaataggtaacttaaatgtcactttcattttactttaaaagtattttcaggattaaatttaaatgtaaatttctccaacttctgatggattataataatttaagctaaataataaagccatccaaatgaagggcctactatccaatgtcaacattctgctgtgggtcaaaccttgcagtctgagaatacactgttcttccccagctgatacagaagactaagctaaagaaggtcaataacaatgtaaaaataagactgcatgttagaatgatctctctagaaccacaatttgcctgtggttgcatgcactgcagtttgtggtgagcttatttgcatgcagacagcactttggtatagaaccagagaacctcctgtatgaggatcctagagatcatgtaatccaagcttctcattttcagaagaaaaagagtagagattagatcattcatccaagatcacataactagctggcagtaaagcttctttccatttcatcatatataaagagaaaaattattttaaaaggaaaaggtttctcttacaaaagtaattaaaattccagctgaaagatattaaactatctaaattaatgtcctatttaaacttcacattccaatcttggtgacatttaaggaaaaaaaaaaaactttcattcacgcaagaagtatttattgaatgcctaccatgcaccaggcccctggcaaggttctaggaataaaaacagtcagtaccgtgacaccttcttaggaatcagattaggaagacaggaattatataaccatacaaatgcaaaattataaattatagtaagtactataatggagttctaacagattacaatgggagaacctaattttaaattgtttgttggaggaggacaatgattagaataaacctcactgaggaagtgacctttatagtgagacaggaaggctagccaaataaacggtggagataaaaatgtttcaggcgacatacgtatatactgtgatccagcaattccattcctaagaatacagccaacagaaatgtgtacatatatgtaccaaaaaacatgtacaaggatgttcatacttgtgtcatttataatagcaaaattggaaataaagcaaatgtcaacaaaacagctaaatattttaatattcataaaatggactacactgcaacaaatatgagtaaactactgccacttgctacaacatggatgatttcccatatgtcaacatggatgatttcccatatgtcaacatggatgatttcccatatatcaacatggatgatttcccatatgtcaacatggatgatttcccatatgtcaacatggatgatttcccatatatcaacatggatgatttcccatatgtcaacatggatgatttcccatatatcaacatggatgatttcccatgtcaacatggatgatttcccatatgtcaacatggatgatttcccatatatcaacatggatgatttcccatatgtcaacatggatgatttcccatatgtcaacatggatgatttcccatatgtcaacatggatgatttcccatatgtcaacatggatgatttcccatatgtcaacatggatgatttcccatatatcaacatggatgatttcccatatatcaacatagatgatttcccatatgtcaacatggatgatttcccatatgtcaacatggatgatttcccatatgtcaacatggatgatttcccatatgtcaacatggatgatttcccatatatcaacatggatgatttcccatatatcaacatggatgatttcccatatatcaacatggatgatttcccatatatcaacatggatgatttcccatatgtcaacatggatgatttcccatatgtcaacatggatgatttcattgagtgaaaggagctagataccaaagaatacacagagaatgactccatttatgttaagctgaaaaacacttaaaactattccatgatgtaagaggtctgaatagtgattatctttgcagatcataataaagataactgggaaggagcatgaggggattattctctggaaagctctctggtatgctagtaataatattctatttctcaacccagttgtggtaataagggtatgttcattctataataatatatcaagctgtatgtttaagatttatatacttttctacatgtattataatttaaaaagcttattattttaaaaaaatacatttgagcagacggaacagcatatgtaaagaccctgacgccagaaagaatttggtacattcagaactgaaaggcggccaatgaggttagaacatagaaaccaagaggtaaagtggtaacaggttgaagagggaagcagaaactcgattttattgtaggtcatcttagagtttagattttaacttcagtggccaatcactgaagagtattaggcaggggattaataagatctaaaccatgttttttaaaagactggggtgtaggcgtggtaagtagaagcagagggaccagttaaggagggaattgtaatgatccatgaaagagacaacagtgtcttgattgaaacagagccagctaaatgcaggcagttgcatggaatctcaaggaaattaagaggaggaattgactagacttggtaatagagagaatgtgtgaaatgtgaggggaagaggtgttgaggatgattcttaagttgtttgaaacaacttggtagatggagtgcaatccattgacataagggagactgaaggaaagatcaggtttgaggatatgcagtggttggtaagaccatcaatacggtacctattccaactcttcctcatttggtagccaccaaacagtttgtgatactatggaaatcacagaaatttctaccttcttctgccaatgatctacctgatgcaaacagcacatgatatctcaacagtcatttttggttcaggaatacacaaacactcaatccggtgcaaggggaagtgcattttccttttgtgggttctaacccattatctgagtttcaaaaagctggatctcaattgtgtcatccaacataattattcaacccagctctcatcaatcctacgtcactttgccacaactaaaaatctgaaaactgtactttctactccattctctaagagaattgataaaactgggaacaagataggccaaagatatattcccaatgctaaccaaggaaagacaactaatgagcactaaggtacaaccagctagaaatttatttaattataagattctggaatttaaaaataaaaacaaaaagaggccgggcacggtggctcacgcctgtaaccccagcattttggggagctgaggcaggtggatcacttgatgtcaggagttcgagaccagcctggccagtaaggtgaaacctgtctctaataaagagatacaaaaatcagctgggcatggtggtgcacacccataatttcagctactcgggatgctgaggcaggagaatcacctgaacccaggaggctgaggttacagtgagccaagatcatgccactgcactccagcctgggcaacaaagtgagactctgtctcaaaaaaaaaaaaaattgaaaaaagaagattcattctacttatagttcacacatggtccacaggatattaaatgattttgtttatctatatttcagcaacacattcaagagattacagcaatcctatggtccactagtgaacagaatgaaacataactcataataaatatttattgctaagagctagttatataagtaaacacacctttatatataaaaagttaaataagactataatgaaatagaaacacaaaattttaataagtacatttaacatatagaaatatttaatgttttgagacaataaagtttttttttaatttttttcttttcactgactcagttggcccagaattatccaggaatttcaagggtctaaaattttttcattctgaactgaggaagtaatgagtatccaaccaagaagaatttatatatctctccaaatgccaaatttattttctccaagtgccaaatcattcatcatttggttcagtagctatgaaatgcaacccaatgtgaatgcatgtgctcacatacgtaacactactgatcagcaatggcttatatttataaactctatttaagctggaaaaagataaaatacaaattcttattaacaaccattaaaacactcaaagcaaattttaattgtcaccagtaaaaatcatgcacaatttttaaaactatacttccttttgatactctaacaaggctaaacaattgcactagcccattccactctttattgcttctttcactttgtatgcttctttcaaaatttcactgattcagactttataatctcaaaagttttgaaaatgttggtattggatactaagaaaggtaatactacaatattaaactgctagtcattataattagctcatattttttcaaccttcgaatgtctgaaaagtctttacatcttcatttgtggttgggtacaaaactctaggtgaatggtttggtttggtttcttccttccagtactttaaagatgttcccaatgtcctctggcttggattgcttgcaaagaaaagtctactatcattcttatcttcactcttctgtaaatgtgtgtcttttcttccttgggctacttttaagatcttctctgtatcactggtaaacagtaacttgatcatgtatttgggtatagtgttctgctttatgttcatttagcttcttggatatgtggattcatagctttcatgaaatttgcaaaagtgccagctattatttcttcaagtgtttttcttccctaccaacttctttctgggatccacatattcatgtatattgggtcaccggaagtcgtcctgcagttcactgatgctctgtgtatttatttattttagccttttttctctctgtattttattttggacagtttctattactatgtcttcaagtttgccaatcatttcttctacaatgtctaatatagtaatccctaccacatctagaagtctaatttgggtctttcactttttttttttttagagacggagtcttgctctgttgcccagactggaatgcaatggcatgctcttggctcactgcaacctccaactcctgggttcaagtaattctcctgcctcagcctctcgagtagctgggattacaggtgcctgccaccacgcccggctaattttgtatttttagtagagatgggatttcaccatgttggccaggctggtcttgaacacctgacctcaggtgatccgcccacctcggcctcccaaagtgctgggattaacagtgtaagccaccgtgcctggcctctttcacatttttcatatctcgtcttaacaggttcattttttcctctacttgttgaacatatggagtatatttacaatagctgttttaatgtccttgtctattacagcatctgtttctacatttgactttgctccttatgaggtatattttcctatattcctataaatattcttaaacttcgttctgggatacagttatttggaagttcggttacttggaaacagtggcatccctttgggtcttgcttttaagctttgttagggagggctggagtggaatttagtctaggactactttgcccctttactgaagcagtataccctttgcagtactcaacctaattctccatgcaggacttctccactctagttgttaaacatgaactattcccagccctgtgtgagctccagaaatttttctgcctactcctttttggtgattctttccctgcctcaaatggtttccttacacactggcaccgatcaacactgagctgaagtctcaaacggagtcctctacagatctctggagctctttgtgcaactgtctcatctctagtacacagccctgagattctggctgccttggcctccccatattccctactcaggaatcctgtcaagctttgcttgagtgactcttctgctgctgtggcctggaagctctccaggcagtaagctggagcattcataaaacccacctcatttgtttcccttctctcaggggtcagcatcttgtgctgccttttgttcaaggtctgcaaatcattccatgtattttgttcattttgttgttgttacttaaggtaggagggtaaatctagttcctgttactccactatggtcagaagctcccgttatagtcctgagttacgtatattttataggacaagttagaacatctgatagacctgagatgatgtaataaaaagccacagagtttttactattcagtgagagtggaagttctgcctttcctttttatttcctcatagcaaagttaagtggtgaagaaatgaaagcacttaagaactaactactggtttgaccctaggtcaatcctactaccaacccagaataaaaaagtttggttgattttctttttaaagagttgacatttaagttactttctattaaatacgtacattcctcagactacaggggcacataaaaaaagaaagaaaataaatatgcaccttccaaaggtatttataaaaagaaaatgaatttttgcaaccctaacataaagtgatatataacaagtctaaatttcatgatttctctgctgaaaaagtcaactataaaaagtcacttcttccctcaacttgcaaatttttctttaaaagagacaggacactgcaacttatctaaagggcaatcatgttgacagcgtttggcaattaaaaaaaaaaaacaaactacacacactgtttggcattaccacctactatatttatccaaaagtctagaacctgacatttaacttggcccaggaaagaaactttgtttttaatgactttactgtaaattaaaccatactttctcctctaatatattaatatgttaatagtttgtagggaaaaacacaagtgtacagttccctcattagaaaatgctaccaattacactcttaaccttaacgccttcccttatttttacacttcattccccacccctgaaaataatagccacacaatatatggtaatacaatagcctcacaacagcacaaacaataattacagtaaaaaaaaattaaatggtaggactatgtcattggggcagttatctttccaatcctcagtttccaaatctctgaaatgtggataaaagcacaatctgaactgaatgaaataaagtgtgtcaaatgccacatctcctgaactgtgtgctcagatgccccacggcactacagcaaactcccagggaagctgcatattttaaacagaaggaaacactgagattctcaacacatgctggaaaccagccaaactattaacctgaggtgcttgagttgtcatattagattgcagtgcattccttggatgatatatattagtgaaaccgggtttttgctggttgctgtgataaaagcaagtgtcacttgaaaatcaatgtggaacaggaaatgaggacggcagtgtactctgttccaaggtttgaaaagctatgcaggctgggagcagtggctcacgcccgtaatcccagcactttggaaggccatggtgggcagatcacctgaggtcaggagttcgagaccagcctggccaacatggtgaaaccccgtctctactaaaaatacaaacattagccaggtgtggtagcgggtgcctgcaatcccagctacttgagaggctgaggcaggagaattgcttgaacccgtaggcagaggttgcagtgagccgagaccgtgccattgcactccaacctgggtgacaagagtaaaactccatcttaaaaaaaaaaaaaaagaaagaaaaagaaaagctatttagtgctcagtgctcaacaagcacacacatctcattagtaaattgtggttacttatgaagaaaataaatgttctattttttctgcatttttttttttgaacagctacaaaagctgttgggacacaaatattttttggacctaactatttaataaacagaactattaagtattgtttgtggcctaggggtgttgtgaaaaacttaacgaggccaggcacagtggctcacacctgtaatcccaggactttggaaggccgaggtgggcagatcacctgaggtcaggagctcaagaccagcctgaccaacatggagaaaccccgtctctactaaaaatacaaaattagctgggcgtggtgccacatgcctgtaatcccagctacttgggaggctgaggcaggagaactgcttgaacccgggaggcagaggttgcagtgagccgagatcgcaccattgcactccagcttgggcaacaagagcgaaactctccctctcaaaaacaaaaacaaaaacaaaaacaacttaatgagataataaggtcaccataaaacaatgaagtttaaaaacctctggcttaatgttgtgactggcagaataagcttccagtaagtggtagccattatcatttcactacgattagtcctttacgcagttttatagaaaagagaggatatttcatattctgtaataaagatctcagaatatcatcctatagtattatgacttatattgagtattatatatagtattatgacttatgttgtaagaaaaaattaggtagacaaagaatctcataaggacaacttggaggaaaaccaggtgcagtgatatggccttgctatttataaaatgcatgatttgagtcctaatctgactcaaattatgctacttgaaaagcctgaaagtaatcttaccactagacagataaaagcaattcatccttactcccatgctagcatgtaatatggaaaagagcaaaagctttaattttaagagttaggaatccatggcgccacctcacctccccatcttttacgtagaggtccataacttctgtttttagagttatcctccatttcccatatgttgaccttttctttactccatcttctatttaggatataattatgaaatgaatcattcactttattgaagcctgagatgggctgtaaaatattgagattgtgaatttaatgcatgtatgtcagactgacagcttgtccttctcctgtgacagtctttgtgtatgtgtgtgtaaactggagaaagactaagaacaatgaattgtacacaaagctgagagacatcttttatctcttaataaattgtttccaggaaaaaaatatgtacctgtttataacttgctaaccatcacacaagctgcttaaactggtagatgcagcaaactagtcacagagctcacctgctacactgaaccactattccaaagacatcaaattgcaatttaatcaaacacttgctgtacaaatacttttcaaaactgagtaatgctaaaaatgggtacactcctaaaaaacatattaactgttatctaagggtaagaactttttagaaagtgttttaaataaatcaatgcaacagaagaaataataatgaaattattttctattttaaacaggtaattttgaaggccaggcgtggtggctcacgcctataatctcagcactttgggaagctgaggtgggtggatcacaaggtcaggagtttgagaccagcctggccaacatggtgaaaccctgtctctactaaaaataaggaaaaattagctaggtgtggtggggggcgcctgtggtcccagctactcaggaggctgaggcaggagaactccttgaacccaggaggcggaggctgtagtgagtcaagattgcaccactgcactccaacttgggtgacagagcaagactccatcttggaaaaaaaaaaaaagtaattttgaaacaaattaatagtacttatagaaataataagtaacatttatcatagacatttcaaattggcatttcagaagaaccttaataatgtggttaacagttatttccaataggatttgtcaataacaaatctaaataatgtgtaatatacatcttttatatcagcagttcagtcagataacaattctcaaaaacataggaaataggccaggtgcagtgacttatgcctgtaatcccagcactttgggaggccaaggcgggcggatcacctgaggtcgggagttcaagaccagcctgaccaacatggagaaaccctgtctctactaaaaatacaaaattagctaggtatgatggcgcatgcctgtaatcccagctacttgggaggctgatgcgggaaaatcacttgaacttgggaaggggaggttgcagtgagccgagatcgtgccattgcactctagcctgggcaacaagaatgaaactccatctcaaagaaaaaaaaaaaaaaaaatatatatatatatatatatatatataatgtatgcatgtatgtatatgaaataagttttatagggctgggcttggtggctcacgcctataatcccagcactttgggaggccaaggcaggtggatcacttgagttcacgagttcagatcagcctggccaacatggtgaagccccatctctactaaaaatacaaaaattagctgggcatgttggtgtgcgcctgtagtcccagctactcaggaagctgaggcacgagaatcacttgaacccaggaggcggaggttgcagtgcacggagatcataccactgcactccagcctcagtgacagaacaagactctgctcaaaaaacaacaacaaaaatttacggaaaaatatctcttattttcaaacataataactgcatgtttatcaactttgtaatctaggttagtctttcccttgctgtcattcatttaataatcacattttcttcaagtatgagtaaaacactacactaagcactaagactgcaaatattactaagacacacaggccttttcctcaaggagtgcggcatccagacacagaacctgagcagaattccatatgatatgaaggcactatactcaaagtgctacaagagtattagcacttggttcagcctgacagtttcaagaaaactacttagtagccccataaaagacaacagcaccaaaattctggaaacatggttattttggataaaatctgcaagccaaaaaaaagcaatcccctaatctatcatagaaaggcctaaatacactttgctcagaaatgagcatcacaatctaattatatcagaatatccagggggctagagcccagacagtagtatttgtaaaagctgcccaggtgactgtaacactgataatgtcataacatcatgactgatttaagcttagaatcctatcgacataaagacagagtcttgaggctgcattagtgaacacgtgggtccctaaggggatccattgtatgagactattttcattgtatttttacttgcaatcttttggtatgtgctaatagtatgaaagacaaaatttcatgttgggtatctcatggcacttcagcaaaggccaagaaaattaagtgattgctaatcctcaacactgtatgctgactaaaatgtctgtttaaaatttactttttaaagtaaagccagggcaagtagagacttgaaattaggaactttgtgtacataaagaccaagtcctgctaaggtcacttccaccacccctttccaagaaaaacacctacatatgagcatttagacaacaacaaaaccagcacataagaagtatgcgtcttggctgcgagcagtggctcacgcctgtaatcccaatactttgggagcctgaggcaggtggaaaccatgaacccaggagtctgagatcagcagggcaacatgaggaagccccctatctacaaaaaaatacgaaaaaaattatctgggcatagtcgtgtgcgcctgtagtcccagctactcaggaggctgaggcaggaggatcaattgagcccgggagttccagggagttcaattacagtgagctgtgatcatgccactgcactccagcctgggtgacagaacaagaccatgtctcaaaaaataaaagcaaaaaagaagtatgcaccttgtgatacagagtaagttctagagaaatgaagagaaggtagagataaaggtgagctggagtggttggggcagagtcttatgaaggaagaagacctgagtaggacctcggtgggactgacaggctcagattagagaagcagcactctagctgtcttggaggaagaaggtgtaaaaagcaacagtatgatgaagctgaaaaaagcatggtgcttgggaaggcactgaggaaacaccagatctccttaaaggagatcaacactggacaaatgacaggttgaggagtacaaacttaatcttggtgaaaaacagggttacactttgctttaatataaaaaatgattttagggctgggcgcggtggctcacgcctgtaatcccagcactttgggaggctgaggcaggcgaatcacctgaggtcaggagttcaagaccagcctggccaacatgatgaaaccctgtctctactaaaaatacaaaaattagcaaggcgtggtggcacacacctataattccagctacttgggaggccgaggcaggagaaccacttgaacccaggaggtggaggttgcagtgagccgagatcatgccactgcactccagcctgggcaacagagtgagaccctgtctcaaaaaacaaacaagcaaacaaacaaagaaaaaacatgattttagaagattcttcaggtagatgaatatgcagaatgcactgaaattcagggagctgggattattgaagatgaagagaacacattgatattttccaagcacagcttctgaatacaataggcatttttaaagtgtgaagattttaagtgaacactgtacagcacaatacaaaccttggtatcactccaaaatgaaggccaaattaattttaaaagtcaaatgacttaagaaggtttgttagctgcttaaatattaatatgttaagtattactgtaaagcttatagtaggaaagataatgacattccaagagattagacatccatttatgttagctttacagaaagagtcaatattccaacattttttttctgaattgctcacatagtctaaatctaatgaaaatagaatagcttagacaatattttaatattctttctccttagaatgcacattaatgccaaaataaatgttttagggccttttggtaaaaacaaaccattatttggcataaaagacggctgctggaggttttggaaatattattattcttaggtttcctaaccttggagtaaagtgtagcaataattctaaaaactataagtaatacacagtttgtagctgaacatttgacttgctattatgagtaatcataattaaagaaacatttagaatttatacaagattagtaagtcaggtaacgtcaccaaaaaacacaagcagctgaaaaatgcttcccatacaaaaacaaacattcgccccacccaacccccacaatattttaattcagaattcatcagtataagaattccacttgtagtaaaaaatatatgcaatggaaattaatactgtaccaaggtatagtttaaatacaaaaaacaacttgaagcaattaagtccatactgattgagtatagccaatattatttatacttatttcttggaagacctagagccccttctccttcattcaaaaaatatatgtaccaaatatatatttcttatata

SEQ ID NO: 195 - DNA, 180807 bp, Homo sapiens
tagcaaaaaggaccctatggtaaacaccctgcctaatgaggtttgaaagacaataaacgagactgtggttggcaggggttctccagatgtagacagcaggctctcctgggccatgccctttctgaatactcagtcaagctgtgctatctccgtgaggttgctaattggaagcaaattctgaaagccaccccactttggaatcccagagaggcctggagatgagtttcctttaagacaaggcaaggaaccatgggtttgttctaaattttcaaggacatggaatcctttgaaaagatttcttaagggagcaggtgcttggctttggcttccgtccccattgagtccaaacctgagagcatcgggaaagcggaggtgggactccatggtggtggggggtgttcccagggagaagctgggggcgcttttcctgccctgagcactctccatcctgggcttctgtctctgaatcagaaacaaaagttccagggaaaacccacttcaaaatctgcccaaacgaaaggctgtgagaataaggagatgttgtcaaaaaatatgtctttatggtttggatctgtgtccccagcaaatgtcatgtcgaattgtaattccccagtgttggaggtggggcctggtgggaggtgagaggatcatgggggtagatttctcatgaatggtttagcaccaccatccccttggagctgttctcgtgatagtaagtgagctctcgtgagatctggttctttaaaagtgtggcatcgcccccagctctcttccttttgctctggtcatgagaagtgctggctccccctttgccctctgtcatgattgtaagtttcctgaggcctccccagaagctgagcagatgccagcatcatgcttcctgtatagcctgcagaaccatgagccaaagtttaagaggtttagcctgttttctttataaactacccagtctcaggtatgtctttatagcagtgtaaaaatgaactaatacatacatatctgtcagaaaaagatacaacatttaataacgatggaatgtaaatatcaaatatttttatttacaaacaaataaaagtttttatatagaactaaaatgatttctataacacctgttttcactgttcttcaatatttctcttttaacttttcaaagattttctttttaaaatttttttttgtagagatgggatctcactatgttaacccagtctggtctcgaactcctggcatgtgatcctccctccttggcctcccaaaatgctgggattacaggcaaaagccaccacgcccagccaagattttctttttttattgtctgtatttaagatatgcaacaagatgttctgacgtacatatgtggagtgattaccacagacaagcaaattaacataccgttaacatattacaccaaccattaacatgtccatgttcgtgtgtgttttgggggggggtatgtgtggtaagagcacctaaaacctactctcttggcagatttccagtatgcaatgtgtacaatgcttataaacatttttctttattaaaacaaaacaaaaaaccgccacatatatggaaagagctgtgctggatgcctaaggaggaagcttgatggttctaagcaaaggccaaaaagtggtctgatctatggaaaaactggaaagccggcaaaatttgctgtgagagccctttctctgctcccatctgtgctgatctgcttttttcctacaagagcccattggccttttatagttcctggggaaaatgaagcccccacggttgtgcctccttgagttccaggacttccccctctccttcccatccagttttaacccccacacacctgtggcctgcacgctgggggttcttttctgtttcttttgatcctcttcctctttgaaaatcatctttgtaaaacaaacctaatacggcaccatttccgtccagattcatgctccaggaagaaagggtgctggaggctacaggggggcctcacagcccatgtgatctctgtgttacattcattttccactaacagaaatcaaagaacataccctgccattcggcctgtgacaggggtctttgttaactttgggtcttgctaaagttcagtaatgtcagggcaaacagaacacaaggaagctgagacgttctctggctttccgttgcaaactaggcctgttgatgatggtgacaagcttctcaatcccagaagcatgaagccagcaaggctgggaaagcaccttgggggaaggctccatcagaagagaatcaactttatcaaaacttggtttgctctatcacagcagcggcatttcagaagcatcctaccaagttgcttgtttcattgataaactaaagaaaccctacatgtttggagagttcttggtgaggcctgttcattggaagtcgtcatgcttgtgtgtatcttagagaagaagaaaattccagtagttcctcagtcaaatggtgtaatccactccagaatcattgccatctcttctaatattctgaaccaggcacagagaaagtagaagctcagtgcatagctaaatgaaattaccagagattctcaatgcccccatttccagcttttcacaaaaccattgtgctcacattaatagcatcaaggaaagcttcctactctgtgagctcaattagaaacgtcatgtattgttaatggttttgaaaaggtgaaaactttcttttccagagtctttttcatcggaatgataatcttagtaccttgtaaatagatgaggtggttgatttcatcacagccagaatctagaattatcaccattcttttgggatacagtgagagcttttttccagccagacacagaatgggcaatacaggtaaggtccctgttgtcatggagctcaagttctgttagagacaggaaagaaaaaaacaatcaataaaacaggaaaacttcataattcaaagaagccacgcacagctgtgagactatgcacaggcaccattcacactgtagactaagtgacagctgcccccgggttaagccctgccttgcctgggcaacagtacatggcatccccacacaattcagataatacaaagtgctatcagggaaatgtgaagaaggaagaagctgtgccaagattgggggaaaagcattagaggcagagagagcagcgtatgcaaagatgctgaggcagtccgtataattgcaccatgaagaggtccctgtcctaatctctggaagctgtgaatatgttaccttacctggtaaaatggactttgcaggtgtgattattaagttaaggatcttgagatgggaagatgatcttggattatccagatgggacaaatgcaatcacaaggctccttataagaagcaggcagggggctcagggagtgggagaagatgtgatcacaaaagcagaggctgggccgggtgcggtggctcatgcctgtaatcccagcactttgggaggttgaggcggacagatcatttgaggtcacgaatttgagaccagcctggccaacatagtgaaaccccatctctactaaaaatatacaaaaattagcctggcatggtggcaggcatctgtagttccagctactagggaggctgaggcaggaggatcacttggacccaggaggcggaggttgccgtgagtcaagatcgtgccgctgcgctccagcctgggtgacagaatgagactctgaaaaaaaaaaagaagaaagagaaagaaggaaagaaagaaagaaagaaggaaggaaggaaagaaagaaggaaagaaagaaagaaagagaaaaagaaagaaaaaagaaagagaaagaaagaaaaagaaagaaaagcagaggctggagggatgccaggatgccagggagagggccaagagccaaagaatgtgggtggcctctggaagctgcaaaaggtaaagaaatggattcacactccctcctcaacccccagagcatccaaaagaaactggctctgctgccatcttgatgttaacccagtgaaatccactttggacttctgacccccagaactttaagataatattataaatttgtgttgtttaagtcactaagtttgtggtcatttgttataacagcaatgggaagctaatacagattcaaagacaaaaacaaaacaaaaagcagagaagcaggatcagactatgtgagaagatgagctcgcagaaaggaccagcggccagtttttccatggcctggccagctgcactaagcattccgggttttattttcagggtgaaaggaacccaatggagagtttcaagcaggggaattgcgggctgtggtttgtgtttccaaaagatcccactggtccctcttagaaatatgtgaatagggacagagtgcaaagccagaggcgtgagcggccagcagtccaggtgtgagctgagaagtagctgtgcggggacgtgtttggagagtcaaattattactataataataattattattatttagagatggtgtcttgctctgtggcccaggctggaatgcagcggcatgatcccggttcacggcaatctctgcctcccgggttcaagcgattctcctgcctcagccacccaagtagctgggattacaggcacctgccaccacacctggctaatttttgtatttttggtagaaacggggtttcaccatgttggccaggctggtctcgagctcctgacctcaggtgatccaccctcctcagcctcccaaagtgctgggactacaggtgggagccactgtgcccagcctggagcgtcaaatcaaaacaaaaaaaccaacagagcagtaagaaacatatttcaatttattaccttcggggctaggggaagagagacaagttctaagaggcttttcgtgcaaaaatggaaagaactaggtttaaggcaacagtgagaaatgacaatgaaaaaggcaagcttctgataacagctgtctgtttggctggtgagacggattgtgactcttctttgcaattggccattgtactagtttatggcacaaaaacccaggcacagttttcaaagaagttgagatggggtattaagggtctggtgggttcgatgtcacccagcacaaactcatacacccacgttcaacctgtgcagagtcttttctttaacaggatgcagagtcaacagtatttgctagtgaattgggggtgtggcagggtgaccaaaaaaaaaaaaaaaaaaaagaaatctaagttaattctttggttttttggcttacacaactagaaagaaagtggagtcactttactgtgataggataggagtaggtttggtaggagaattgagttatgtttggacatctgaggttgagatgcctattagacatctgagtgaaaatgtcaagtgagcatcttgacatttgattctgaaattcagagaagaggactggactggagatacacatttgcaagtcccctacaaatacatggattttaaagaaatcaactttattgtggtatagtttacataaaattatacacacccattttaagtgcatggttcaatgagttttactcaggtaaccacctacaacaaccaagatatagaacaattctatcaccctccaaaattgtctcttaatcctttgcagtcaatcttcccctcatctggtcatagaaaactactaatctgctttctgtcacgagggatggcttttgtctttctggaatttctagaaatggaatcaaacagtacaacttctttgtgtctgacttcttttgctcatataatctttgtgggattcatccctgttggtgcatgtatcatttatttgttcttttttattgttgagcaatatttcattgtgtgaataaaacacaatttgtttacccacttatctgttgagggatatttggcttatttccagtttttagctattttgaataaagctgctataaacattcatgagtttttgtgtggcatattttgaaaatttctctaggtaaatacctagaaggggcattgttgggaacttttgatctagttaccaaactgtttacaagtggctgtatcattttacattcctaaggcaatgtatgaaaatccacttagcccacatcctcaccaacacttggtgttgtcagtctttttaaatgtagccattctggccaggtatggcggctcatgcctgtaatcccagcactttggaaggctgaggtgggcagatcaccctgaggtcaggagtttgagatgagcctggccaacatggcaaaaccccgtctctactaaaaatacaaaaattagctgggtatggtggtgtgcactgtaattccagctactcttgttgaggcaggagaatcacttgaaccctggacagggaggttgcagtgagccgagatctcaccactgcacttcagtctgggggacagtgagagattccatctcaaaaaaaaaaaaaaagtagtcattctggtgagtgcgtagtggtatctcattgtaattacaagttatatttccaatgacgttgagcatttatgtgcttattgtatatattttttggtagtgtctgcataaacctactgtccattattattgagtcaattttttttcaaatgatgagttctttatgtattctagatgcaaatctgttgtatattctagatacaaattcatggtggttatttttttcagtatattacttgcctttttattttcttaattatgttcttcaaggagtaaaagactttaataatgatgaggcccaatatatcaatattttccttttatgatccatgtgtttcagtctttgtttcctccatctgcttttaagattttctcattgcttttgattttaagcattttatgcaaaggtgtgactttctttgaaataattctctttgagctttttagttcttgaactcatggcttgatttttttaaaaagcagttttggaaaaaatctcattcactatttcttcaaatattgcttcagcttcagccactttctcctctctttctgggactccaactgtacttctgttagtcctttttcctgtatctctcatactttcttgggtgtatcctattattttgttctgtgcttcactgtagatattttctgctgactagatttctaattcactaatcctctcttcagctttgcctatgctgctggtaaatccatccactaaattgatacatttaaaaaatagatttctgcggagattctatttattcttgggctgactctggaaatttatatttttctggcaaattatatatttcatccaaaacttcaaattgtatttccagagtgactttttatttagttgattctatatttatttgttttctcttttgttcctttctgtttttgttctaaagtttcatttattctacatttttagtttattttttggttcttttgctttttgagtttaatgagttcctattattttccttttatttatttttattttttagagacagggtttcactctatcacccagactggagtgcagtggcaccataatagctcagtctaacctagaactcctgggctcaagcctcttcccacctcagcctcctgagtagctagggctacagctatgcaccaccattcccagataattttaaacaatttcttttttatagagatagagtctcagtgtctcactatgtcacccaagctgttctcaaactcctggcctcaagtgatcctcctgcctcagcctcccaaagcagtgggattacaggtataagccaccatgcccagcctcttttccttttagtgaattcatttactgtataaatttgcctctaaggttcacattgtctgcatcccagaagttttcaaatatatggcagttcctttgtaatttaatatcttattatttatgtgttttcctctttatccatatgttacgtgatgatatacttattttttggttttcagatatatcaaggtgtacagactatatttttgctgatttataattcaactgcattgtagtaatggaacccagtctacataaagctgatatttaaaaatttggttggacttcttttgtgacccagcacatggtgagtttttaaaaccgttttatggacacttataaagaatgcacatcatttgttggttaggtgtgggttctctccatctattttataaaggtaattaattctattactcaattctatatgtttactttttaaaaaaatctatcagtttctgaaacctaattcctaccattgtgcatgcctcaatttcttgtaaatctgcctgtttcactttgaatattttgagtccatatacaagcccatgattttactatcttcttcgcaggttgtttcttttatcaaattgtagtgacatttaatatcctatggatcacctgaaatttcagtttttcttagatgtctgcattttagccttagcttgatatgttttttcatcaccttattttcaactttttatttgtttttattttagatgtgcatctttattttgtattttattttttgagacagagtcttgctgtttcacccaggctggagtgtagcagcgtgatcttggctcactgcaacctctgcctcccaggttcaagtgattcttatgcctcagcctcccaagtagctgggattacaggcatatgccaccatgcctggctgatttttatatttttagtagagatgaggtttcgccatgttggccagggtggtctcgaactcttgggttcaagtgatccgcccgtctcgccctcccgaagtgctgggattacaggtgtgagccaccagccccagcctagatgtttatcttttaagaagcatatagctagattttattttgttattcagtttaataatacttcttttaataggtacttattttaaaggatattgtgattatagatatattcagatattatcttagtcattggggcagttatagtaaaaattataaactggatgacttataaataacaaaaagttattgctcatagtttggaggctggcaggtccaagaccaaggcactggcagatgcggtgtctggtgaggtctccctctttgattcatagaccgtgccttctagctgcgacctcacatggtggaaaggggaaggcaacctccctgtagcctcttttaaaagggcattaatcgcattcacggggtctccatcctcttggcctaaccacctcccaaaagccctaccttttagtaatatcacatggggagttagaatttcactatatgaattttggggggacacaaacatttatgccacagcagatatctttctaccaccttatttggtgatttctgggttttgtttgtttgtttaagacagagtctcgctctgtcggccaggctggagtgcagtggcaccatctcggctcaatgcaaccttcgcctccccggttcaagcgattctcctgcctcagcctcccaagtagctgggattacggacgtgtgccaccacgcctggctaatttttgtatttttagtagagactgggtttcaccattttggccaggctggtcccgaactgctgagttcaggtgatccacccgcctcggcctcccaaagttctgggattacaggcgtgagccaccatgtccggctggtgatttctgtttaaaagttttttcttaaagtgttttttcccacctagtttttcattgaatgggtaaaacattctacatttgcttttattaaaacaagaaatgaattttgctgcatttcaatttatagattttactatcctacctcgtgccaggttctgtgctaagtgctgtatatatctgtgatcacatttaacttttataacaagccaaatgagcaggaactcttatctctatcttacagacgaagaatccaaagaccagggacagtaagtaatttgctcacctggtttgccagcctccatgacacatcgccgtccagttctgcctttaattaccaaagcacaacacgctgctttgattcccctctcctcggcgccagaattcaagagtgaagttaaaccgcaagggctgagttagaagattggcctcagttccctgttcccaccagcaggtggcaccgtctcctagcggaattcttacttgaacgttttgcttccatttctgcagaggcatggtgaacacagttacaccaccaaagtgttcctcctggctgagtttgcctatcttgttcagtgaagacaacccatgaggacaaatggtgttaatgagaagcttttgcggagttacagagatcctcgtatttctttaaaatacacctaataacgttaactctgcaataatttgtagatcatgttaaatcttagctatcttcctcttgccacccagtgtgcttcaagccacatggttcagagcaccatttaatgtgaaactccaattttaaaacaaagtgaaccttccttttacaaaaccatgagacaagttacagagtaatgaccacccacatgaccttgaagtgattttgagtgagtgagtgtaacttccgtggctgccatttaaattggattcaaatccaaatggctccacctccatgtcatcagacctcttgtgccctgattcccttggctaagttcacagtaccttccacatcaggttgtggcaatgattacctgaggttaatacgataaaagcacatggtaagcactcctaaatgatagccaatataaagactcagttctcccaattccaagggtccccaccatgatagaaaaggatcttttggtaaatagagtatgtttagctcttgctaggtctttaaatactttgctgggggccaggcaccatggctcacacctgtaatcccaccgccttaggagactgaggctggaggatcctttgcggccaagagtttgagaccagcctgggcaacacagcaagaccctatttctacaaaaataaaaataaaaattaaccaggctttgtacacacttgtagtcccattacttgggaggctgaggcaggaggatccctcaagcccaagagttcaaagctgtagtgagctatgattgcgccactgcactccagcctgggtgacagagtaagactctgtttcaaaacaacaacaacaaacaaaaacctcaaaacctctttgttggacttaacttccagctcctccatgtagtaccttagtacccttgcagcccgtttctcttttacaagacaacaatgttgttataaactcatttggatgtggtcccgtggaggagtatttaccagaatctagcttatttagcgtcttcagaacacggcacttgcctggaattatactgaccccctcaacccataccaaccacccagagatggctgttcttggctcctctccctggggccctgtccttcccacatcgtcttcttcttctttcttcttctttcttcttccttcttcttccttcttcttccttcttcttccttcttcttccttcttcctcttcctcttcctcttcttctttcttctttcattgagacagagtctcactctgtcacccagcctggagtgccgtggtatgatttcagctcactgtaacttctgccttgtggattcaagtgattctcctgcctcagcctccagagtagcagggactacaggtgtgtgccaccacacctggctaatttttacatttttaagtagagacggggtttcaccatgttggcaaggctggtcttgaactcctgatctcaggtgatctgcccgcctcagcctcccaaagtgctgggattacaggcgtgagccaccccacccagcccttcccacgtattctggcagggaatgctgttgtcccccaagcctaccctaagaggaagacttcttctggggaaagatgttcactgtacccaggccctgccctggctggagctggcaggaagggtcccagagcaggaacttgtgccactctgcccaaagccagagtccctgaggcacacaccccatcaggcaccaaggtgaattccaactgccagttagtatttaactttccacatacgattagattaaacatgtgggttcataaaagcataggattgcagactgcagttgcaagggcttagatggttgtaaggtgaaggtgcccagcaggctgaggcttgtgtgcaacccagaagagagctcgctaacgccagcaagaaggttcagaacagcctggctttggaaaggaatttcatcctgcccacacactgcataggtaagtcttagcacacattctttattttttgaggaattaagtaacaaagttatctatgtgccttttccagaaaatgataaaaggaatgattttcctggtacatggcctggctcctcatccactcttccttctttccttcttgtgttttccttactcatttctttgttaattgccttagaatgaaaattttgagagtttttaaaatggaggattcatggtaaacgtaggtaatcatattgttttctcttcttgatataaaaatgaaagactttgctgccttttataggcccaggtgatgtgagcgatctaccatgtttcaagaaaagaaaactttggggctgggcgcggtggctcacgcctgtaatcccagcactttgagaggctgaggcaggcggatcacctgaggtcaggagatcgagaccagcctggccaacatagtgaaaccccatctctactaaaaatacaaaaaaaattagcctggcgtggtggctggcgcctgtagtcccagctactcaggaagctgaggcaggagaacggcatgaacccgggaggtggagcttgcagtgagccgagatcacgccactgcactccagcctgggcgacagagtgagactccatctcaaaaaaaaaaaaaagaaagaaaagaaaactctggactttggggtcaaatgagtgttactttcctaatagtgtcctgattgctgttgtcatgaataacacacattcatgacaggaatggctggaattaggggatcattctgtagcctggagacagggcacaactaatgacatgtgtaagctcaaatcatggtcttgatcttatgtcttgtacccagttgagccaactggtcacagcaatgaaaacagtgagttattggaatgtgtgacctctgctaggacagtcagtgctggacactggcttgggtgatgtgagttctagtccaggcactgtggccaacttgagaggcttgtgatcttggacaggtgacttaagccctctaggctatagttattccacctatcagagagcaaaccagcctaaatgatctccaggggcccagcctgtgctaggactcagcaagaagcattcactggaaatgtaggtcctcctaggttgatacacatgaattgcccatatttgaccatttctaacctatataaatggctatttcatataattccagagaacataaatggtagttgtcttagcattactaaagtaaatgcctattatgatattctacttaggggtaggataagtatgtataccaaatatggtttgtttcgatttgatttttgagacagggtctcactgtcactgctgagtgcagtggtgtgatcatggcttactgcagccttgacctcccaggttcaagctatcctcccacctcagcctcctgagtagctgggactataggagtgtgccatcacatccagctatttttttatgttttgtagaggtggtgtctcgctatgttgtccaggctgatctcgaactcctgggttcaagcgatcctcccacctcggcctcccgaagtgctgggattacaggtgtgaaccactgtgcctggcctccaaatatggttgatgtctatcagtcagttaaacagtaattctgggaataaaaaattgaaatcaacccacttataattggaatgtcttagcataatgtccttcaacgaagctgctttcacacactgtgatttgtttttttcctgtggtcatggagcaggcatgggccactcggccacatctcatgcatccgtattcaaaagccaaatcccttttggatcctgtttatttggcctggccacgggtgagcacttagacatttaatccctataggccctttcatccctgtgattaagtcttatcaaaaagcacctcctgaccggcttagcagtggggcctttgttcacattagaagggttgaacaaataatgggcagttggggctgcttagctctaaaaggctggtgaacgctgccatgcctgcacctggaaacaaacccaaatgactccagtggaattcagcactgaagtccctcatctcaaagaccttttgtggcagagactcttggatgggccttaggggtcccaggagtcccctgaaattgaatgtagagcttcctacgtgcataggtatactttcttggggaaaaattaagtcacatcattttattttacttttcgagggatctttaacaccgcccctcccccacccccaattcccacaccccttaagaataaattaagaatcactgttctggtagtttccagttgaattccacagaggaactgtcattcattcacaccttcattcaacagatttttagtaaagatttgctacgtacccatcgctgtgtagggtcccgggattcagagatgagtaaagcaatccctgccttccgggggctcaagctctcctgtcatcgggactcagttactgaatctcactaaacatcctgaaggtaggagtttatagagtggttttgaggatcacatgaataagcacacaatacatgggtaattcaaaaacgaaaacaaggccgggcacggtggctcacgcctgtaatcccagcactttgggaggccaaggtgggcggatcacgaggtcaggagatcgagaccatcctggctaacatggtgaaaccccgtctgtactaaaaatacaaaaaattagccgggcttcgtggcgggtgcctgtagacccagctactcaggaggctgaggcaggagaatggcgtaaacccgggaggcagagcttgcagtaagccgagatcgcgccactgcactccagcctgggcaaaagagactccatctcaaaaaaaaaaaaaaaaaaaaaaaaaaaggaaaaaaacaaaactaacatggtcatttgcagaaggggcagaaaaagggtctctgcctagacctggggaggtcagggaaagtactatggattggtaacaaccggctgggcttcctacaagagaaaaagactatactcacagagccagaccccatctcaaaaaaaaaaaaaaaaaaaagtctggcatggtggctcaaacctgtaatcccagcaccttgggaggctgaagcagggggatcacttgagcctaggagtttaacaacatagtgagacctcatcactacttttttattttaaaaaagagttaataaaaaataaaatgaaaataaaagggtaaaagagccagtggcaaagtcttgagtggattaaagccagctcagctaactttcacagcagactatatcattttaaaggggaaaaagcacatctctgttacattgcttaggaaatatgcttggtatataccctggggcaatcttatctatttgttaagtttccttccaacccactagcctgtgtggccaggagagggagacaaagatcttagagctctctaaataatagaacttaaaacatcagacagagaagagtatattatcttggtgatggtaattctcaatgaggaaaatcctggggagggatgttctgtgggagaatgcctgcaagtttatttgtttagtaggtttgattattcagctgattgaaattcctttcccagatggggagatctgattctcttttcatgaaggaaagaaaagtcacatgctaaagagacgggcatgtctttagaacggcagcaggcaaacccactgctgggatcctggggcttttactagtggctagtcacaggtttacctcctgcctgtgctccttctagctgtgttgaaacccacttgccccatctatgaaccgtgttcagctccattttctgagcccccttatctttttgtccatacctgttgcaactctttgcacgttgcattgtcattgatttggtctctcccattcaactgagcctctcacagagttcctgtcacctctgcagtttcatcgcctagcatagtacctggcactttaattcatgcatcaaatgtccattgagtgccttctatgtgttagacatctgctataccgagctagacaaagttggcagacatgacagccgagtggaaaagatgagcccctaaaccaataatcacacacacacacacacacacacacacacacaatatatatatatatatatatatatatatatatgtatgttatatatatgtatgttatatatatgtatgtatgtatgtattaaaaaatcttggccgggagcggtggctcacacctgtaatctcagcactttgggaggccgaggcaggtggatcacgaggtcacgagatcgagaccatcctggctaacatggcgaaaccccgtctctactaaaaatacaaaacattagccaggcgtagtggcggttgcctgtagtcccagctacttgggaggctgagacaggagaatcacttgaacctgggaggcagaggttgcagtgagccaagatcgcgccactgcactccagcctgggtgacagagcgagactccgtctcaaaaaaacaaaaaatttttgccttgcaatcgtttgccttgatgttatgtctaaagccccacaattctctaaaaacagagatgtataaaaaagcacacgtatataattctctgaaaacagaatataaatgagtcattgctccatttaactgacatttgttgagtgcttgttataaatatggcattattctagctggtgtgaggttaccaattttttttaaacaaaagtaatatgaatatatacacacacatttagtgactgcatatgtgatgtgtgcttttgaagaaaaaggagatgctgttggaggaaaatggtggtggtggtgggaagtgatttagagtagaaccagggaagtctcagaagtgacaactagctggaacctaaagaacgaggaggtagcaggtggaagagaaaggcaaaggcattctaggttgagagaataggatgtgataatgtcccgaggaaagagagcttactgacagggagggaagatgtcaggtgtgaccgaactgtagtgagcaaagggtaactgaggaggtggtcaggagcctgctcagccaatggggtaaatactgttaaggaattaggacttgattttaagaacaaccatcgcatcattttaaaagcaaacaaattgcactataatttccctcttcaaaaaggcacattggctgtgcacggtggctgacacatgtaatcccagcactttgggaggctgaggcgggtggatcacctgaagtcaggagttcgagaccagcctggccaatgtgttgaaaccccgtctctaccaaaaatacaaaagttagccaggcgtggtgacatgtgcctgtaatcccagctacttgggaggctgaggcatgagaattgcttgaactggggaggcggaggtttcagtgagcagagatcgtgccaccccactccagcctggacgacagagcaagattccgtcttaagaaaaaaaaaagggcacattgatggctattcaaggcagagaggggcacatataaccccaaagagatggctctggggagggttgtgttgtattacattgttggcattgtattatccaggtgagagatgctggaggctgggcggtgccagtggtgatgaaaaggagagatggatttgaaacataggaataatctctcagattgtttcttggcatcacttacctaaaatgcttctttcaaatatagatgtacacacccctccctttaggatacttgggacaatgtgccacttagacataggggatggaacaaattggagagtctgtcaatgccccctgcaatcttttctcttgatgttatctcataatgccccacaattctctaaaaacagagaacataaatgagtcattggtccattccactgacgtttgttgagtgcttgttatgaatgtggcattattctagctcttgtaaggttaccaattttttaaaaaacaaaagtaatgcaagactgctgatgaaaatttggaatatgagaaaagcataaagaagaaaatacatatctttaagcacaccacccactgttaacattctgatctatgtacttctaatattttctccattttcatatgtacacatacatttatttacatgcatatataaatatcaaagtgtatatatataattttctctgccatttaaatttttactgtgtaacaatcatggattgtaaaaaaagtgaataaaatgtacgcagtcagtttaaagactaacaaaatatgcattaaatcaccagccaggttaagaagaaatactattacttataccctggcatctccctcccacctttacatagccaaatccagaaaagatccgttttcctaaccttgttcgcctattttattatttaaattgcagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaagtaaagtgtctgggcagtggctgtggggatagaaaggagagatttacaaatcattgaatcttctttctcatgaaacatcatttgtgtgtgacaaattcaatttataaataacccagatgtattatgtagaagctgaggctcaaaagctatcacttgcttaccagacggacataggagcatttatctgtaatattaattcatgagtgtggagtctgaagagatgaataaacaaaccataagattactttacatttattgttttcctggcctttaacctatttagaagtcttaagacagaacaaacatttttctttttctttttctttttcttttgagacatggtctctctctgtcacccagcctggagtgcagtggtgcaatctcagctcactgcagcctcaacctcccgggctcaagtgatcctcccacctcagcctccctagtagctgggactacaggcacgtgtgccaccacacccagctaacttttgtatttttttgtaaaaacagggtctcactatgttgcccaggctggtctcgaacctgaacaaacatttcaaaggacaaataatccataccagagaagtagagtatttaagaagtacccagtataacaaaacatattttaaaactaacatttaaagttttgcagaaaactaatcttaaaaagttctcattatttaagaaaaaaaaataaaaagttataatgtcgctttaaaaatgtattcttttaacttgatttagttttcctctatttataattagttgttagcatttatgtttaagaaactaaaggatacagaaagggtctaaattgctgatgccctctgaagacctagacaggaactacttaatatcttgcaccatgtggtgcaggatatcatagaatgtcagggctgatcattctactgttggcagagaccacttcacttacagatgagagaagggcagtccactgagaggagacaatttcattcactaattcggtcaggcaacattgacctacttggtccactggcctagaccccaagagtataaagatgagcaaggccgggcacagtggctcacacctgtaatcctagcactttgagaggctgaggtgggcagatcacctgaggtcaggagttcaagaccagcctggccaacatggtgaaactccatctctactaaaaatataaaaattaaccgcgtgtggtggcaggagcctgtaatcccagctactggggagactgaggcatgagaatcacttgaacccgggagggggagattgcagtgagccgagattgcatcattgcactccagcctgagtgacagatgctaaacatcatagtacaatgtgacaaggtcctaacagagatcaatgcaaaggggacacagccagccagcacaaggacaggagggcatgcctaatgcaggtcaaggtcttctctctcagagcagctgagagtagcaggtcaatggcagcagagagatgtggggcctcagcatcccatggcttcatgcctcctagtttaccctgttctcctccccatgccccagccaaggcacagcaacgatgggcaaggcctcaagcctcagggtgctaggacaaaatttagaaaaagaggctcttcttcagagaatgcttgtagaactcgttattccaatcacaaggtttgtctctttaaaattacagagtgagatatgtacaaggtatctacttcctaataacagatttgcaattatgccaactgaagcattcagtacagttagagaaaaccatccatattccaagagcagatgtaggaagagtggcttccctcctcagatcagaaacccagaaatgttgtcccacccagaaacatccatctcagagaggccagagcagccatcaggctttaaatcccagccctctgctctgcatccagacagaaatccgaggtttccatcaggtgacaaagaccctctccttaaccaaactgtcaagctcctctgagccctcttcttgactagagcccaaccatggccctataaaaactgcagactctcagcacacatgatttcgcccacctttgcacactaagagacataaacgctagcataggttctaagagctgaaagctaaagcgcctgcccgagaaaagtgaatgcggcctgaagaatttactaattgttccaaccaaaacctggtgacaggcagatagtcccctgatccctctcttaaggcagttactttagaaagtttgcaattataaatcctttctctctcccttgagatgtatatcttctaccattcagaactgtattgtctctctgaaatgcaaacattcaaactctccttgctggatgggtgccttgctctaacttactgctccccatcacagacagaagtttgtttctactctagataggagccaattaacaaacccagatcacactgaccaaccccttcccactttctatgcatttccacttcctggactctgctcaagccccatccccactcagttacctttgcacaaagggaagttgagctgggcctcttccctctggcaatagctaatgatttcagtcaatccttactgctttaactggctttctttacctttgacacaggtaaacacatggagagcaaaatcgaggtttttctggccgggtgcagtagctcatgcctgtaatcccagcactttgggaggccaaggtgggaggatcacttgagctcaggagtttgagaccagcctggccaacatgatgaaaccccatctctactaaaaatacaaaaattagctgggtgtggtggtgggtgcctgtaatcccagctacttgggaggctgaggcaggagaattgcttgaacctgggaggcagaggttgcagtgaaccgagattgcatcactgcactctagccttggcgactgagtgagactccatctcaaaaaaaaaaaaaaaaaaaatcgaggttttcctaattaagtacattttattatcatcactgaaagtacaggtggtaacatagagggttatcagccaacttcacttttggggaatgggagaaatgctgactctctccaagcatgttgggtgtctagtggttgaagccatttgccaagattgtcaccctaggatccactcccaccaaacctgggcttttcactttcaacccagcaactgaaaatgccagttcaaacaacttgctgtttttttctaccccacttgcttttagagttccttctgcctgttttattggctccatataacctgaataccacttatttcttaaagcatagctcagatgctattttaaaaggagcccaggatagtggctgatttgatagaatctatacccagattacccagggtcaagtcccagctctggtacctgcggcctttaaaaccacgaaaaaattactttaatctctgtgtctccatttcctcatttgtgaaatggttatcattatagcacgtcccttacagccttgttatgagacttaggcaatagccactagtgcttagaacaaagctatttttgtaactttctccaggaacacttcccttaacagaaccaacccctccacccctcagtttgttcttccctccacaccctctaacattctaacataaccacaaagagtcctgatgggatttggagttacactgcctgggttcgaatctcaattccgccactgccattcgcgcgttttctattgccagccaccttactctcccctggcctcagtttcctcatccttagaaggggagcagagcacatggtggtaactccctgcacattcctctctttccttgtattgggtgcccagtttgtgccctcacatggcgctagcactgagtgggctcaaactctgtacgcgtttactaagcatattgactgaagaaatctggaaacctagtaccgcggcaccatatcgttaccccaaaggaaaatgcatgcacgctgtcagagatgacgaacactgcgtctggaaacttcttaagggcacccacgtgtcctcagctgcagacagcagcgaggagacacccagggaattcgagacagcggaaggcggaagggtcccgcaacaacccaccctccagctcaggtgagttcagagtgagaacgcaccgccaggcttggacaaaggcacccggcctacaccccagcggctccccgccggggcctacgtggacttcagcctccagccacagggacaagagctgctggccagggctgcccgcctgggctcactgcgcctgcgcagtgagcagcgcgccccaggtcttctgcccgggcccactgcgcctgcgcacggagtagtgcactctcgtcggcggcaccggcccactgcgcctgagcacgtagcggtgcatttcgggacctgtagttttccccggcaggacggtagaagtcgtggtttgtgcgcggccaggcgctggagcctccgctgccgggagcagtaagtgtgtgacgtcggggtagaagggagtgacccaaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatggtgggggaagcgatgacagcccctggtcctcatccgcagctctgggggaagtcggggggtggggagggcgggtgttgctccctgagtgttgggggaagggtatggggagaggaccctgaactagcccccaggttacccaggaggagctgaggcccagagaggttcagcgactcgcccagggttgcacagcgagcacaggcaccgacgtcgccctccgaggcctgggcttccagcagggagagacccggacacctgtcatcgcttctcggtggatccctgaaatgttgagttgtggagtctgggcagctgagatcgggcagggctggtttcttgtaggcccaggcttccgtgtagagggccaagtgatgcccaaggttcacctggcagccccctctctggacctacccctccttatgattgggtgaagggttgggtgaaaagggtagaggccgggaatgagaacagcttcagaaagctcagacaaagggcgcagcatgattcgtggctggaaggagacagcaagcgatagactgatccttgaatttgttagtgtgccaagaagaaaaagtattaatagattgtggacgacacattatccatattgctttagttggtctaaccaaaataagcgaatagcttttttgtttctaagagaaacctgacaaaggaagacagggtatttttgcggtgaaggaaatagaaatatttggagttgtatctaagccacttgttacttttgtgttttaagctaagatcatggataggtccagggaaagttaaaaatttcccgcacttcttagattttatgcccctcaaaaacatccccaccttgttggcttttgcagttcaaccttcagataccagctccctcgtttctaatattgcattaggtgtacatatggcagcagagcaaatagcttactgatacttttagcttttttcttctcatttgcaaaagactctatgaaaatggctggcttgggcatgtaattgaagggaggtggggaaaagtggtaattcagaggcagtgggtgggaatgagcaaagcatgtcagtgtggttcaccctcttgactcccacctcaccacagcccttctgctacaattgcagattgactctaaatatgtttctttcctaaagagcttgaattttatcactccaggtatgaagttgaggcagctgccagtatattttggcagtcaggttctgtgatatcagagaggatggtgaattgtgaattccagagttgcagaattgttctttagattctgattttttaaatgacagcactttggtttggagggttaatgacttaccccaggtcatatgccacaccatgggtaacaccaagagtagagctcagatctccagttgtcctggtcctcaggctactgatctttattccctgccctgctatcttggaatgactgcattttgccctggatgtcgctagcctgtatccttcaggttggcatgtccagtcatggaaggagagagatttaacataacaacaatggctgacattcagtgctttctgtgtgctggccatggtgcttagtgtttacagtctaatctgcaagagaatttacagatgggcaagttgaggctgagagaggccaagtaacttgtccaaggtcacactgctagtgaacatagcacatgttttccagagggccagaccactggatgttttttcattcatttcctcctgtaggatcgttggacctatttctcgttcttgactttgggaatcaatattctacgtacatcaattcactgggtatgcagttttgcctctgaaaattttgagggaacagccagactcatctactgtatttgtatacaactcaattaaagcaggaattgtaaaaataaaatttgtaagatctttaacattttaatatacaacattagctaatcactaagattactagagatactcaaagtgaaaattgtagcaacaggttataacatgttaggagcatatttctttagggcagtcagaatctgctgcttcttaaagacaagtgggccatttacacatgaaggtaacaagcacattcagccaccatcattatagttaaacagatctatgatttaaattcctatcgctaccttatctgactttgaaaaagtcatggggaaaacttggctaccttgtgccaactgctagcttgttttcaagatattataatcttgaatagatggaggatgaactttttatacttagatagctttgtaattgaaagtttgtataaaaacatcttgcctgaagttcatcttatccccattctatctaaaggcctttgaaattttcagccacttttcttaattatgacggtaagtacatttcaagagaagtgtttccctgacttttgaatgcaaagctctctgcctgtgtcaggatggtgccgaggttaaagccctggagccagactggatgggttcgaatcccaggcccacctgcgagaccctcgatgtgttacttaaattttatttcctcctctctaaagtggaggcagtaagctgttttatggggtagttgtgagggctaaatgtcttaactcatctaagcactttagccacttttttccatctgacacaaaaaagttaagctatgattattgtgctataaagcattggatttcagaagaagtaggggcactaaacaccatctgcttgacacctttcttcacttacagatgggactgaagctctagagggaagtcacttaccagagggtgtaggttcttcatccagagctgaagtcttcttgggggtatgtgtcatattctaagagtagggacctacaaggccttggagcgaatcccaaggctcgggctgccagccctgccttctcatttccatatgccatggtgtggcatatgacctggggtaatatcctctgaaccaaagtgctgtcatttaaaaaatcagaatctaaagaacaattctgcaactctggaattcacaattcaccatcctctctgatatcacttccttccctaccttctactaggtctccctcaagctttagagaaaattctgcctctgaattattgcatctgacaatttttctgccctgtcacttattcccttgctcccagataatcttcgaaaaaccaagatgagtttaattaacactcagaggacttgacaaagacactcactcccaaaccagcttgcgtttaggtctggaggcaggtggagggacagattttagacttgggcccttaggttcacagatgaatgggatgggagcccatgtcccctcagaagcggcgctgtgctgctggcggctacagacagctggtgaggagagctttctgcttagcaagggccaggcccgtctgggccctcgcccagcccatccacttcccaccagtctctcaatcgccttgtcaggacacagcccacctctctgtggagctcactttctgttcacattccctctctccatcaaagagacatctttctaaggtggtctgccctaggaactccaaattgacctgcttctttcttcctgcccagatcagaccttccagctgcctctcatgtacttgtctgttgggggcttgtgttgatcaggagtgaattcacagtctaccatgaattggaaggtgagtatcgttttaaatatttatggcttggggttttttcttcctcctgattgtgaaaattcagaataacagttctacaccagtagcttgattaaaaagaaaaagtaggtgaaagcataatatttatgtttcattttaagttaaaacataaatgtacatttattcgctggacttctggaagaaggccaggccttttcttcgagtgtgcattcactaacttcaaatcttcctcacttttcttacaaaaactatacctttaaagctttacctgcaattttgcattgtgctttctttttttacacattttttttgtagagatagggctccactatgttgcccaggctggtcttgaactcctgggctcaagcagtcctcctgcctgagcctcccaaagtgtcgggattacaagaatgaaccactgtgctcaggccgttttggttcctttaaagtagatgcagtggactgaatgtttgtgtttccccaagttcatatgttgcaaccgtagtgcccagtgtgatgatatttggagttggagcttgtaagaggtaattaggtgatgaggctggagccctaatgtttggaatagtgagcttattaaaagggctccagggagctctcttaccctctttctgccatgttgggggtacaacaagaagccagccgtcagcagcctggaagaggactccgctagaacccccctgtactgcgccctgatcctcagctttcagcctttcgaactgtgacaagtacctctttaataagtcacccagtctgtggtcctttgttctaggagctgaattgactaagacagtggattaagatcttatgagcagtgcatacacaaaatctttccagtgtttcatactctttcctaatcttttacagttgacttgccaacagcattttttttccaacgcaaacttgagtctttcaaagtattcaacttagttttcataaaaacttttgctttacacagtcatatttcacaagcgtaatgtttaaataagttatggaacatagtatcaagtacaacttaaataaactgcttggcgagtaaacacacctgacccctgtgaaacattagattcagctggtgggagcagaagttcaagggcagccagagagtaggtcagcaatcaggttccaccgagggaaaggagaatgtcatcttaagtcccggaagtcaataaggtgaggtggaggttgtttaagagagcagccactaaaatatattatagtcactttgcaaagtctaatatcaagcaaaaatcatacattgtctcaccatctagaaatggctactattaacaatctcggtatattcatctttttctgtatatatgtgtggcgtgttttcatgcataggatcttattttacgtgttttttcaattattataagcattttcttcaaaacatccagtggttttctattgcaaggagaaactggaaaggtctggaagcaggatcagggagccaggaaggtagctttcccatcttccccagctgtgtggggtgaggggctcggcaggccctgcaggagggctgagggcccaggaacttgtgtaagttaaagatggcagagtgagtgagctgtgaagggtgggaagatatagaacagtttgtttagcatgccttgaggatcagagctcacagtggaaaggttgggaaggaaagaagaggcagtgagaggatggagaggggaaggagcggaaagcagtgtggggtgaggtttagggaggtcattcgcccactgcagtggctaagtcagtagaggagagaggcagtaactggtactaagggccagggttcaaagcattaaacctcatgcctcaaggtggtgtttctcactcctgagcactagttaaggcaaggatttcgagccccactcccagagtttctgattgggtagatctggctggggcctgagaatttgcacttcttataagttccaggcggtgctggtgcacactggtcgaaggcaatgcgtgggaagttttcctctttaattgtagagtgacaccaacccatgtgaccactcgggccagtcttgcttgtgacagttttttctgccatcaggaacaaagtctgcccaaaccttcccagcttctgcaccagggaagtggctaccagggagcagcttcgtgtttaaacacagccccatctcgtgtagtgttagaaaggaatggccgcaggccgggcgtggtggctcatgcctgtaatcccagcactttgggaggccgaggcaggcagatcactttgagctcaggagtttgagaccagcctggacaatgtggcgaaaccccgtctctacaaaaaaatacaaagattagctgggcatggagatgcgtacgtgtagtcccagctactcgggaagctgaggctggagaattgcttgagcctgggaagtggaggttgcagtgagccgagatcatgcccctgcactccagcctgggcgacagagtgagaccctgtctcaaaagaaaaaaaaaagaaagacagtcatggccctgattgcagagagctgcagaaggtggaaggttcagtagcccccagtgcgtctggtggccttccccctctggctcagtgggccatggccggcagcgacagtcaacagtgctacctgtgcgttagcaacaagtatggcctcattatttaaaaacttagttattcccatttcacagatattggggttttgtttttaaaaattgatgtagatctaggccaggcatggtggctcacccctgtaatcctagcactttgggaggctgaggtgggcagatcacatgaacccaggagttcagcaccagcctgggcaacatagtgggaccccagctctacaaaaaatcagaaaaaattagctgggcgtggtgtcatgtgtctgtagtcccgtctactcgggaggctgaggtgggaggattgcttgagcctgggaggtcagggctgtgggaagccgtgatcatgccactgtactccagcctagttggagtctcaaaaaaatattcatatagatccagtccaccctggcagcattcattttcctccctgaaggtctgtatgtttcaagagatgtaaggggtttgttaaaaggaaattggaggaaggggttcataccactgaaggttagtgcctaagagaggggcaggaagggggccctggagctcttcgctttaccctgtgaatgttcttgacctctgctgcccttgtgctgcgtccttctcagtccacacttctgcctcttgccgtgcgtctccactgcctgtaaaacaaagtgaacactgaagcctcccactagggtccattggctgatgcgtttccatttccatgggttttctaacttctggatgagagagtacattcctgcaattgctaaagctaagtttcctatctggattgtagacagctatgggcagtaacatgggctttgttatattagtaatagggccccggccaggtgcagtggctcacacctgtaatcctagcactttgggaggccgaggtgggcggatcacgaggtcgggagttggagaccagccggccaacatggtgaaaccctgtctctactaaaaatacaaaaaattagctgggcatgatgccgcatgcctgtaatcccagctacttgggaggctgaggcaggagaattgcttgaacccaggaggtggaggttgcagtgagctgagatggtgccattgcactccagcctgggtgacagagcaagactctgtctcgagaaaaataataataataatagggccccataggtttattcagagagactgagaaagctggaagagattagcttttcccagtgtgagtcattgcctcaggtagcctggaaaatcctagcaaacaaaaagaagtttatacaacaacattcttttcatagctggtttgtatgcatggcgtcaaaccttcacctctaaaatgtgaaccttcaagaaaacaggatttcagggtttactggagggaggggattagcctaggtctgagggaagaagaacctggaaatgaagtcagtgtttaaagctccttatatttaccagagtaaaaagttgaaaagtttcacttttggaactttttagtcttttgtactgatgccagagtgatctttctgaagtgtatgtgttgtgcttattctttactgttaaaacgatatcatggttgaaaactattagctaattactgagtgttcttgtgttcttactgttttagtaaaattaaaacgatttaagtatttgcgtccctgcctcctcccatgattttcattgtatttctatcatatcatgctatatccttctgcaaatatccatacataaccagttaaatgatttcagaggtagcgagtctagttgcctctggaaaattcagtagccaagccatagtgtatttgcatattgtaaatgtgaagtggatgggtgtgaggaatgaatcatatatagtacaggacagcgtgatgctacagagttgggctttggagcatttggagctgggtcagccctgcctcgctgactgctggcctccccgcctctgcattttctcggctccaccgcagtcagggcgagccatctgctcatggaggtggctaagggcagaagggaaagccgcataaggcactttgcatgccgtgagttcccagtctacagcagctgatgctacagcttctaagcgtgaaatccacatctagttctgagtcataaagagtttcgatacaatcataggaacattcatctacatacactgtgatttcatgaatttcagtttgttgaaaatcaggcatcagtggaagggagactggccccggggttagaatgtccttccaactggctcctcatgagggagctgtgggaccttcaacctctcaacctccaggagctcttctttccttgctcatataaccagggggttgagtaggtccccttgaaagttatttccagccccccggttctgtgagcatattgtacacactaactaggttcagatcaacttcggttagactattagagggaggtgcacatgtatcccccacagtggaatctcattggtatttcatataataagtgattgacagaaataaggatttcattgggataaaatcctacctggtcctctaaaataatgattgctcaaccagagcataccttttcactatttgggagggaatttttaatcacacaaaaagcacatacatatcattcaggtcatgctaaccatgtgtatggaactaatattgctttgaagtactatttgcaatatatagaatttcacacaaaaaacctactagtgcaaagagtgagtaattcaaatgcatagtgtttccctagactttattttagtgaatggggttgcaagagcagttagtaagtagccatgttttaatgttttgagttctgtcgtgttttattttaccagcaagtgccagtgctagtgagtctctagaaacaagagaaaatcccagagtactaaagctgcagtttccagaagcaaggtctgattcacccttactttgtagatgaaggggcaggagctcagaaagaaaggagctcattgcctgacccaggtcacacggtcagtcggtggtaaagtagagctctgacccaggcctccgggctccagctcctttcactggatctggctgctgcctcagaagcaagggcctgggtgatcagcaggttgcacggttgagctgtgagagaccagagtccccacgcctgtggatgaccggtggtcccctccatgaagccagccgcaagcaagcagcaaagagcagagctgtaacttgactgttggccccatggggatagagaccttttctgcttggtctccagtgtagctccagccccctatcctcgtgcctgttgcagaataggtgctaagtaaatatttgttgactgaaggatcataaaagaaacctcccatatcggtgatggaacatttagttagcatggcttctttcttcttgaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtgagtccacagtacccaaccttgcaaatgggagctggccagtgggttggggtgaccaatcaatgaacaagagaggtctgagacctccctgtccgtcgggtctgaagggctgcgtgggggcatgtggcctcacctgttctctaaggtagaactgctccataaagggccaggtgtgcagatcctggtcctgggatgtgagtgctgctgagccaaggtgcacggagcattagttcatccttcttgaaacctgcggtggcaatggttcttgacaggtattgggttaagaattgaggactcagtgacagctgtggaccttcttcccagagaagcacacatactgaaaccatctgcatttgtgtgtggggagaagtttgcagatgtggggagtcacaggtcatttgaaattccaagattaagaaaccctgttacctttaagataaagtctgactccatggtatgacaaataaatcccttcccagtctggtcttaacccagacctcatttgccacatgtgcccactccccatccccctgcaggccattcctcagccaccatggcctttggccttgcttattaggttcttcccaaggacctcctcaccaggcctgagggtacactcatcgttgtcacccagtgcctatcacagtgcacactggtgggcttagaacacacttggggagttacaatacatcaaggcaccagaaagttcctgttaagcccctgttacagatttaacacatgacaattcacagttaccttgattccagtgtgttgatgcagtttcttcactttgcaggttgagttctgtactttaaaaatcaggggattcagccaggtgtggtgactcatgcctgtaatcccagtgctttgggaggcaaaggtgggaggatcacttgagccaatgagttcaagaccagcctgggcaacatagtgaaaccctgtctctacaaaaattaaaaaaaaaaaacaaaaaaaaccaaaaaaaaaaaccaaaaaaaaacttagctgcacacttactgggtgtgtagtcccaactactcaggagactgaggtggaggattgcttgaggcccagaagttcaaggctgcagtgaggcatgatcacaccactgcactccagcctgagtgacagagcgagaccctgtctaaaaaaaaaaaaggattcaaatatggtggcggtggggttctagatctgtggttcccaaacctagctaatgatcagaattgcccaggtgtttgtttaaatgaagattcccagcttcagcccagagagattccataatggctctggttaggtttgggtgttggtttttgttgttgtttttaagataggggatcctactctgtcatctaggctagagcggtgcagtggcacaatctcggctcactgcagcctcagcctcctgggctcaagcagtcctcccaactcagcctcccgagtaggtaggactacaggagcacgccaccacacccggctaggtttttaaaacaatttttagtagagaaggggtcttgctgtgttgcccaggctggtcttgtactcctgggctcaagcgatactttcgcctcagcctcctgaagtgctgaggttacaggtgtgagccactgtgcccagcctctgttcttttgaaaacccattagataatccttaggttgtcttctcagcaacaggtcattgtaggaaccactgggctaggtggcctcccaaacccagcccactctgagattccatgctgaattcccttgcagtgccgtcaggcttgttgaggctaaagacctactgatgaggaatagtagcaacacctactaagtggttattctgtgctggggactttgctaagcattcatgcacaactgtgttattcagccctgatgactctgtgaggcatgttcagattgaaagaatggctctctctacatggtgaagaacagagtcagaaattgatcccaggtcaaatgcattcgatcagcatggccaagcccaagctgtgctaccttcctgaatacaggcaagtgagctcgtagggatgcttcactctgttactcaccacttccggcagctgcccactcgctggtccccagtgaactgtaggcttttgctagatagaagaagttactttctttctttctttctttctttctttttttttttttttttaaggtgtttgattgactgaaatttaggagtaggcattacgatggggaggagagaaattaaaaagggtgagggaaggcagtttaaattaaaatgttgctgattgaatttatattcctgacaatcccattttgtgtgctaaactgatcaaaggaagaaaagatgagatggaagatcataaaggctttgttcctcccacaaacatcagcagagacctgcatttaagtcaggcctggatggcttagaagcaactcagggagttggtcttcctctctaggctggcagcttcttaaagactagagacttgcttcaaacaaaaagcgttttcaggccgggcgcggtggctcacgcctgtaatcccagcactttgggaggccgaggcgggtggatcacttgaggtcaggagttcaaggccagcctggccaacatggcgaaaccccatctctactaaaaatacaaaacttagctgggcgtggtggcacgtgccagtaatcccagttacttgggaggccgaggcacgagaatcacttgaacctgggaaacagaggttgcagtgagctgagattgtgccactgcactccaggctgggtgacagagtgagactgtttcaaaaaataaataaataaataaaaggggggtggggtgtttcagatggaagggaaactgatgctaaaaatacattggttaataaatagacttgagtgatagacttgagtggtgtccgcttgttaagtttaaatggctgagcatacgtctttatgctgagcagtaaacatcgggtatactcttatcaaacatttcctactcatccctttggtattcccttctagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaaggagtcgtggcctttggaataagtcaaattgtgtatctctttctctttctcttacacagcaccctctaccccgtgttgtaaagcggggggttttgtaaacttacacctcccccaccatctcaagctggggggtcccaggtgagaggcttccatagaggacaaggtggtgcagaaacatctgctgtgggagtggggtccccagcactgggtgcttcggccagctacccccgaccccaggccccctcataggctgccctcccataccctcctttctcgtcttttcctcctacaggtgctacacccctgtgagagtgttttggagtgttttcattgttagggtggagggaggctgtgtgtgtccaggaaaggtgactcctgtgttaaccatgagggtcctcgcagggaggaatcgttgggagccctagggtgtgttttgtcctctcctcacctgtttgctccttgggatttgctgatgagaaatgaagggtagggcaccctagtagccactggaaccaagggcagggaggatgggaagatgttttactcagcacctaacacacgcagatccctgtgacaagagctcatgctctcccacttcttcgcaagaccccagagtggatggggagtgaggtggcagcagctggcactggaagcagtgcggagtgtttggtctggttgctgatggctgcatgggaaacttgcaggagtgtgtgttagtaaacgtctccccgtcctggcccagtttgtgtcgaacatgcgttttccatgtggggagtcaggggagttccatcttaaattgcactgtgcttgctggatgctcttcaggacaatttaggaagcaggaaagaatttacaaagttctgaggacagacagaccctgctcctacaagctgcagtgctcaccatagtcaaagtggactttcacgtaagcccagacctcattctctctgaaggaggccgctccagcctttgccaggagccctggtgactttattctgcctaatcctgctgcggcctggggtcctgttagaacgtgaatggaagaccacagcagaggtgggatgcccttggatttctgccatccccacgctttcgtgacatgctcagatggggcctagaactgaccctgggccgtggcctaccatcctccctttgtcagggcctccttgcaccctggcaggttaccccacccaccctggcccatgttcctgccccaggggcctggcctctctgctgcccaccctgcaggtgtagggtatcacctgctcctgccttgcctggcatcagacctgctaccttggcaccacttcctccctcatgcccacccgcctgtgtgcctcataagtccaaggcgggggatctgctgaccagtagacactcatgtgctaaacacaagcgcttttctaggctttgggatttaaagctacactttggaatttgtggaagatctggccatcttggaaaattaggtagaaggtgacataaggactggactaaaccactgatcatcccaacagtgcccgtggcttttctgttttttgtttttgcttttgtttttttagagatgaggacgtgctgtgtccctcaggttggagtgcaatggtacaatcatagcttattgcagccttgaactcctgggctcaagcgatcttcccacctcagcctcccgagtagctgggactaggccctgctaatttatttatcttttgtttagagacaagggtcacgctgtactgcccaggctgggtgtaggttttttctgaagagcatttgggagttttgtttttgcttggttacttttcctatgcacccttctaccactagggggagatgattaatcactaattgaagggattttgttcgttttttatgttttgggtttttttgtttgtttgtttgtttgtttcaataaagaaagagtttaattgcagtaaggcaggccgcgcaggagatggcgttcttattcaaatcggtctctctgaaggctcagaggttaggggttttcaaggcggagttcttgctatcattccactccttaggtacatgaagttggtagatgtgtagtttgatgttaaattattgggtggatgcatgcaccgctggttgtagagactggtaaagcccactagcaggaccccacctggaccaaagcaatccctcaacccgctggaccatgaccgagaacaaacacaaaggacctgaaatgcgttgtgaaggccagaagccgacatccacattctccacccacggagagccccagagtccctcatgcacatcctgcttgatctattacacacattcacacattcgcaacacatttgtttggttttcaagcttacaacatattagaaacagaaaggaagaaaggctgtcagcagcagaaatacctttgagcaagagggacggtctttgagaagcagacttgagaactcaccgtgtgctcttcatgcgccagacactgcggcagccacagcgtcccacatgggatgccacacgtgatgatgttatgttcatggtgatgacctcaggcgtgaagaagaggttcagccgtttcacacagtctgtttaacaagcacatacataacacagacatacgtgaggaatctcagaaaccaaataattcaaacaaagagtctgggattctttcaaaagcgttgcctctgcccaagctttcttcaaattctgtctatagggaaacgtagctgtcaatgtctcattcccgaagacttccagatgcctggatctttagagttctccacctcaccccgagttgattacacaaatgttcctggggctttgcttagtgccctgctctgtgccaggccccacaggcagagatggcagggacccaggcctgacgttggagagctcctgacccactgccggaaacacacgcaccatcacaccatgagggagctcccccatgcagatctcatctgtgtcagagtgaagccagaggatggacggtggagagtctagaaggagaagagaaaggaggatgagttctcatacatgagcaagcaggagaggccatttaaaatgcacactctggcctggtgcagtggctcatgcctgtaatcctagtggaggccgagacaggaggatcacctgaggtcaggagtttgagaccagcctggccaacatggtgaaaccctgtctctactaaaagaaaaccaaaaattagctgggcgtggtggtgcatgcctgtaatcccagctcctccggaggctgaggcaggagaattgcttgaacccgggaggtggaggttgcagtgagcagacatcgcaccactgcactccagcctgggtaaaagagtgagactctgtgtcaaaaaaaaaaaaaaaaccaacctaaaaaataaaaataaaaataaaatgcagactcctgggctggattccaggtccactgcatcagaacctgcaggagaaggaccaggaatttgtgatacgaacatccccaggcaattcttgaccctccttttgagacctacactgtagaagatgggcagagggagaggcagcaggagcccaacctgggaaggagccatcgggaaaggtgggaggaggggcaggagacagcgcacgcgaggcagcaaatccttcagcccttactccccaagagctcacagctgcctccacagagggtaacggtatcattatccccttttcgcagataaggaaactgaggcagagaggccctgcctaaggtcccccagctggtgggaggcagagacaggaaccagccctcatggtctcactgtgagactggacttttcacagctgtgcggtcgagtctgagccaagtaaagtaaagcgagtttttgtacttcgaagtctgggacataaaatcttcaagacgtcagcatcagtgacacgatggtgacagaggccagcattgcttgttgtatctttttccatcctgttcctatctacacttccattcttctgttcattctgcttgcatttcccacccagatggctttcacggacacacacacacacacacacaccgcacacacacacatcactcacagacgcaccctgtgcccaatgtcaaaagacaaaactgcaacacgtttagtcatagacctcattgtcttttattcttgattcatgaatggggcagcctcccttctataaaacagagcaagagctcccaccggacaattgcagaacagtgggctttgtaaggtggggacaaggaaacagaacaatagaaaagaagctgatgggttaacatcaggttacttcaggacctcctaatcacgctgactcaggtagaccagaagctcctgttttcaggaaaaactaatctgtttggggacatacctgcttccttattaaagttttgggttgattatatggctcttagcatgactgactccattttggtttggtttgatctggtctgttggggcctagtgcaggatctcagtccaaaacaatagcctcccataatttttgtttaatgctgggtcagcggtaggcttggtccacttgcgcttctgcctgggtgggccttcctcttttcctccttttctctctgtggtgaaatccccattcttctttctgtcctccacttcagtttcacctcttcctgcaaccctgcccacagctcttcagcgccaggccctggactcagctctcactacgcaaacctccaacatctcactgagtgggaggtggcccccacctccacaccagacctggaccttgagggtccaggcttgttttccttggtactcctggccctgacgcacccagccaggcacacagaaggtgctccagtatttgatgagtgaatgactggtagcaccagaggaaagggagcagggagtatggccaagaccattagctgccttcctcagtgttccttctccccttctccctagtaatagaaccctgacttttacctggccgtatggtcactcaaaataaaggactacatttcccaccttctctcgcaaccaagcctggccaatcaggtttaagtggaagtgtagtgtgggacttcctggaaggatctttaaaagggacaggatgggcccctcttcctccctttctcctttttggctgcctggaatactaatgcaatcgcttgttccgcagccactttggactaagaggtgagtttgagacctgaaccaaatctaggacaatggagtaaaaagataggatcttgggctctcagtgaccatggatccatcatttcacccctgaactgacaccttgacacttcttatttttggtggtggtggtggggtagcttctattttgttggcatctctgtggtctattcatagttcacctgttttagctgacacatggagccagttagagatgggcgcaagggcttcctgatatgaagacttggattctggtcctgaccctcctgttactactgttacgtacgtggctaggtgagtcggtcaccaccctagcctggcctttgtaaaatgagctcaatgatcactgccctccctactgtacagtgtttgtctgaactgaatgaggtcaagcatgtaaagatggtttgcatgtggcaggacaatcacaaatggaaggagtgtatactacctcggtgggcaactcagccaccagttggccaggcaggggctccatccaacccaattggattgagccaatggccaacgaaccccatttgctaatttacctcttaggtccttgtaggggcagcaccatttcctaatgcacccccaccttgaaagccaccttgatccgtgggagggagaggggctgtgggtattagtgatggggaaggccagagaggctgggatgttccatcagccaaccactcagaaggagaatagtgccaccaacatcaggagctcacttctagtggacatgtctagagatatgtggctcagccctgcgttgctgcgtgtggtcacccgctcttaactaaatacagtgctctaaatatggctgctcccaaagagactgtgggctgtcctcaccagccatcctgtcccacccccaccagaagaaacctcttcttattattaattccctaaccgattgcagatattgcagatggtcttaaaggaaatgccagagaacaaagtttcctctgatcaaagtatcttaagatgtgtccaccctcattagatgccagcgataaaaaggaacaaaaatttttctcaaagagtgaaaaggaaatgagatcagtgatggcaggtctaattgtggacatgtttgcttcgaccttaccatggaccactcactcagtgggtgccagacacaatgcagtggcttggcgcaggttatgtgattttttttttttttttgagatggagtcttgccctgtcacccagtctggagtgcagtggcatgatctcggctcactgcaacctccgcctcccaggttcaagcgattcttctgcctcagcctcctgagtagctgggattacaggcatgtgccaccatgccaggctaatttttgtatttttagtagagatgggtttttgccatgttggccaggctggtctcgaactcccaacctcaaatgatccgcccaccttggcctcctaaagtgttgggattacaggcatgagccactgctcctggccaggttatgtgattttaaagtcccactgtattttattaaggagttgattgagcctcaaggaagtaaagcaacttatccagaacatatagctacgaagctagaaactcaagattccaactaggtccatccaattccaaaagcccggtgaactttctgttactttctatgggaagttttcaggtttagtataaagcaacatttcttaattatgaatacaatcttatgtaaccaaattgcacattaaagggtattccttttgatccttctttcctcttttctaataatttttacaaggcctcaaaggaatagaactctaaatctgttttattaaattgctttagttttcaaacaaaaatagctcctgttggtttatctttagctgataacctaaaaacattccttttttatcgctgtaaaataatgtgtctttaaaggatattctgtctcctctttaattttatgttgaaataaaattttttggtgtccaggggagttggccattttagcggctggtgtctcatctgaggtcagaggtgagtcttgcgacatagaaatgatgggggtgaaaaaggaaaagctcagcttcaataactaagctaagcacggtggtgaggagcatgggcttcagaatctcttggccccagtgccttgccagtgcctcagtttcctcatctgtaaaacaactgacaggattaagagaattaaattataatagctatgcgttagtggcatcatgaagaatggctctaagcatgaattctgggttgaatctctctgggcctcagttttccacatttatttatttatttatttatttatttatttattttgagagggagtcttgctctgtcacccaggctggagtgcagtggcacaatctcggctcactgcaacctccacctccaggattccagtgattctgctgcctcagccccctgagtagctgagattacaagtgcccgccatcacacctgtctaattttcgtattttagtagagatggggtttcaccatgttggttgggctggtctcgaaccccttacctcaaatgatccgcccacctcggccccccaaagttctgggattacaggagtgagccacggtgcccagcacgtgtagctgttggtgcctattattccagaaccgcagaggcatggaataaacgggatgtagggcaaaacccactcatctcccaaaactcaggccacccacacgtgggcctgcacaatgacagcacactgaagtgaccaaggaagtttgagtaccatggtttgctctcaaggaacttaaatcctaaaacgtacatgaaatcctgagggaaaaagacctcacaaatatactacacaataggagttatttcaccaggttaattgccaatgagaaatgcaatgtttctattggcagagcaagacttcctttagcacctgtggctggctgaatagtggccaccaaagatatcaaggtcctattccctggaacctatgaatgtcgctttagatggaaaaagttctgcctatgtgaccaagttaaggattttgagatgtgaagatggttttagattactcaggtgggccctgaatgcaatctcaggtgtccttgtaagagggaggcagagggagatttgacacaggatgagaaagtggtgtggccacaagcccaggaatgccggtggccaccagaagctggaagaggcaagaaacaggtcctccctggagcctctggagagagtgctgccctgccaacagcttgcctttggctgtcttctctgtcctgtcctgtcctatcctttttcttttctttctctctctttttttttgtttttttggagatggagtcttgctctgttgcccgggcaggaatgtgatggtgtgatctcggttcactacaacctctgcctcccaggttcaagtgattctccttcctcagccacccaagaggtggaattacaggcgcccaccaccatgcccagcaaatttttgtatttttagtagagatggagtttcaccatgttggccaggctggtctccaactcctgacctcaagtgctcctccgacctcaggctcccaaagtgctgggattacaggcatgagccactgagccaccgtgcctggcctctttcccttcccgtcccccttcctctttcccttccctttccctcccctgcccccttccccccgccccctccctctcccctgccccctccccctccctctcccctctcctccctcccctctttccttcctccctcccttccctccctcccttccttccttctctctttctttcttctttctttctctctctctctcccctccctctcctccttagcccccctcctttctcccttctctctctttctttttgagacagggtctcactctatcacccaggctggcatgcagtggtgcgatcagagctcactgtagcctcaagctcctaggctcaagcggtcctcctgcctcagcctcccgagtagctgcaaccacagccactacatctggcttaatttctgttgttttaagccaccaagcctgtggtaatttgtttcaacagccacaacaaattaatatagcactgttgactgtcaagtgaggcctgcaacagtggaaactttatagttctgagtggtcagctgtttgaggtgtgattaatctccaggaaaaatgttaccaggattccctttgtaaccatgacaaaatgctgagaagtggtggacacttagttgctgaaaagcactgaacgttcgctttcatctgacaaagtctttctgaataatacagggaggttcgggagggaaagaaggcaagcaaacgatgggatgctttctgcacgtggctgtcaggaaattctgggtagaaattctttctttctccttttcttttctttttgagacagagtctgactctgttacccaggttggagcgcagtgatacaatctctgctcaatacaacctccgcctcccagggctcaagtgattctcccacctcagcctccctagcagctgggaacataggtgtgcgccaccatgcccagcgaattttggtattttttgtagagacgaggtttcaccatgttgctggcctcgaacttctgagctcaagcaatcctttcaccttggccttccaaattgctcgtacaggcataagccactgtgcccagtccagaaatgttcataaattgttttttttcatagaccttattttttagagccattttttagattcatgcagaattgagtgaattgagtgggtgccccaccacccaccaccgctaccaacatcccatgtaagtgtacaaaattttttttttcttttacaggcagggtttcactttgtcacccaggctggagtgtagtggacaaccatagctcactgtagtctcaaacttctggctcaagtgatcctcctccctcagcctcccaagtagctaggactatagatgtatgccactcagcccagctatttttaaatatttttgtagagatgaggtcttgctgtgtttcccaggctggtcttgaactcgtgacctcaagcagtcctcctgcctcggcctcccaaagtgctgggattacaggtgtgagccattgtgcccagccataaattattctttttgcactcctcggaatgattacctctgaaatgactgtctgaatgtacataaccaacagtgaattttatgatatgtttaataggggtagtctttttctataaaaatgaaaaagacaaccacagattcttacaacagacatcggcagcagccccaaacctaaatagggaggtgttgtcccagctgcaagtggctcagctacagggtctcgagatgaaactccacggcacagtctaatgacctgctggaattcctggagttggcggggagattggctggataagtggtctctgcagacccccatgcgtgccacccctttgcccaccatagcccacttgaacccaccactgtcataactttccaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttggtgggtggaaacttggcacactatttaatttgggctttttgggggatgactgcacactggttctctttttttctcagacctaaatttcgaccactcaactttcagcctgctcacccctgcttattgccatccacctttgggctgggttagacctaatcctccccttgacaaagccctcaaagtagccttcacaagataagagtcgagacccctaacttaccaacaaattttaatgaaacttctagtaaactcaaagcgctttgccaacatccttaggagcaacccagttctcgcagcaccccatgtgaggtcgctgttgaagtatctttggctgcagtggtgtggaattcatctcaacagagttgacggtaaagaccagacatgtagcagcctcactgcttgttggaggaaccacccttaagaaaatttcccaagatagtagttttcccatctccgtactttgctagttaatgttctccacttgcttgcgtttatcctttcaattcctttgctaattaaattgctgaaaagtatacattggtaagaatagccactgtcaatggactgcaaacaaaactcgtttctgttattgatgataaaccatttcagagaagaccaggctgagtctaaagggttcagataattacaaggggaaggcagagagagtagttcatggccacaggacttggccacctctgggcaacacataatgcttgctaagctaatgactgtagggatatagaactggccctcagcctctctgtcttcctttggcctctgctcttcctgctgccttctctctttgaccacgatgacacactttccataggccttcctcaccacatcacagaactcagagaagaggctgtcttcttgtttgatacacagctcgtctcttaggaacacccgatatttccaaggcacccatccttgactacccgcagcatgcacaatacaccaagttggggtttgtatgaaatatccatcactaatatcttccccagttacgagactttctgggatattggtttccccaaaatatacggtcttaaatccatcatattgcagtgttctcagggttttcagatattggaggcattgcttcctcttgatgccatcaaattgacttctgataatgacatttcttaaaagagggcttgcaaagcgaggcatggtggcttctcaagtgtttttaaaagcttgcacatctgcatctggggagagatggcaagtgggggatgatgacctcataaagggctttcttacagtggtgccagtcccacacatacacttcagatttcaagcatcatggaataaatactcagaacaactccctgctgacccataaaatatgggaattgcagatgctacccataaaaatgctactttgacatcacttctgcaataggtctgagacagaggttggcaatcttttaatagtaatgagcctacccatttggcttaagatggggagaaatgtttacattcattcatccatttcaaaaatatgtactgatcacctgctgtacaccaggcattgtgccaggcaccaggggtatagtcatgacacacccagggagtcctggacttacgtgttgtgtgtctgtgtatgcatagaatttgtgccagttgccttcccatttgcacaactaagagtgattttttccaggtggcagaaggaaggtatggcaaattgcaaaagaaagtcagtctgcacacctagcttccactggcgcttgcaggtctttttttttttttttttttttttttttttctgagagggagtctctctctgttgcccaggctggagtgcagtggcacgatctcggctcactgcaacttccgcctcccgggttcaagtgattctcctgcctcagcctcccgagtagctgggactacaggcaccttccaccatggccggctaattatttgtatttttagtagagatggggtttcaccgtgttagtcaggatggtctcgatctcctgaccttgtgatccgcccgcctcggcctcccaaagtgctgggattacagatgtgagccactgcgcccacccggagcttgcagttattgaactaattcaatacctcatcttgaaagcacttttaattttatatactcaggcaaaatgacagtttgcttcaaactctaaccatctcttcctttgtattttcttgcctctttaatcagagctaaagacatttcataaaatgggcatgaaggattccttcaaatgaagacgtggacaaaatgattggtcaggtcctttgctctactgttgaatggaggaggattttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgtatcttgttttacagttttcattttggaaaatgtcaacatttttacattaaaaaatattactcagccataaaaaagaatgaaatcacgtctcttgcagcaacatggacagaactggaggccattattctaagtgaaataattcagaaacagaaagtcagatgccacatgttctcacctttaagtgggagctaaataatgtgtacacatgggtacagaatgtaaaataatggacttcgaaagggaggctgagatgggaggaccatttgaggccaggagtttgagacaagcctggccaacatggtgaaactgcttctctactaaaatgcaaacaaattagccagacatggtggctgacacctgtaatctcagcactttgggaggccaaagtgggtggatcacttgaggtcaggagttcaagaccagcctggccaacatagtgaaaccccatctcaactgaaaatacaaaaaaattaactgggcatagtggtgcgtgcctgtaatcccagctacttgggaggctgaggcacgagaatcatgagccgagattgcaccactgcactccagcctggacaacagagcaagactccgtctaaaaaaagaaaaaaaaagaggataggattagggtgagggatgagaaattatttaatgagtacgatgtacactactacactcaaagcccagacatcaccactgagcaatcaatccatttgacaaaactgcacacctgcacttgtaccccttaaatttatatacaaacaaaaacaaaggcaaatcaaaaataaaaataaaacaaaatgatctctaaacaatacaaacagtaactgatgaacctagctgcttatcatgtcagttccaaaatcacacagagttgaatttctttcaaatgaccctacaacacagtattttgatcatatattctccagtagagtataagctaaggacaaagaaaaacacatgaaatcttaaatggtactcggtagttttattgttaataatgatgctggtattattattttgaaactcatgtccatttctcagctgccatttgatattaattttttttttttttgaggtggaatttcactatcactcaggctggagtgcagtggtgtgttctcagctcactgcaacctccacctcctgggttcaagcgattcttctgctttagactcccaagtagctgggactacaggcacgtgccaccacacctggctaatttttgtatttttagaagagacagggtttcgccatgttggccaggctggtctcgagctcctgacttcaggtgatctgcctgcctcagccttccaaagtgctgggattacaggcgcgagccactgcgcccagccagtgatttttaacctttatcaatctgatagacaaaaagatcatttcattgttttaacttctttaattatgagtaaatctggcaatatattatgaaaacaatgacaagaagaacttgatataaaatgcacaattcagacgtccttgaagatcattttagaggcagcatgaagtggggggtggcactggtgatgggggctgggtgtggagaaaaccagccaaaggaggactcatgggatcctggagcttttgactggggttcacttggagcccatactcaggctggttctgacagcagcacctgccaggcctcagcttaggggcacaatgtgggacacatggactgggggtgtggtcccagagcctaagaggcaccaacagagaggtctccgcagagactcatctgtgccccccacccaccaccccgggacaggccaagccagcgtctggccaggaactgcttttgcacaaggagccagaagtagtttgccccgataaatgggggcctggactcacgcaaaccattgcaccatggatggccagagaaactcagagaaccttcctgtgcttgttaacatactctctcacgtcctctgcagcctctgccaagccaagcagccagctcctaggactcccctccctccacctgaggctccttgtcctcccttcctcaggagtctccagcctcccgggacttcccctccccgctgcccactccagcagaggctgccaactgcctgggagagagaagtgggcttcctggggccacctccccaactttggagtgtttggaaggtgatggagcgaccactaggaggcagtgtggacaggtctctgtaggactgctcaggcagacacctttgcagggacctcccaggtcgggagccctccacacttttcccatgggagcttctccctccaccccgagtcactactatctgctttcctagaaggcacttctttacttctaattcttctccactgcccaggtaactgatattctcaagtgggacattgtaatttgtttaattcatttaaattgatttcatataattgggagataaagattgttcagttgcaagacaaagtcttaacttgaactctcaggacacgggtgggtccctaaactcaatacgtgagtgttgctgccgggctgttgggccatcttccacccgccatagatcactttcttcatcaaagaagaaggaatatttagaaactggtagtacaaaaaaacaaacaaacaacaacaacaacaacaaaaaaccaaaacaacaaaaaacaccaaatcaccaaaaacaaacaaacaaaaaacaaataaaaacccaaagcagttgctcctataaatagatgtgtgtatacatgtggctggtatgaatcttatccacaaattcagttttgtgggaaacatcacatttatttatttaaatcaagtcatatgggacttgggcatggttggaggttcttaccccaccccacttcccaaggccagtgcacaggcagggccttgaggtcacccttagccgatgcttgggtctaggtgctcagacccaagcccctgtggtcccatcatgtgggcactggcatctttgctgaggctgagaatttcaaagccaggatccagcccatttaggtaaacccaaagtcactctcccaggtggcccagtcatcttcttgagaacaagagccatgagcctcagttccctgcctcaagagcctctgttcaaccctaggcttgtagacaactctgccccttcttctctcccttcagtgtcacggtcccctgtcccatccctctctgggacaggtaccacaacctccccaccatacacagggaaagggtcagccctcaggtttttggcctggcatcttgaatctcctcccaggcaacaaaccacagagggcctggcattctcctgtgaaaagcagggcggaaaggaaacacagagaacaaacccacagacaacaaacccacagaaaacaaacccacagaaaacaaacccgcagagaacaaacccacagacaacaaacccacatcaacaaacccacaacaacaaatctacaacaacaaacccacagagagcaagcccacagggaaccagccaaattatgtctgctgtgcatctcggcagacgatgctgccaccgtctgtgtatgagcatgtgtgtgtcagactttcccatcgtctccaaacttgttttcagaataatgcttccagtgaaatgagtcggccacatgaggtcacaaagcccctactctgttcagcacctggggtaagtaataatattttggagcacttagtgtggggagtagccctgacccctttacatgtcatgtcttagttcattcttgttgccatccttggaattgaggccaacatcatctgcccatttgccagacaagctgctcaggaggagagggccacagccccttatctcctcgccaaacaagagaagatccccagttgctttttttttctgtggaagagattcttttaaaaacatttttttcatggagaagaaaatctgaaaaaaaagaatgaaaccgaaccaatagtcccatagacagttagttgttgttgttgttgttttgtttgtttgtttgtttttgatgaatacagaaattgacccttctggtcttaaagcttgaaaattaaatttgttttatctgagttgcttcctcaggaaaggagcccaagtcctctccaaaagtatcagagaactgaaactcaccagatcatcttgtctagacaatgagacgtcaggccctccattcatcatgactgcttccttacccctcccgagttcctgttacatttcttccctgctatataaacccctaattttagtgggtccagaagatggatttgagactgagctccatctcctgggcagcagcacccaattaaagccttcttccctggcaatactgattgtctcaatgattgccttccttccttcctttctttttgagatagagtctcactctgtcacccaagctggagcacagtcgctctatcttggctcactgcaacctctgcctcccaggttcaagcacttctcctgcctcagcctcctgagtagctgggattataggtacccgctactacagctggctaatttttgtatttttttttttttatagagatggggtttcactatgttggccaggctggtctcaaactcctgacctcaggtgatccacctgcctcggcctcccaaagttctgggatgagaggtgtgagccatcacgcccagctgagtatgtgtgtgtgtgtgtatgcttatggggatgtgcaaatgtgtgtgtgaatgtgtgcacgtgtccttgtgaattgtgaatacccaggacttgagcacactcagttcctgatgcacttcctgttttctcagcagctgagctcaggcctggaactgagtgacagcacacccgggcacctgtctccctgggcacccctcccacgcctgcttcccacggcattcccagctcccaccactgggaaggagctggaatcatgagtcgggataatcaccgaattctcttcgaccttcctcagctcctggtttgttaaggcaaacccccatctctggcttctcctggaacctcacctgggaaagaaagaggcagccccggagctggaagctgcttcagggctcacccggaacagcagactcaacctggacccatccaggcatctcctgggagtttcacccaattgcttctgcctggcaccagctcagaggttctgacagaattggcctggggtgagacctggcatccatgggatttttacaagcttccaggtgattctacagggaagccaaggtgagaacccctgtcctagaaccaggtctgatcaggggccggtggggaactgtgggtggagaacattagtgcttccagagcctcagggttggttttgaaaggaacgtaacacatttttttttctcacaaagacatatagagagagactttttaaaatagacatatatatagagagatgttttaataaagagaggtttgggtttatataagtaaaaaagatgatagaaaatagagaatgagattaggcttccccttgctctcaaaaaatggtttgagagtcttggaactggttccactctatgatagccatgagtactgttcgcccaacttttggttctcagccttccaggccccggtgggatgagacttccctgcccccacggttgagaggagccatgggcttattctagccaatgaatggtggatggacgtgactcgtgtctcttccaggctggagcatttaattgtccaggtgagatactcagggactcgtccctccagagctgagaatggccatgtttccagagggtctgcaggagcaacctgagtctcagagcacagccaccagcagacctgctgcacgcatgtggcgggggaaagaaagaaagccagctgtctgcagccactgagagtttggggtggttgtttctcatgacaaaaccagctcaccctgacttatacaaagtctttgagttatatagatggagaatgaggctcttgggtccctctattctcacaaagcaatagcctagctaaatccatctaactagggagcagaaaaggggatgtgctggcttgcacaccctagacagttgttcaagaagtcaggacaccaggcctggagtgatacttcagccatccttctaggtgagggtcttgaggccacacagacagaagtggcagagatgggacacacattcgtcttctcactcacagtctggcactgagctgtgggctgctgggacaccatgcccccatacgagtagccttcccactccttaccttgaaggaaaagtgttttttggacaaatacctgatggaaacattacatgggccttggaatctgttagatctagcttcctgaaactcttgctagctgtgtgacaatatacaagtttcttaacctctctgagcctcagtgctctaattacactcccctcatagagtttctaagagcatcctggggctggcacgtgtcaacgcacccagtatttgatagagtttgttaaacgttggttatcctctctccctatcgcacctcaaatggtaagggctgcctgccagcttccatatccccagcagtgccctgagttgttcagatgttcatccatctcccacagaactcaggttcctttggaggaagccacatcaagtcctgctccaagcttaagccagtcagcacattccatgctctgccccattgccagggttcaggagtatgctcgtgatctaagcacccccactcccagatacagctcaagattcttgcttggacttctgggcactcaggctcctccgagagggaatcaaacttacttctctccatgtcctttcctctaggagatgcgtctttcataaaactctcatcaacactgttcagacatgtcccaccccagcaggggacagcctgggctcaagctgggatccctactttatttattttctgctaattaaacttcctaatatactccacactaagtgtgcttgcaaggcagggggtgtgggataagcggccctgcctggctgggagagggggcagctccctgctgtactatgtattaataaagagacacatgcatggcagggcttgtctgggccttggtggcagcttaggacagaaggcacgtgacagtcaggggttcaaacaacccagggagaacactgcttcagggaagacagctcagcatcttcctggcaaagataatgacattgataatactctccaaagaatttcaggattttgagcaatcagaaaagcaacacagaaattcatgtcatcaaaacgatatggctctattggacacttaagacatttattggaggctcaacaacataatcctgctggttggttttacttcattgattttccgttgtgtctgattacattgctaatgctgatggtggatgagctacggctcttttcctgcctgtcctgaggtttatccaccaatgtttcagttctgttttaagatattgtcctaagcccccagcatcgcatgcatgctgtttttttgttttgttttgttttgttttttacaaagagttcatagcccgtggaagactctcctccatcacacacttaggttccctccacaccaggcctggaaggagtctagcttctggggactgtacatatgctgtggaccatgcagaacctggagaggcggtgaccccttctagaagtgatctgcctgaatccttccctctggaggaggcatttattaaatgccaggttcctgaaaggctctgagatgggcactccctctcctgagtcgtcccttccattactgctttcctatttctggccagggttccctggcccctcctccctgctcccatgggaccccagttcatccccatctttgctcaattgccctgcactgtagtaatccattggcactcttgtcttctccaggagaaatagttggaggagaagtttatagggtttcctgggccagggctggtctacagtcactggacagcaggaaacgacccttcggggcctaggagggccaaggctggtgggcaggtacagggggagccagcactgctgtccaccactgtgcagcctggaggctgtttcccatgaccctgctgatgggacccaaggcaccccaggccacccactcccctgcccccagcagggtgtcagctccccggcttccctgcatgcctgcctgacatggacagtgcaccttcgggccacacttgccctgctagcgagcctccagtgaactgggaattccacagagtgtagaggactcgccccagcactgtgctgagaggcttcaccaaactgtagcctggcttccacctgcactaagctgcatccccagaggcgaccccagccctggctgagtcttggctcaagactttgcaatgcagccaaatcacaaaatgcacctcgtccagcccaccccgctaaaccattttcagtagttctcccctcaccgttctggaactttccatttccacgtggcccccacgttctgttttcatttctccttcagtccctttttgttccctttctgttctctctttgaagacctcagtcaccgttttctgagttggggttgagcttggtcggtactggaatctctttccgctgctgcaggagtctgaaggaatcagtcttgccgcctgtaacacatgtccagcgctgctttttctctgatgagtgtcttagtcagtttgggctgttaaaacaaatggcttaggcaacacacgtttctgtctcacagttctggaagctggaagtctgagatcaaggtgttggcagattcggtacccggtgaggacctgcttcctggttcgcgggtagaacacttcttgctgtgtcctcacaaggtgcagagagagaggggggtctggtgtctcttcctgtaagggcactgatcccatcatgggggccttacaatcgcgacctcatctaaacctcccgaaacctcatctaaatctcacctccatactatcacattggggattaaggctttaacatgtggatttcaggggacaaaggacaaaagcattcagtccatggcacatgctcagtgcctcgactcttgcaagtgccacaccacagcctctctggggctgtgtcctggaggcgtgtgccatgggccctgtgtgccatgggcaaggcgcacagcatcctcccggccaccccaccagcgagtgagctcctggcaccctggctctctctggtcacccatctaccagtcttggtgctcctgtgcactagaggaccagctgcctggggactgtgggccaactgtggccccggccacccacgaacttcccctccggccagtggctgcaatcacatcttctctaaagacgtctgaagcccagccttggggagccgagttggtccttccctgggtactgagccctagggaacccttgagagttctctttgtatctttgtagtttcttcctcaccacttaatcatttccttacaggaaacttcctgtgttcaagtgactgtatggtttctgcctccagcttcatttgtgggtgccataagagaggcaagcatggagcactaggcgcaggggatgggcaactggcaagcggggagatgcatgcagcgcacttagtgcctggtacataccaagtccttttagtctggatttcattatttttaaatgggtattgctatttttaaaagaatagttacaaatatttattgtgtgttttgaaataagtgggtcaagatcaataagatattgttgatcaattgatcaataagatatcttttattcttaaaaatcatattcttctggttcagtggggaagagactgccgacctgtatttacagcattatgtgataagtgttctccttttcaggtatgtattagtctgttctcatgctgtcaataaagacatacctgagactgggtaatttataaaggaaagatgcttaattgactcacaattcctcatggctgaggaggcctcaggaaacttacaatcatggcagaaaaggaagcaagcatatccttcttcgcatgatggcaggaaggagaaatacagagcaaagtggggaaagccccttataaaaccatcagatcttgtgagaacgcaatcactatcaagagaacagcatggaggtaattacccaccggctccctcccatgacgcatggggattatgggaactatagttcaagatgagatttgagtggggacacaggcaaaccatatcaaggtgactcctgcaagcacctacctccacccctccttcatccttgccctcattctacaatgatttggtgaaatctggtccctgcctcagttttacagcctccccatgactctggttacttcctgattagcttaaacgaaacctaactaggttgccctaggaaagcatttctgttcctgacaccccccatctgcctgctgcttccgttccacctgtatgtgtctgggcacatccctgcatccctttgctggcttctagcctactcacttcaagcatttatcccatgagtttcataaaatcgtagaagaaaagggcttgaggcagtggtggggaaatgataggaaagtcatttctggatgcattctgccatcctgcagatccctaaaccacctctccctctccattccctccctccagagaacagcttctccttgtctcctgtggaatagttccgcccacattcatgggcccttcctgtaccaaaactgtacaggtctctcttgcttaccaaacacttggcaaacaaatgtgccgtccttggaaaaattctgttgaataaaattttctctctttgatccatccaaatgttttacaaagtgctacagaagccatggaggaacaagcaattctgccttagggatcaaggtttcacacagggggtgatatctgagcaacagtgcttttttggtttgtttgttttgttttgagatggagtctcgatctgttgcccaggctggagtgtggtggcacaatctcggctcactgcaacctccgcctcccaggtttaagtgattctcctgcttcagcctcctgagtagttgggattacaggtgcccgccaccatacccagctaatttttgtatttttagtagagacggggtttcaccatgttggccaggctggtctcgaactcctgacctcaagtgatctgcccacctcggcctcccaaagtgctaggattataggcatgagccacagtgcccagccaacagtgcttttaattggcattttcttcaaagactttgatgtcctataggagggggcctatgactcagcctcagccaatcagagcgctccattccctgggtcacctgcacacctgctcttccctgatccactgcagtgccctcaccctgagatctgaaacttgagcagaggcactaaaaggcagacatgggagctgagctgtcttttgggagaatcctagtgagaaggttctccaactggggccgccaagtaagggcctcatggcagactaacccctctccttcctaaggctgggaggagctgctgtccttttgattctgtgagctacctcagttaccttcctcaaaatcacacacacgcgcacacacacacacacacacacacacacacacacacacatttgcatgcgctaggtagagctgttttccataattgccaacagaagactaactgtatttgaagaatgagctggcattcttctgctccggtagaagtcaaggcaatcagttatgagaatcagagcccacctgtgactccagaaagaggtgcataaataccaagaatttagtctctaaagtctttctttaagtccttttttaaaaaatgtgatgagtacatcacccaggaaaatcaaattgtaatgcaaccgagtcgatgcaagttttatttaggagatgggttacaatcacctggggaggctctagttaccttgatttggtctggtacaaaccctagcaccatcatccacagatccccagaggaagtcattcctggatgacttcctcatcgattttaaataatttccatttcagaggaaggcctttatctgacctgatcccctaaatattgggggaaacctacatagggacaaagacagcaggtgtctgcaatgttgagaatcagtgtgttctgtcactgtctctatcagggctggtggcacatgcaaatctctttcccactctccagttgaacactaacgccatggtgcccacaccttccttattagtccatgtacatggggtttgtcaagacagtggttcatggctctgaccctgagcatgtcagatttcaggggctttatgcaaaatatccataccagttggggtcatttcccatcagtattgctcacaatggagcctacaaacccctagttcccatccaacacatctccaaggcagactctcagaccagctcccagaaatgaggtgagtttagatcaggcagcagagaggtggcctaggaaggagtccttggagctcatgcacctgtgtctgggcaccaacaggaagatggtggcttttgctctttgggagatatctttggagccagtctctgaccacatgtccaacaggacaggcatccttggggtttccatggcagtctactgacagtcaggggtgaggattaaatggtacagagtctcactgagtgctctttgagaggtcaagcaatgagaagtcctgcaaatgattattgagctgaagtaagaagtgtaccgaatctgtttttcccctataaatataaaagcctataaatataaaaatcttggtgaaaaaaaatgatcccagcctcccacacagcacatcacacatcttctcttttcaaatttgactccaaggcccacttccttcgggaaatcatttatccagtggtatcatttaggatatttttggttgtgaggaacaaaagcctagctccaaaagacttaataaaaggatctcattggttcacaaactgaaaaactccagtggtaaatgaaggctctgggtacagttggtacaggctctggtctctgtaatttcctagttcttctcccttctagatgctgggtttttgccttcaagttggctttcttcatggtggcaaaatggatccagcaattctgtcagaggttttcgaagcagagtgactccatcttgattaaaggctgtgtaaaatgaggatgagacttgctggactgcattccaggagggtaggcattcttagtcacagggtgagacaggaggccagcaggattgatatcacaagacacaggtcacaaagaccctgctgataaaacaagatgcaataaagaagccagccaaaacccaccaaaaccaagatggtgattaatgtgacctctggtcttcctcactgctcattatatggtaattgtaatgcattagtgtggtaaaagacacttctactaactccatgacagcttacaaatgccatggcaatgtccagaagttaccctatatggtctaaaaggagaacctatatagtctaaaagaactgagggttctgagaaatccctgaccctttcctggaaaatttatgaataatccactccttgtttagcatacaatcaagaaataaccatagtgtactcagtcaagcagtccctgctgctgctctgcctatggagtagccattcttttgttctttactttcttaataaacttgctttcattttactttatggacttgccctcaattctttcttgtgcaagattcaagaaccctcccttggggtctggatcaggatcccattcccgtaacaatttcaggctcagatcggcttttaacaccatccagagcaagagaaagcttttttgttccagaattccccattaaagttctcctggtcactcttattgggttgtttcgcttagggtcaggtgtccatcctggtcccaagcaatgaggccaggagatgggatgcaacgactggatcaatctaggcctcttattcccactttttaaaacacttattattattattttttaaaaattatttttcattcagctttttcatttgaaacttattccaattcttgaactgggggtagtttcaactttcctagagctgtatgggtcctcaaatgaaaattcggggcagctggattagagaagggggaaatgcatgctgcaggggcaaccaacaaggggagattgtgccaattcactcttcctatcctcagattcacctaagttctgaccattcagccccatttgaatgcattctgtattcctatgactgtggattacatttttgtctacctttgtgtcttctgttttgtcctgccctataagcatctcaaacatatgcataaagcctatataaactttataaataaactaacacttctgttttcaacctgtaggatgatgacaatgatgatgacgacaatgatgatggtaatgatgtggaaaatgtgaaaagagaaagaaatacttggaaatatatctcaccctccataaacaaagctcggggtttaattctgacctgtatgagttcatggggtgaactgcagaccgctgtctgtggacaggaaaacgatatttcatctctagccccagggacatctccaaaagctgagctagatgaactttatataaattggtacaaaatataattttctctttgcctgctgaaagccatttctagaaattctgttaatcagaatctccctaagttaatcagtcatctagacagatcttatttcttttttagacaaagaaaagtatataagtaacaggtattggtaaaccacttgagtgaagcatatgatatctaatgtaaggaaatctaaaagtgtccacaggcaaaatctcatggattcaattgatagcacaggtcatcaactgacatgcagacggaattctcttgtggaacaagacaatacagccattgcttagagactaattgtcaaggaattagtcatttcctgtttcagaatagcatcatcaccaccaccattaatgccaacatcaaccaccaccacctacgccaccaccgttagcatcataaccaccaccaataacatcaccaacagcaacactgccatcaacataaaccatcaccaccaccaaaaccattagcatcacctagaaccaccagtcaccaccatcaccacttaccacaacaaggcttatatttacatacttattttacttttcgaaatacattcacatgcatggtttcattagatcttatctacttggtaaggttggcagatctgacatcattagcctcattttatctgtatggaaactaagttctagagaagcgaagtgatgtgtgaaaggacaccagagtgattgataatcaaatccagactagagtttggttcttctgactccaaaattaatacatttttcttaaaagaaaaaaattttttttgagacagggtctcactctgtcacccaagcttgagtgcagtggcatgatcacagcttactgcagcctcgacttcccaagctcaagcaatcctcccacctcagcctctcaagtacctgggaccataggcacatgcctggctaatgtgttttaaacattttttggctgggcacggtggctcatgcttgtaatcccagcactttggtaggccaaggcaggcggaccacaaggtcaggatatcgagaccagactggccaaaatggtgaaacctcatctctactaaaaatacaaaaaaattagccaggcgtggtggcacatgcctgtagtcccagctactcaggaggctgaggtaggagaattgcttgaacccaggaggcagaggttgcagtgagctgagattgtgacattgcactccagcctgggcgacaagagcaaactccgtctcaaaacaaaacaaaacaaaacaaaacaaaacaaaacaaaacaaaacaaaacttttttttttttttttttgtagaaacggggtctccctaggttgcccaggctggactcaatcttctgggctcaagtgatcctactgcctcagggtctctaaatgctgggattcaggcatgagccaccacacccagctccaatgctttttttgtcgtacctaattctttcaatgaaaatgaagaatttccaacttctgatattaacaactttggtcctatattcaagctagagtctttcaaataaaatagacttttaaaaccatctgtctccaaaccctaaatgtctcaggtgagcaactaagctgctcagtttatgtgactccccagaagttgaattttaacccagaactgactccaagttcattcttctttccacgacaaggagtcacctccttgtatgcccccaggagtctcccggattcctccgagaacagtggaatagtgctcctccccagagcacaggttttgccagtgaagattgaatttggctagaaaccgctgccctgctctctcttctcgaagcacctggaagtctgagaaggaactgggtggctggctctggtcacaaactagcagccagaagcaccccttgtcagtgatgcacccccagtccccctcaagggctccaagtaaacccaaagctgctcccctccaagaagtctggggccaccctagggaaggcctcctggccttgactctcagggggtctctggggttgcggtttggggcccgctgcttccgccctttgcccccaggtgggcctggcagggctgcagcacagctctgttgctgatagacagggtggagcacttggcgaccttgccctgcagccctgtcattttgagttcagaggtcagatttgagtaataaacatcttctaaggacttgtcattctttctgaggatgttgctggccagccggaagacgaaaatcaccgcgtagatgccgatgatggtgagtatataccaggcagcgctggttccgtctggcaccttcagagccctggtggagttggtgtcattcctcccctctgtgtggtcacccagcaggagccccaggagggtgctggcctgggtctggttggaggcttcatggggagtccacttggcccctgagaaacagagaggtccggatgagatccagcgtcctgggctgagggctgcctggccacaccaaggagaatggagccctcatatccgtgaaaacgtgtcgctgctcaaagaggccttctctgaggcatgagcaggagtgtaacaacaggtatgtcaatatatttttaaaaatcaaaagagtccaaaacactattttgttgttgttttgttttgttttttgttttgtttgttttagagagacagagtctctgtcacccaggctggagtgcagtggcatgatcataacttactacagcctcaacctcctgggctcaattgatcctcctgcctcagcctcacaaatagacatgcagcaccatgccgggctaatttttttcttttttctctctctttttttttttgtagagatagggtcttgccatgttgaccaggctggttttgaattcctggtctcaagagctcctctcaccttagcctcccaagccctgggattacaggcaggagccactgtgcccagaaaaacactaagttcttgaataggagacacaacatcataaagatgtcagttatccctcaaataatttatacaacaaacataattgcaataaaaacagcaataggatttctttgtgaaatcaataaactattcatttagaaaaatcaactgttggccgggcatggtgtctcatgcctgtaatcccagcactttgggaggctaaggtgggaagattgcttgagcccaggaggttgagaccagcctggccaacatgacaagaccctgtctctacaagaaataaaaaaactagccaggtgtggtgtgcaagcctatggtcctaactactcaggaggctgaggccggaggatcacttgagcccaggaggttgaggctgcagtgagctgtgttcacaccactgcattccagcatgggaccctatttaaaaaaaacaaaaaaagaaagaaagaaaaagaaaaagaaaaatcaactgtcaagactaattagaaaaaaaaatctgaataaaaagaatgactaatgaattagcctagccacaaattttaaatcagccagctataaaaactaatttacatttttttcaatgaatgaaagctttatatgcacaaagcccagctgggacttgctgggctttgcagagtgtgtgggctgggggttcttcagaaccaggtacaactctccctataaaactacaacagtgctgggcatggtggctcacacctgtaatcccagcactttgggaggctgaggcaggtggatcacctgaggtcaggagttcgagaccagccctgccaaaatggagaaaccccgtctttactaaaaatacaaaaattaaccaggcgtggtggcacacacctgtagttccagctactagggaggctgaggcaggagaatcgcttgagtccaggaggtggaggttgcagtgagccaagtgatgcctgtagttccagcaagacagagcaagactctatcttaaaaagtaaaaaaataaaaaataaaactacaacagctaaaatagtgtgatgcctgtagttccagctactagggaggccgaggcaggagaatcgcttgagtccaggaggtggaggttgcagtgagccaagatcgggccactgcactccagcctgggtgacagagcaagactctgtcttaaaaaataaaaaaaataaaaaataaaactacaacagctaaaatagtgtggtgctgaaaacacaggcaagcagaccaatgaaacagagtaaaaacagcatcaatagttagcaattagaatttgatagctagctaataaaggagcatttctgatcggtgggaaaagatgaattattcaatatgtagcattgggggaaatagcattagatccacatctctccaccatatgaccagataaatcggtccagattaaaaaaaaaacagcccagataaatcaaatattttaacataaaaagtgaaataatttatagtactagagtacagcatggcagattttttctttatcatctcagagtggaatattcttttaagcataacaaaaattcagaagaaacaagaaatagaaatcaaattcaactacataaaaaaaattaagctatttcataccataaaaccaacaggcagatgacaaagtgcaatttatatcactgattttctaaatagccttcggttctgtaagaaaaagtttaaaactgcagtagaaaaatgtgcaaaagatatggacaaatagttcacagggaaaaaatgaacattcaacataagaagagcttctcaatatcactcatataagaaaaatgcaaattaagataataactagataccattttgttacctattggacttgcaaattcatgatgtttcagaataaactaacaaaaaaatggcttttttttgttcttttgtccagcttagaagaaaggtgtctaaattgggagcaaaggtggcaatgacgtggacttgacaccaaaaaaaaatttttttaaagaaaagaaacaagtgcctctgcatttcaggggtttaggattggcatttttaaaatgtcaacaaataaatgttcatatccacacttgacattttttccaaggagaattttaattgtataattgctggtaaattcatgcagccaacatggagggcacacggacaagatctatgagcattacaagtgcacttacctttgacccagcaattctatctctaggaatctatcctaaagatgctccagaacatctagagacaacatatgctgaaggttagtcattgcagtcctccttgtgatgacgaatgcctgggaacagcctgaatagcaccaactgagggatggtgaaatacattttggaacctccatgcagtggagtactacacagtcataaaaagcaatgagttttttatggtactgaatgttaataagtgaaaaaataagctaatggtgacatgctctgcaatgccacttgtaaagaagggggaagttatatgttatttgcttgtactttttttatgtatagaacatctctggaagaatgaataagaaattagtatctgcaattgcctctggggaagaaacctgggggaagaagatatattttttactgtttgcccttttgtacacttagtaccgtgtatacttatttttgaaaagcaagagtgtaccagttggtacttttctggtctccctggtgaggtgcccctgggtaaagccgttgtatgcccttgtaagaccagaagattaagatctcaattgctgttcaattcaaaactgttttctctgcttggagagctggtggagaaaatgaaacaatgaaaaccagagctgtagagtgcaatcctgtgagacatttcccagtggggccttactggctcaaacccccatttcttgctctaatgtgaacacagatgtatttaaaaacacatcataggatcaatcttgcagcctgctgtgcagaacaaaggtgctccaaaatgcttcccatttgatcgttgtttgttgctaattcattttgcgaacgcaagactcagagaggccagtattttttattatagttagttgccagaatgtgtgaatgagcttattacttttagatgaaggaagaaactatttaaaaattacttttcaaactacatgtgacaaagcccaggacaaatgaacagatttaattacataaaattagtcactcgcaagaaacaacaccacaagcataaatttacaccattgtttggtagaatggtttgagacattaaagtaaggaaggtgaaaaattcccgtaattattgcaacaaacaaacagacagcaaatcaacccaacaagaacacaatatccttatattagggcaagagaacttattgaaactcagaacacatgtataaactcatagaactttctagaaattgtcatagaatgatgcaacacattcaaatacaaataaaatatccccaactaagagctacacacagaacattaaattatttaaaaaccagtccattttctacacgaaagaaactcactatattaattactgcaatacattacattttacctttcttacaaaggtaaaagtaagttaggttgtatcttaatggacaaacatatcctgtagaagagagaaactttttcctctgtgctattttgtacttgtaatttaatgacgtgaaatatgtaaaatctcaacctgcccatccttgcattgtagctgagtactcacattccatggggtggtcttgtccttgactcttggaggggcaagttcaagcggctaccatgcacagaaggggaagatgatgaaaggagaactccgtctcctagggaagaatcagtcctactgcagttgagctgcactgagtttccagagtggggagtaatatgatcttccaacaatcttagggcagcaccaaacagaaacttagtaagtggatgactttgctttcatgcaattaatcagaggatccgatttgctgtgtcttctgttgcatcagaacagaaagcacttcccagctttgacttgttaagaagttctcaatcaaaacaaatttttaaaacgtgctggtattaaggaatctccatctctcaggtcccatcatgaactgaggtggccagaagctccccctgaggctggctctccgcttagagcttggatggctattgaattcccctgtgttctgcacctgttgcaggtgtggcagatggccaggtgtggcagagatctgtcatcatagggccaggaaactccatggtcaagagtcaccagcttcctctggacagtctcccagatgaggaaacccagacaggaagggagtgacaccccaagggtgacacacctgaggggacttgggctttccctgaggggtcagtgggcagtggactcctgtgccaggtggtgagaaatggctcttctctttcccagagtcacagaccccattggagttgaggtaggcttaattggaaagtgttagagtaagtgtctgcgggtaaagtttccccaggagcagggagggaaaagttggaagactggcaagttaaatcatccagccattgtttccagttccatttcttcctaatcctcactctaggactctaacttgccacgtttgtgatggttgctggtttttaagatacaatttgatgaaatttccatcaatggggtactgggtaagtaagttataaaataagccatatgatccagcaattctactcctgggtatcttcccaggagaaataaaaatgtaagtttacacaaaaacttgaacacacatgttcaaagcagcattatctgtaatagcaaaaaatggaaacaacccaaatatccaacaactgactaatgaataaataaaatgtggtttatccatacaatggaatgttattcagcaataaacaggaatgaagtactgatatatgccataacacggatgaaacttgcaaacattgtgctaaataaaagaagtcagtcacaaaggactacatattgtaggatttcatttatatgaaatgccaagaataggcaaatctacaaagatagaaaatagattagtggttcactagcgggagggattgggggtgataactaagggtatatagcatttttggaggggtaataaaacttctaaaattgtggtgctcactgtacacaatctgtgaatatacaaaaaaattgaatgcatactttaaatggatgaattttatggtatatgaattatatttcaataaaactgttaaaaattataatatacaagctgggtgcagtggctcacacctgtaatcccagcactttgggaggccgaggtgggtggatcccctgaggttgggagttcgagaccagcctgaccaacatggagaaaccctgtctctactaaaagtacaaaaaattagccgggcatagtggagcatgcctgtaatcccagttacttgggaggctgaggcaggagaattgcttgaacccaggaggcggaggttgcagtgagcagaggttgtgccattgcactccagcctgggcaataagagtgaaactccatctcaaaaaaaaaattataatatacatatacaatggagtattacacagctgtgaaaaagaacgaggaagctatttatgtactgatgtataaagctctctaaggtgtgctgttatgaaaaaggtaaagaagagagcatgttaacatgtatccaaaaattgagaggaagcatatatatatatatctgattttgccactgtaagcatttaaaacaccagtggaatatccaagaaattaagaagaggggttacctattggaggagagaaccaggtagatatatggcaggtgtgggagggagagctctcactaaatatttttatgctttaaatatttttaaccgtatgtgtattacctattcaataataaatgcacccatttgttagatatctttgttgaagattcatttggctcctgctgtctcttgctatgggatggaccatggcatcccccctctgccacacagacaagggatttggacactgccagtgggacgtgggaggggagagcacctgacccgtgataataaggggctcgtggcagtgataagggctgggagtcagggctctggccccagccacatccttgctgcatgaccctgggccagccccctcatctttgtgagcctcagtttcctcatctgtgaggtgaaggtggtgaaggaggtgaaggatgagcaggatcttatgtccttggtcctgagaaggcaggagagaagcctggggctctgtgtgggaagagccgctctctggggaggtatctgaatagatgagggagagcacaccgggcagccaatgtgccagaggtggaggctttggagagtgtttcatttgtgaagtcaacagatttaacattcagatcaggaggacgttggcatgagatgtggggaatcataagctccaaaacaatcgtgagacagaaggaaagatggccttttgttgagcagccattctcctccacggagagtcctgtctagtctgcctgttgaaggggcactgatgttagggaatagatctgtgtcaaatgcttcccacctcccagaatcctgtgaggcaggagtattatccccatttaaagagaggacactcaggctcagggaagtgactggcccaatgtcccatagctcataggtgccagaggtgggtcatccacaccaaagtcattctccttccataccctgaatgtcaccttcacgctggacccaggatcctgtgtggtgaactgtctcgatcacttccctaaaggttaaatcataaactcttactgccaaggcatatccacgaccttaaactctccctgttgggcaaaaacaatctctgatgttaaaaggcaggatagtggatacttttcagggaagggtaaatgacaagggcatgaggggaactctgggtgccggtcatattctgttttacaggtttgttcaatttgagacacttcatagagctgtagccttgtgcacaggcacttttttgcatgcatcgtctgcttcaatataaacctcttcctgttgtcttgtttttgtttttgtttttgttttctcttgttttcttgtcctgctctgtcacccaggctggagctcagtggtgtgatctcagctcactgcagcccctgcctcccaggttcaagcgattcttctgctcggcctcctgagtagctgggattacagaggtgtgctaccacacctggcttccctgttgtttctttaatgtagaaagccctgatagatggtgggaaaacaaagtttaaggtattcatagaaaaatacaaatactatttttaaggattctatatctggccacatggtgccatctcacgaagagtgtccccgtcccttgagggggagtggtcgggatcatggtcagtgtggggccctgcagctgcctgcttccctatgctgtgtggatgacgcccgcctccggtcattcccctgtgcttacataacagtgaaatggaacaacctgtatcagcacgagggccaagaattttcttctgacttgtggatacctccttccttaggcctctgatcagtctggacaaatattgccctgaacgcaaccaagcaaagccactcacctggtaaatatttgtatgagctacagttctggaagaacaaattccaatatcctgcagtccccttgacatcaaagacccaactctcccagagggcaatggcttttttgtccactgagaagccagtcagcttcgaagaaaggtgtctaaattgggagcaaaggtggcaatgatgtggacttgactccaaaagaaattttaaaaagaaaagaagtgcctttgcatttcagggggtcagtattggcatttttaaaatgtcaacaaataaatgttcatatccacacttgacattctttccaaggagaattttctagaggagacagacctcatcggtcagctctgatgccctgcagtgcaaaaagacattaaaaatgacggtaaaggacccctgcagagaacaactgagtctcttccttgccctgcgtctccagataaaggatgccctgcatccatcccctcctggctaagagcacagactccagaggctttttcctctcctggaggttaaagaggcatcacatatgtttaaaatctttaatttatatgtcacctttgtccttccttttaacttcatttttctcttatccagcatttagggactcatctttagggaggttcaaaggaaagctcatggcctttagaactggaagaaccatgttccagttgggacttgatcatttactaattgtgggattacagccaagtcacttcatccctctgctgtaaaaaaaaaaaaaaaaacaaaaaaaaacatatgatgacatttgtggaatggctccccaagccaaagagggcaaatattgtcacagctcatttcttctctcagttaattacttgcgtcctcggctgcctggctggcaggacaacctatattcgcctccctcttaaagcctcctgggttggccaggactccaagcggctttgtccagaatgagtagggtggttggcctggcctcctcagccaatcagagaggactagcatctgaacactcctctgtgctattgcttctagctgccacatggggacgctgttgaaacaccggcctggtgcagttggccatatgatgcttcagggtcttctgagacttcaagaatgtgctcacagggaaggtattagctctaaacacttgcctctgctagtttacatcacagaacagacagacaagactgttttgctccctcagctctctccttttcctagcttcagtcctggggagctcagaagctacagtttgttttttgttttttgtttttgtttttttcttgagggagtcttgctctgttgcccaatctggagttcagtggtgtgatcttggttcactgcaacctccgtctcccaggttcaagcaattctcctgcctcagcctcccgagtagctgggactacaggtgcctgccaccatgccaatctaatttctgcatttttagtagagtcaggatttcaccatgttggccaggctggtcttgaattcctgacctctggtgatcacccacctcagcctcccaaagttctgagattataggcgtaagccaccgcacccggccagaagccacagtttacaaatctgggggatttggggcatgggaacagaaacagaagagtcccaatgaaaggaagataccagctgagctgcccactctcccagctgcagttctcctgcccacagcaggccctagctgggacagggaggagccccagccttaaatcaaattcagaattttgtttatgacataagactgcacatcttaattactgaattaagactatattttccaacctatcatgactataggtgcagggcaagatcaaactccagtgtatgtggggcccgcagaagagatttaaagaaacagtgggggcagaaataaagctgtgtggttatcagatcccatgagtcttgtctgtaaggatgatggttacagtcgggatgctccagagtgcaaagccacatctcaaccagagttagtaacaagggagagtttactggttcatgtgaggaagagagaggaaggggagggctagccaaggggctggatgcaggaaggagggtccccagggttctctgtccccctcctgtcttccatctctgcctctctcagcaggttggcctaatttcctccgactgcagagaagcacacaagctgtggcacctggtgctcagactcacactgcaacacttccaccagtagatggcagagaggtactttcctgcctgttcagccacgaaaatcccaggggatggctctgactagcctaagtcaggaacctgctgtgggcaatcactgtagcattaagatgggggccagtgatggagccggtctgcagcacatgctcagcaaaagacaaaacccgcctgttttagatcactccggctgcatcacagagtgtggattgaacaggcacagaactggaggcagagaaacaagttaggcagctgcaggcataatccaggcaggagatgacagtatttgaaagaaggagtgggagcaagtctggagagaagtcgatggatccaagagatttttagaaggtagaatgtgcagaacttaattagttggtgcagtgggttgaatggtgtctccctaaaagatatgttcacctggaacctcagcatgtgaccttatttggaataagggctcttgcagaagtaagtaaggtgagaatcttgaggtgagatcgtcctggattacagtggaccttgtatccaatggcaaatgtccttataagagacagaaaaggaaaagaaagagacacagggaagaagatgtgaagatggaggcagggattggagtgatgcagcctcaagccgcagaatgcctggagccaccagaggttgggagaggcaagaaaaggtcctcccctagagccttcacagggagtagcgtcctgccaacgctttgattttgagctggtctccagaactaagagagaatagatatctgtttttctaatccaccaagtttgtggttattttgatgcagggcaggcaagcccccaaattgggttgtagcctgagagggttcttgggttcattcaggaaggaattcaagggcaagctggtggtattagacagcaacttctgttgaagcagcagtggacagcagcagcagaggtcctgctctttgcagagcagggctaccccataggcagtgtgcccagagtagcagctcgaaggcagttctgtagtcctatttacacccacttttaattatatgcaaattaaggggcagattatgcagaaaattttagaaaaagagtgctaatttccaggttgtcgggttgttgccatggaaaggggccgcaacttccggtgaactccatagtatgtggcacacactggtgggcgtgtcccatggaaaggtgcttccgccctgtacctgttttagctagtccttaatatggtccagtatccgcgccctgcctttggagtcaagttcaacttcctacctcaattgatgatagcagtttctgaaaactaacacatgtagatataaatataagtccttaagtctatcattattatgcatatcctataggggagtcatcgcgaatgaaactgaacttattgtggttcattcattcagatatttatttaaaaatatttattaaagcttactgtctgccagtccgatactgcactaggtaagtgctggggttacaaacagaacaagatagacagattagttgcccgcatggaacttatatctagtgggaagagaagcaaaaaaaaagtaagcaagcaataaacagtaaaaaaaaaaatactgggatttgagccataaaaaaagaaataagatgcagaaatcagcaataaggaggttggggagaagatccttctttagaaagaattgccagagaaggtggttgggataggcagaaaaaatagtaatattcctcttttatcttcacctatattagatgatcaatagatatttcctgagaaatgaaggactgagtatattataagaaggtatgattaaaaacaatcaccagaatgaatggctaacaagcacatgaaaagatgctcagaatcattagtaatgaaagaaacacaaattaaaccacaatgagataccacttcacacataaaaaggaattaacacttgctggtgaggatgtggggaaatgtcatatttccccacagcagccatagtacactgctggtgggaatataatatgatgcatctgctatggaagagaatatagtggctcttcaaaacgttaatcctagaaagcctgggcatggtggctcccgcctataattccagcacttcgagaggccaaggtgagaggactgtttgagcccaggagtttgagagcagccttggtaacatagcaagaccctgtctctataaaaatcaaataaaaaataaatagaggaaaagcacattaatcatagaactgccatatccaccacttccactccttggtatataccccaaagaactgaaaacagctattcaaagaaatacttgcacatgagtgttcagattattaacggaaaccaaaaggtggaaataacccacatgtctaccaatggatgaatcaataaacaacacatggtctatccatacagtagaatattgttgagccataaaaaggagtgaagtgctggtacattgccagaacatcaaagacccttgaaaacattatgctaagtgaaataagccagatgcgaaaggacatgaattatatgatttcattgatataaaatgtccagaaaaggtaaaaaatatccattgagaccaaaagcagattgtggttgccccggactaaagaaagagtaattacttaattttcctgggggtttcctcttggcatgatgttctgtatacaggacatacaaaaagcctttattttttattcttagcaaatacttaattagtactcaccatgagctgggcatgttctaagtcactttccaattactaacaaatcacttaattatattgacacaaaaagaatgggcataatgcataaagcaaatacgaacataaaaaagaaatctccctattaatatcatttatgttgaattcaatgcagggagcatttaaataagataaagggagatacttcataatccacactggtcagctaacatcatgactatctatgcagaagataaaccagcatcaaaactcataaagaaaaatttatagagagtaagaaaaaaatgaagaaacagtttagaggtaggtaatttgaatttactgttcggtgcataaaagaacaaataggccagacgtggtggctcaggcctgtggtcccagcacttcgggaggccgaggcaggcagatctcgaggtcaggagttcgcgatcagcctgaccaacatggtgaaacctgtctctactaaaaatacaaaaaattagctgagtgtggtggcgtgcactgtaatcccagctactcaggaggctgaggcaggagaatcgcttgaacctgggaggcaggctgggcgcagtgactcacgtccgtaatcccagcactttgggaggccgaggcgggtggatcatgaggtcaggagatcgagaccatcctggctaacacggtgaaacctcgtttctactaaaaaaatacaaaaaaattaaccaggcatggtggtgggcacctgtagtcccagctactcgggaggctgaggcaggagaatggcgtgaacccgggaggaagagcttgcagtgagccgagattgcgccactgaactccagcctgggtgacagagcaagactctgtctcaaaaaaaaaaaaaaaaaaaaagaaagaaaatacaggccacacagatggggagatgataattgcaagttatatatttgataaaggactttcattcagaatatatgaaatagtcttacaatttaataaaagaggacaaacaacccagtaaaatgtaggaaaaatatttgaacagatgtttcaccaaggaaaaaatacaaatggctaatcagcacatgaaaagatgctcaacatcatttagtcattaaggaaatacgaactaaaaccaccataatatatcactacacacctgccagaatggctataattttaaaaaaatggacaatactgagtgctggtaaggatgtggaaaaacagaaactctcataccttgccagtggcaatgttaaatgatacagctattctggaaaacagtttggcattttcttaaaaatttaaacttattatatgacccaacaattccactcctaggtatctacccaagaaaaataaaaatacatgtccacacaaggggacttgtgcataatgttcatatcagccctatttgtaataacaccaaattggaaggaatccaaatgtccattaactatgaatggaaaaccaacattcttacaaataattcaacaataaaccttcatgaaccttagaaacattattctgagtgaaagaaaccagacacagaagaccacaaggtgtaggactgtatttatttgacatttctagagaaagcaaaactgtagagacagcagatcagtgactgccaggggctagagacggaggcaagggttgatacaagcaggcaggaggttgctttctgggctgatggaaatgttcttatgctggattgtggtaatggttcacaactgtataaattaacaaaaaattatcagactatacccttacaatggtatgtacatttcatccaagtaacgctgctttaaaatttgaaattaagcacctaatgatattaagaaatgaataacaaaataaacccaaagaaagcaggggggaaaaaaagcaattggaaaagatgagagcaaaaataatgaaaaaaaaaacatctataatacatctagcggttggttccttgaagaaaaagaaagaaagaaatgaaaaaatcattaactatcctaataaagaaacaaaggagaaagaacaaatatacaaaataagaattgtgaatgaaataattgtagacacagaggatatcaaatgagtgactcctcaatccctctgcaaatagattcaaaatcttgaccaaatggatgattttctaggaaaatataaattaccaaaactgaccaccaaagagattttaaaaatcagaaaatatcgtttatcacagagatggtaaaaaccttgataaaaagtcatttacccagagaagcatctggttccaacagctttgcaagtgcatcctattaaaactttattgattggcaaacgctaattttttttaatttttatttttaattatactttaagttctagggtacatgtgtacaacgtgcagttttgttacatatgtatacgtgtgccatgttggtgtactgcacccattaactcgtcatttacattaggtatatctcctaatgctatcccttccccctcccctctccccacgacaggccccagtgtgtgatgttccccactctgtgttcaagtgttctcattgttcaattcccacctatgagtgagaacatgcggtgtttggtcttctgtcctttcaatagtttgctcagaatgatggtttccagctgcatccatatccctacaaaggacatgaactcatccttttttatggctgcttagtattccacggtgtatatgtgccacattttcttaatccagtctatcattgctggacatttgggttggttccaagtctttgctattgttaatagtgccgcaataaacatacatgtgcatgtgtctttgtaacagcatgatttataatcctttgggtatataccctgtaatgggacggctgggtcaaatggtatttctagttctagatccttgaggaattgccacactgtcttccacaatggttgaactactttacagtcccaccaacagtgtaaaagtgttcctatttctccacatcctctccaacatctgttgtttcctgacttttaatgatcgcccttctaactggtgtgaaatggtatctcattgtggttttgatttgcatttctctgatggccattgatgatgagcgttttttcatgtgtctgttggctgcaaaaatgtcttcttttgaaaagtgtctgttcatatcctttgcccactttttgatggggttgtttgatttttttcttgtaaatttgtttaagttctttgtagattctggatattagccctttgtcaggtgggtagattgcaaaaattttcacccattctgtaggttgcctgttcactctgatggtagtttcttttgctgtgcagaagctctttagtttaattagatcccatttgtcaattttggcttttgctgccattgcttttggtgttttagacgtgaagtccttgcccatgcctatgtcctgaatggtattgcctaggttttcttctaggttttaggtcggacatttaagtctttaatccgtcttgaattaatttttgtataaggtgtaaagaagggatccaatttcagctttttacatatggctagccagttttcccaacaccatttattaaatagggaatcctttccccatttcttgtttttgtcaggtttgtcaaagatcaggtggttgtagatgtgtggtattacttccaagggctctgttctgttccattggttctgttctgtctctgttttcgtaccagtaccatgctgttttggttactgtagccttgtagtatagtttgaagtcaggtagcatgatgcctccagctttgttcttttggcttagaattgtcttggcaatgcgggctcttttttggttccatatggacgttaaagtagttttttccaattctgtgaagaaagtcattggtagcttgatggggatgccactgaatctataaattaccttgggcagtatggccattggcaaacactaatgtttttaaactgttctagagagcatggagaaaggagaaaaccttccaaattattcctgtgaagcttgcatgtcaatgattccataacaataactatagaatcaaataaccacaataaaagaaaaacacagaccaactccacttatggatatagatgtaaatattctaaatacaatattagctgatagatctaacactgcattaaaagatttgtggaaggagttgttcaatattaggaaatccactctgtgattatctcaagttagcaattagatgtatattcaatgctgaaataacagaagcaccccagtttagtcagaaataagacccaattacccattatcaccaccaccatttagtattgcactggggaattaccaattcagttagacaagagtggggaagaggtacaaaaactagaaagaaggtggcaaaaacaatcattgactgtatgattggaaaaaataagagaatcaattgcaaaaccattagaaagagcaggataattcaggaagctcagggggcacaaaataaatgtttttacaaaacaatatccaagaatctatattaacaacaatatctttgagatataattgaatagaagattccatttacaataggaaaccccaaagatagaacacccaagagttgcacaaaatttacacaaagaaaatctaaacaacagagggacaaaacggaagatttgactacatgcaagtatatttcctagtcttgggtagaaagactcatctgcataaagatgacaatccttcctgaattaatctataaatttagtataattccaatggaaatttcccttgttttgttgttgttgtgctgtttttgttttgttttccagactacactgaatgccaaatattccatttagtgattttcttcttcccttttcctttctaatgacatattttgtgcttttcagacctgcctttctttctctcggcaccaatgaataaagttccagctttaaggcttgaaaaatcacagcaaagttgcagcaaaattaaaaggaaaaaaatgttctttttttttcctgcagctgcagagagtggcagatagcatcctgcgtgataaacgcctattcttggctaggcgcagtggctcacgtctgtaatctcagcaacttgggaggccaaggcaggcaggtcacctgaggtcaggagttcgaggccagcctggccaacaaggtgaaaccccgtctctactaaaaatacaaaaattagttgggtggtggcgcacacctgtaatcccacctacttgggaggctgaggcaggagaattgcttgaacctgggacgtggaggttgcagtgagctgagatagtgccactgcactccagcctgggtgaaaagagtgagactctatctcaaaacaaacaaacaaacaaacacctatccttgcctatgtcattttaacaaaggaggaagtaaatcccctggatttcagaggctgatgctctgcccaagaaaagcaaccctaacttccccaaaggctaaaattcagactgattggctctggcagagatatttaaattgatacctctgtttcctcaaaggtataagcctttgcgaactttctttggtttctctcttctctcacaggaggcaggggataaacaaatatgttagatttcttatttaaacaaagagcttgagggttttgcctcatcgaaattaacagagacaagttgatgctaatatttttatggaaaatcgaatatgcaaaaatagccaaggaaattccagggaaaaagtaatgaaagaaaatatcaccaaaagatgttaaaacattttggaaagccacagaaattaaaagtgtttgatcctagcatataaacaagcagacaaggggctgggcatggtgactcatgcctgtaatcccagcactttgtgaggccgaggctggtggatcacccgaggtcaggagttcgagaccagcctggccaacatggtgaaacctcgtctgtactaaaaatacaaaaattagccaggcatggtggcacgcacctgtagtcccagctacttggcaggccgaggcaggagaattgctggaccctgggaagcagaggttgcagtaagccgagattgcaccactgcactccatcctgggcgacagagcaagactctatctcaaaattaaaataaacaaacaaacaaataaataaataaacaggcagatagatcagtggaacagaataaaatccagaaatagactgaaaacattcaggaaaacagtataaaataaaggggacatttcaaatcaatggagaaaagattagttatctcagaaatgaatgggacgattgagtagactgggaaagagtaaaactggagctctacacacaccaaaatacattccagatggggctaagattttatatatctatatatgtttaaataaagccatgaaagaactagagcaaacatgagagatttatttttataatcccagacggtggcaatctttccaagtgtggcacaaaagtcagaaatcattaaaaaaagactgataaatccaactacacaaagttagacatttctttatggcaaaaaatgctatcaaaaagtcaagagatcaatgataatgggggaaacatttgtaacacatacaataagctgtccaattttttaatagtcaaagactttaacattaagaaacagaccagctggctgggcatggtggctcgaggctgggggatcacttgaggtcaggagttcaagatcagtctggccaacatggcaaaaccccgtctctaccaaaaatacaaaaattagctgggcatggtggggcatggtggtgcatgccagtaatcccagctactcaggaggttcttctggcttctcagcttgcagacagcctattgtgggaccttatgattgtgtgagttaatacttaataaactcctgtttatattatgtgtgtgtgtgtgtatatatatgtgtgtgtgtgtgtgtgtgtatacacacatatactggaatatatgtatatacatatatacatatatacacatacatatatatacacatatacatatatacacatatatatacacatatacatatatacatatatacacgtatacatatatacatatatacacatatacataaatacatatatacacatatatatacatatactatatatatacatatacatatattcattccattagttctgtccctctagagaaccctgatgaatacagtgggctacacacctattggaatggccaaaacccagaacactgacaacaccaaatgctggtaaggatgtggcgttttttatccgcattcattgctgatggtaatgcaaaatagtgcagccagtttggaacacagtttggcagctctttacaaaacggcgtgtactcttaccatacgatccagaaactgtattcctaggtatctacccaaaggagttgaaaacttgtaaccacacaaaaacttgcacacagatgctcatagcaagctttatttattattgcccaaacttggaagcaaacaagatgtccatcagtaggtgaatggataaataaactgtggtgtatccacacagtagaatattattcagtgctaaaaagaaatgagctatcaagacatgaaaagacatggaggaaactgaaatgcatatgactgagtgaaagaagcccttatgaaaagctacatactgtatgactctaactatgtgacattctgaaaaaggcaaaactatggtgaaaacatcagtggttgccagcagttgagacgggtggggggaagataaccaggtagagcatagaggactttaagggcagcgaaaatgctctgtatattactacgatggtggatacatgtcattatacagcaggtccttggatgacactatctcattcaacatcattttgctataaagttgatgagaaaaaaaagtcaattcctagccaggccactgtctctgtggagggtgtgcgttctccccatgtctgtgtgggtttcctctgggtcctccagtttcctcccacatcccaaagctatgcacggtaggtgaactggcatgtctacatggtcccagtgtgagcgagtgtggaagtgggtgagtgtgccctatgatggaagaggaccctgtccagggttggtgtctgccttgaccctgtgcctctgggatgggctctgccatccacagctctgaagtggaataagccagtcaataatattctcgcttgttttttgttgttgttgttgtttgtttgtttttgtgacagagtctcactctgttgcccaggctaaagtgcagtggcactaactcggctcactgcaacctccacctccagggttcaagtgattcctgtgtctcagcctactgagtagctgggactacaggcatgcgccaccatgcccagctaatttttgtatttttagtagaatcaggattttgccacgttggccaggctggtcttgaactcttgacctcaggtgatctgcctgcctcagcctcccaaagtgctgggattacaggcgtgagccaccgtgctcagctttcacttgtttgtattaatctttcctaaatgtatgtatggctcacatttatttcaatgtttagtattagaagtgtttgaggtctttgtaagtttggtgatgttttgtgaccagaaacaggccataggaacttaactcttgtttatattaattagcttatggtaaaattggataaatgttttataagagacatgaaagggcatacagacacacaggagagaaggccacgtgaagatggaggtggaggagacagtgatgcagccacaagccaagggatgcaagcggccacctgcagttgagagaggcaggaaggatcctcagaaggcatggagcctacgaggaagcctggccctgctggtaccttaattttggacttccagcctccagaaccatgagagattacatttctgttgtttgaagccactgatttttgtggtcattggttatggcagccacaggaaataagataatcacccacttaattttcctagaaaagctgtgttttgaaagtcctcttgaagcctgggttcctctctctgcatctcccagttttccctcaaagcttgtggattctccattcctcacattaactcaggcctttcattgccaagtgaccccgagtcctgccttcgcgggtgctgggggagccttcctgacccactggaagtggacctgcccatctccttgctgtgaaactgcatgagggggcttgtgtctgaggattgtctggcgtgaggggagagacaccacgtggggacagaggagtggatgagcaggccggggcatgacggggccgtgacagggacctggccttccattctgtggaagcctgagacaagcagcaacttctctcattcctcctctctatgacaagacaggaactgggacactcaccttactaccctaattcgctgagcctcggaagaaaagcagcttagatttttaatcccatccaagatggaggccctcctgctcctgctgccttgttctcaccccctttcgtgatgtgcgaggccatcggaaggtgtggaatttctccactgattcctctcattgtccctttctccctactcctggggaggctgcaatggtgacctcatccaccttcagaggcaggtgctggaggaggaaaggatgtgggagttcaagccggctgcagaggcccaagagcccagatggtgtccttccagcaaactggagaggcactcctcctaccaggcagccactgccccactccagggcccctggctcagctagggaagtggggctgggtttcaccccctgctcatcccctaaggcccagtgctggactcagtgcagcacctgcccagccatctctagcagcggcataaagcataaaatcaaggccaatgttacgtgctgccttgacatgtggtaaaatgtgaagggcctcaagtggcctaaatgcaagctcctgtcccacctctgctcccataaatagggtctcccagctgggcaacccttctcatcccagggaccaggtaccacccctgtttgttgccaagtagcaggcttcagttccctgccagtctgcggaattatttaacaacctcatgaagaaaccaggggccactccaccctctgtattagcctgttctcaggcagctaataaagatacccaagactgggtaatttataaagaaaagaagtttaattgactcacagttccacatggcttgggaggcctcagaaaacctacaatcatggtagaaggggaggcaaacatgtcctccttcacgtggcagcaggaaggagaagtgctgagcaaaagggggaaaagtcccttataaatccatcagatctcatgagaattcactcactgtcatgagaacagcatggaggtaacccccacatgattcaatcacctcccactgggtccctcccacgacatgtggggattatgggaattacaattcaagatgagatgtggaaggggtcacggccaaaccatatcactcttgttactaccaaacctgctgtccaacaaccctgctgttcactctgctcttgagcaccacctcatgtggccctgcatagcctgcagtggcccttcccctgggctacgagtatatgtgactagaaaattgccgtgggtctcacctatccagtgttgggtgttgtgtgtccagccctagagtgggactccttccctcacgaatggggtgaatagaaggtgataaaaagatctgagtctagggatacctaggaggtggaatctcttctccatgcatagcatgagtgatcacaggcctgaaaccaaaagggacttaggtctgggggagagattattttccaggtgctgaatattcctgggataggggagggagctaaacaggttcctgcccaaaggaagtgagaagggggtcctagcaacttctcagggatttagagctgtgactccagggcctttgttcagaggagctaccttgcaaggaacttctagaagaatgcttctctttctcagcatccatcctcccatttcatagtcgtgcccacgatgggccccgtctccctgaacttgatggctgaatagaagtgtagcctcccaggggcatctaaaggcactcagagccccttacccagccccagcaggcacctgcctggctgcccggtcctcagggttccctgtgcattgagcaatatcctcaaagtgaccaccagggggcagcagcacccagactgccttccactgcacctgcagatcaacaaattccagtattttgggggaatatctgtgataacttggctactgctttactgacctcaggtaaatagacagaccaatgtgcttgaggagccaattgctttaaatctcctgactcattttttgtattaagatttgttttatttatgcaattattctgtttactcaaagactttaccagaagctgggtgcagtggctcatgcctgtaaccccagcactttgggatgccaaggtgagaggatcgttggagcccagacattggagaccagcctgggcaacatagtgagaccccatctctacaaaaaatttaaaaattagctgggcgccactcatggtggctcaggcctgtcatcccagaactttgggaggccaaggcaggtggatcacctgaggacaggagttcgagaccagcctggtcagcatggtgaaaccccgtttctactaaaaatacaaaaattagctgggtgtggcggtgggcacctgtaatcccagctactcgggaggctgagacagcagaattggttgaatctgggaggcagaggttgcagcgagccgagattacaccactgcactccagcctgggcaacagagtgaaactcagccctccatcccgaccccagaaaaaattacctgggcatggtggtttgagtctatagtcccagctactcaggaggccaaggtgggaggatagcttgagtctgggagggtgggagtctggcttgagtctgggagggcgaggctgcagtgagctatgattgcaccactgtactccagcctgggtgagagagccagaccctatctcaaaaaaaaaaaaaaaaagtaccagcccctatctacccattcatagctttatgtccatttcttttgtcttcaagcactggtatcctttacttatctctcctcacctgatctagtgtttacatctcatttgcgcccatagagaagtcatacactgatgtggattttagatagggcacgctctcaagacagccacatgtattattctgtgctcacacagcctggcctggagatgcaaagattatggaatccagaatctaaatgagaggatcagattaatgggatgttctcacagtgtcaggtgaggacagcctgatgcagcctttcatcatgaggctgggacctctgggtcccttggccccaggaccacactcgaggacatgcctgttcctgccaacatggctgggcagagttcctcttttctttccttttcttttcttttctcttctcttctcttcttttcttttttctttcttttcctcttttccttccttccttccttcctttcttctttcttctttctttcttttctttctttttctttttccttctttctatttttttttgaaatggagtcttgctctgttgcccaggctggagtgcagtggcacactcttggctcactgcaacctccacctcccgggttcaagcgattctcccacttcaggctcccaagtggctgggattacaggcacccaccaccacacccagctaatttttgtacttttagtagaaatggggtttcgccatgttggccaggctggtctcaaactcctgacctcaggtgatccacccgcctaggcctcccaaagtgttgggattacaggcgtgagccaccacaccctagccctgagtctgtttatgcttctgtcaggtgtggcatgggcctgcctgggagctattctttttctgtaaagcacaggcagttaatcagtggtctctgggaagaatccagctcagggttatatttcgtttgacccactcaagttttaaaaagtaaattagttgccaatgtgcaaacattagaagagttcacagcttctccaacaatacctagaagttcatccgatggtgcccgcattccctgctctgtctagatggtgcccacattccctgctctgtctagatggtgccgacataccctgatctgtccagacagtgcctacattccctgctccatctggatggtgcccacattccctgctctgtccagacggtgcccacattccctgctctgtctggacggtgcccacattccctgatctgtccggacagtgcccacattccctcctccgtccggaaggtgcccacattccctgctgtgtctggacggtgcccacatttcctgctccgtccagacagtgcccacattccctgctgtgtctagatggtgcccacattccctgctccgtccagacagtgcccacattccctgctctgtctagatggtgcccacattccctgctccgtccggacggtgcccacattccctgctccatccggacggtgcccacattccctgctccgtccggacggtgcccacattccctgctccgtccggacggtgcccacattccctgctctgtccagatggtgcccacattccctgctccatctggacggtgcccacattccctcctctgtctagacagtgcccacattccctgctccgtccggacggtgcccacattccctgctctgtctggacggtgctcacattccctgctctgtctagacagtgcccacattccctgctccatccagacggtgcccatactccctgctctgtctagatggtgtccacattccctgctccgtctagactgtgcccatattcgctgctggctgcaaatgcgaggagttgacagcagcctcccctttacaaggcaggaggtgccactgttcgccattgtctccacctagggcttcacttgctttctatctgcagacatcagagggacccacatctctctgttctgacacgctgtgtgttgatggcagagtttaattatccacatgcaatcttactttccttattcccaagtccgtggggctgcctcatcaaagcattgtaagaactgataaccatcttctagaagtatcatagtgatattaagaacacacatcacagatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagagggcagtgggtggcgcctcgctgctctgggcacacaccacctcttctgacttctcccacgtgctccggctgtgtcgcctatcagcactgataacagcctggaagctttcagaacagaagctttcccagcatgggaaactctcattctttcttttttttaattttccaaagcctttatttctaagaccaactgtggcctacccgtgcataaactgggcaggctgtagacagcaggcttgccaagtaaatactacagccttcctcccaatattgagccctgtcccattgatcctgcaggggagatgtgtagggcatttgttcacggggaggccacaagtttgggcctctcatcactgtgacctcacacccctgttgagtgtgtcgtaaacagaggagccgttcttcaagccccctgccctgagtgcacccctctcattcttttgttattattagcaaattcccccagttcctgatcattctttcttaagcctttagtgactgggtaaggttcttgtggctgactccaagctttcttctaaaaggaatagattctaggggtgagtagaggagacaggaatgtcggagtcagagctcaggaatctgggttccagccccaggtcaatcctagataaactagagggctccttaacttacttccctaggttgactctgggtttttttatcacgctcgacaggactccttatgcatttcttcgaaagagcatccagtcttaacatcatcatttggcctcatttggtttaagaagcagaattagggtaaaagcaatgatggataagcctcattttggtgaatatgatcttattgagacaagaattctgagtcaattgtccttggaaccaactgtctattgttttcatctttatcacaacactatgtccaaattttggaaacatgtttccctcctagcagaaaagaagccacccagggccaccagatgcttcccgacacttggctggctttgtctggtcttctatccttcccctatccccagagtcagtgggtactaaggtggccagggtcgctcaaggaatcagaatgcaaccgtccagaggcccagaatcagactgtcctctctgattaggaaagtgtttcctgccacctcccagggggatgtggggtgtggcttgagtctggtgcttttaccaggagcttcccagacctctctatgggtgatggagagagagtctggggtgtgaaggatggaaatataaacactgaatactcagagagtcaggccagcgagctggtgaggagactccatcaaactcaatatgaaaacatgggtgggcgtttggggatggataatgaatgacagctgaagtcacacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccccgccccggggcggcaccttctaagggcctgagcgctgcacagggatgggggcgggcggggcctcccagagccgccaggcgtcccgccccactccgcccacacgcacggcccagcccagggttccccgggaccaccccagaccagccccggcccccccgggtcctccacactctgcaccccagaccaacaccaacgcgcgtagggaagcgttttagatcctgtcggagaggctcaaggccggcagaaggtttgcattaggatcgagaaagccgaccaacggacagatctacctaccttcctgcgggagtttgaggttgccaggggggaagccactgcagccaggagaaaggccgtctgggaaccaccccaccctcggacgtgcgggccttcaaatatctctgaacataatcctccaaagaccgctcaacctccgctcccgacgactctttctagcctcgtcccgcaccccagctgtggccacacacctattaggcaaacatttatgaagcacccacttactgggtgtgcagccctgagctgggggtgcagctgtggaccagacaggagggggcccggagcggcagacagtcgctggaggcacccgagccttggcgagcacaccctaacgtccttggggcctttcagcccgagccgtccttgtccagagagcaaaccatgcaatgatgcaggtgacttcccagcaaatttcatagcgttgctcaccagcttggcaggcaagaggagaaggggcagtccccaaaagacaatcccatgaaccttctagggaatgacgtccaggctccaggctcctgctctgcaggcgggtcgcagaggcaggttcctgacctaggactagaagacattctctagggtcactgcctccatggtcttccttggcaggtcacttcttcctgggcttcgacctcggtgttctcatggggacgagggtgattggaggccctccaaggggtgcaccgatgtgtcctgtgcaccaggcagaaccagcattgccctacagtgtgggtgcaaaatgaacccacatggccacgttggaaagtcctgaaatgttcatagcctatgacatgaaattgcactgtgtgaaatctatttattctttttttttttttcttttttttctgagacggagtctcaccctgtcgccccggctggagtgcaatggcacgatctcggctcactgcaacctccacctccctggttcaagcgattctcctgcctcagcctcccgagttgctgggattacaggcaccggccaccataccctgctgattttttgttatttttagtagagacggagtttcgccatgttggccaggctggtctcgaactcctgacttcaggtgatccacccgcctcggcctcccaaagtgctgggattacaggtgtgagtcagcgtgcccagactgaaatctatttattctatggaaaggatcagagctgtagaaaaatccttatgcatgtaaaagttctttgtgtttttacttgcaataactagaatctaaacatccaaaaatagaaaatataggtaattaaattgtagtacatatgatattattctacatagtagaatattatgtggagtccttaaaatgtttacaaataatttataacaacatggggccgggcacagtggcttacacctgtaattccagcactttgggaggccaaggtgggtgggtcacctgaggttaggagttcaagaccagcctggccaacatggtgaaacctgtctctactaaaaacacaaaaatttagctgggcgtggtggtgggcacctgtaatcccagctacttgggagtctgaggcaagagattcacttgaacccaggaggcggaggttgcagtgagccaaggtcacgccactgcactccagcctgggcgacaagagtgaagctctgactcaaaacaaacaaacaaacaaaaacccaacaggggagatctttatattatcatgttacgtgaaaaatacaaaaacagaaaacaaaacaaaaaccccacaaaactcaaggccttaaattgtaaatatgagatgccaggcattattcccaaaatctataaggaagcacaccaaccaccatgttaacattgtctattagtggtaggcctattggagatttattatcttatttatgctacttcatgttttccttccttttttgttttgcaacaactctgtattagtctgttctcacactgttataaagaactgcctgaaactgggtaatttataaaggaaaaagtcttaattgattcacagttcagcatggctgaggcctcaggaacttacaatcatggccgaaggggaagcaaacatgtccttctttacatggcagcaggagagagaagtgcagagcaaagtggaaggaaaagccccgtataaaaccatcagatctcgtgagaactcactcattatcatgaaaacagcatggaagaaccgcctccatgatccaatcacttcccacaaagtccctcctgcaacatgtggggattacaatttggattacaattcaagatgagatttgggtggggacacagccaaaccatatcaaactctatgtactttaatatttaaggaaaattacataaactttatctgaaaattccctggattcttctcctcaaggtcatgctgtacatatgcaggatcctcctgcctacatctccaaatggataatggattgaagcaaaatgtttgtcccaccaaacattgatgtgtaacccttttagtaacaattcatagaccaggtaaacatgtgtggagcagcccagatcagctggagggagcattattctcatcagagtgtggaacaatgcctacccatctgtcagctggttatggtgaagacagtataaatggaagcactgtcagaaactaaaggcttatgtaagtgatgctgttcttatgtctcctcttcctctctatcccacatatgatgaattattttattatgatgatgctgtagttgttattttctatttgaaatgaaaagacatgattacagatgagaaagagtgtattttgttatccttgatgcacttgaaatggtttcctcttttttttttcctgttttcttcttcttccttctctcttcactctttcattcttgcctctctccattttataggtatgattgatcttgaaataatgatgataacagaatgatagcccatatagtccttgggtcacttctgtctctatttctctttcttccctcctctttttttcttggtccttttgctagatgggttgcgagcatggctccctgcccctctcagtgggtttatcttcattttccatgagctcccacctcactgcatgtgacatcaaagccaaagctccagccacttctcatcctttcttaggaaaatctcaagtcttaacttgaaagttgaatgtcctgcttttgttcctaactctgctcacaggatagtggaagaagaaaggctcagcctgttaccagaaagaacagatctgcagtgtaacccatctaggatgaagggtcatgtggacagttcttcactcttccctctggctgcccttcagttggtgtccagatgcccctgtgttagcctgggggcattccttgccctttggcccctcttttgttgcctttttttttcttagacaaggtctaactccgctgcccaggctggagtgcagtggtgcgaccattgctcattgcaacctcgaactcctggctcaagacattctccccgctcagcctcgtgagtagctggaactacagttgtacaccaccatgccttggctaatttaaaaagtctttttgtagggatgggagtctcaggctggtcttgaacttctggcctccagtgatcctcctgccttggcctcccaaagttttgggattacaggcgtgagccattgtgccctgccctttgttgctttttcactcctttaccctgtggtttctactatcctcagggacaactctcattgccctggggcttctggatcttcagcaagacacacccctaaaggcaaacaatctttctttagcagcagcagagcacaaacggagtgttgctgtatgctaaaagcatactatttcccccccatgagaaagtctaaggggtccaggggtcctgaagtccctatcctgcccccgccagtgacaggtgatggggaacagaatgctgaaagagaccccacccaaccatctggtgtgtcaacacccgcccctgccggtgctgtccacaggttgatccccatcccacatgggtggcttaacacattcatgtcttctgagagccatttgttgctccccagtctcttctgtcctccttctttgaccaacatttccctgtctgatttgcttggtcacaggtagcctgtgtcagtttcctcccaggactctctttgcctgggaataagtgctatacatgagaagcatccctcccaagcgctgtgtgtggcctcctggcattctcctaagacttcctagaggattgctctggttccaaaaagaaaccagccacaacctgtttggagccctgcaggatgttccagctcaccgacttcattccccactacttgcccctctaacagagcttctagaccagcagccaaggtgcctccattcactgtacatgactcacctttcccccttctagacacttcttcacgggtctagcctctgtttccagctttacacagcacaggctgatgcctgccactgaacgggatccaggactttttcaaatctcagatccccagcaaaggtatgacaatgggcaccctgaccagctctgagcctctaagcatagggtctatttgtttaattttgaattcacttttaagatttaaaaattgagagctctcatcttcaacaaaattcaggggatctagaaacatcatgcccacttgtggcagagtagccaactggcagaaactgatgctgatgctgtctgtttcctacacaaaatgcaaaccagagtttaccacaggccccgctactccacattctcctccacaaggacactcagcaggctcctgtgctgaacggcttgcctggttctgtaggtgtagggtttgttactctgttccaggacctattttccgcaaagccccttacctggctgtttcttcccttggcatacgtgagaactcctttcctcactgaattgctttgaccttgctaattagttgtgttgcaagtgctttttggctgtgtcagacatgtatgttctgtttatcattttagagcaatggttattaatttttttcagattcttcttgggaattagagaaaaacttatggctctcctccaccatcctgcccccacctaccccaatgcacacatgtgcaacatttgttctacaattcaagagctctctagacccctgatatgctaggcaattcgtggctgccacattaggaacccctgatttaggggaaggactgttttctccattagacaaactcaactgtgtagcatcaatttcatgggtctactgtgtactgtgcccaaaaaatgccactgaatgctgcctgactggtggatagcaagactgtccattaatgtggtcatttaggttgcctctgcccaggtcttgaggtcattggcactaattcacaacaccctcaagtcacccagggaagatgagacacagttggctgtagacccacagtttgggcattacagctgcccttgaagttgacaaataaccacaaccttcaaattgttatgaaaagagcacaaatccaattaagaaagcttttccaaaagaaataacagtgttcctaccccctctgtcactctccaccccctttttgtcccagaataatgttgtgctgataggaacatggataaattaattacagtctggaatgttattcatgggtaggaaagaacactaaatctactcgcacaatgtttgatatttaaagataaacattgcctttatgttttttttttaaacctcagtcagcctagtttacgaagacataggtataatccttttaaatgctgtggattttttaatcgcaaaggtaacaatatgctgggtgttttacccagccagagaaccaggagatgcaggaatgagattagcatctctttagttccttgcatatttgatattattttggtgtacctccaattcctgataacatagaagaactcttgtggttgaagtccctgaaatggaaggatattggtaaccctgaatttaaaacaagcacaggcagcctttgtgggaatgtgtgtgaaggtcaccttctagaaacaggactgtccatagccattgccatggtttctgtgtcatttcaaccagaaccttaggcctggaagtctggatggatgtgggttggcatggtcctctatgggcattaaatgaataaatggatatagcagagggagtatccagcatgactcaaagaaggatgagaggaaacatattcaaataaaatctttagaaaagcaaatttcaaaaaaaaatgcttaagtataaaatattttgatgacaaccatgattttcaaattgaattcttattctaagtaatggtctaatctgaacttagacctctttccttaatttttttctcaataagcctttggtgtctagtcagttcaattcagtatttactgagtctctatacagacagggtataaggcattaatcaaatgtatgtccaaaattgcccaccatgcagggcagagctaaaatgcctaacacccctcctctcaccaacacatcccccacccacatctccaaagacttcctggcagaggtgatctctgcctgctgggacagatgtataggctccaacagcagcagggtggcccctctgaccaccaccttgggacccacattgctcttagaactattcctcttttttcatccttgaagcccccagcaaagctcagcctgaatcaactttttctaggaatctgacaagtttccaggctgatttcctgacccagtcagatcctcttccatctttctttgggtgttcaattttctacgtcattttccacctcacatattggccgttgatgaccacatcagctcttctatgctgtaagctcccaaggaacaaattctatcaaatgattggcctttcagctctctactgtgaccagaaagttgcccagtacataaaaaggggttcacaggtatttctcacgtggataactggtgactcatctatccatgattttggggatcccccacttcctggactaattgtaaaccaccttctaccacctgggggtgcctgagcacaacagagctaagtgaacatttcatcagtctaattgaattcagtggaatgttgggggcctggaaatttggactaggaaggtaagcaggaggaataagtgtgaatgacagtatctaaattaaaatctgttgccacgaaagaagatcagaccttttctcctctgatttgtccttctagaagtcacaagatgcccaaagaatcataagcaatgggtaactaggcaagggaattatctctgacaaatgccatgattgctcagtgtcccatttctcttggcagcaagagtggcccaaagactaaactgagatgggggtctgcacccctgcatgggactcaggctctgcagctagccttccaaccactaaacctgagctgaggtacttttagctctttatttcttgtttttctcatttgtcactcagatgagaagaatgcccgctctgtttgactcagtgtcagcgtgatgaagtaaaacagcttctttaaatccctctgcaacaaggcagtgaattgaaaataagaaagatagggaagaacattctgggcaagacagctcaatgagttcatgctttgatcgatctctcagctctgaacacaaagccatgacaggtaggtataaaaatagaaagctaaaaagagatgtctggctcaacagaagcagaagagacactgccagaagcctctgacctactgggctctttgtctaaaatcagcagggagtttggcctctgctgggcaaatccaagacgccccacccaagatggcagacaggaaccaagtacttgcttaaagtcaggaactagggtggggccccgaaagaaagacagtgcctcactgctgcctagggaccaaggttttagaaaaataaggttgaggggccaagatggccgattagctgctgctgcagtccgcggctctcatggagaggaatgaaaacagccagtgaattcagcaccttcaactaaaatatccagattctcggccccactcggactagtcagacaactagacctatggagaatgaagaaaagcaggctgggaaaatggtccacccgagagcggcacggagccaaaggaagccccaccccagcaaagggaagaggtgagtgagtgtgcgacaccacccggaaaaccatgcttctcccatggatcttcgcaacccgcagatcgggagatcccttcatgagcccatgccaccggggccttgggtccgacacacagagctgtgcagagtcgtggcagagcggccactcaggcacacacaaagacccaggaattttacatactccagcccaaggaatcccagcaaggcaggagatccattcatctattcccccaggaagggggctgaacccagggagccaaccagcattgctttgcaggccccgtttacacagcacctcacaggttaaggcccactgtaatttttgccagccagtggtgacagcctggagtcagcctgagatggactgagctctcgtgggtagaggcagccaccatctctgcggttcagttgactcagccattctagcctgccagctccggggagtccagacagtctggacaaggaggagtctcccacaacgtgtagcacaggtgctgtgccagatcgtggccagactgcttctttaagtgggaccccgatccaatcctcctcactgggtggggcctccctgtgggaatttcagcagctccagccagggttatatggaaaatactctgctctctcctgggacggagacccccatgagaaggggtggccgacgtcgctgcagttcagtggactcagtctttccagcctgctggctctggagagttcaggcggtctggaggaagggtcccctcaatgcagcacacccgctacacctgctctaacaaaaagcagccagactgcttctttaagtgggcccctgatcccgttcctcctgactgggtgagacctcccaacaggggtctccagagacctcccacaggagcgatcaggcaggcaacatgtcagtacattcctgggatggagaaaaatgagcaggctgccatcttgctgttttgcagacttcactggtgatacctccgggtatgggaaaaaccaaggcaactagggtctggagcagaccctgagcaaaccacagcagccctgcggaagagtgacctgactgataaaagaaaaacaaacaaacaaacagaaagcaccaccgacaacatcaaccaggaaaaccccattcaaaggtgagcaacctcgaaaatcaaaggttgataagcccacacagatcagaatcaatacaaaaacgctgaaaactcaaaaagccagagtgcctcttctcctccaaatgactgcaacacctttccagcaagggcatggaactaggctgaggctgagatggctgaaatgacagaagtaggcttcagaaggtggctaataatgaacgtcactgagctaaaggagcattttgtaacattaaaaagtggggaaacgacatgaacagacacttctcaaaagaagacattcatgcagccaacaaacaaatgaaaaaaagctcaacatcaccgatcattagagaaatgcaaatgaaaaccaccatcagctaccatctcactcccatcagaatggctattattaaaaagtcaagaaacaacagatgctggtgagattgcagataaaaatgaatgcttttaccctattggtgggaatataaattagttcaaccattatggaggacagtgtggcgatttctcaaagatctagaggcagaaataccatttggcccagcaatccctttactgggtatatatatcattctattatatatacataaaataggaatacaaaacatgctattcctattatatgtgtaataggaatacaaatcattgtattctaaagacatgcatatgttcattgcagcatgattcataatagtaaagacatggaatcaacctaaatgctagactggataaagaaaatgtggtacatatacaccatggaatactatgcagccataaaaaggaaagagattatgtcctttgcagggacaccgatggagctggaagccgttatcctcagcaaactaatgcaggaacagaaaaccaaacactgcatgatctcatttataagtgggagctgaatgacaagaacacatggccacgtgaggggaataacacacactggggcctgtcagggaagggggagagagagcatcaggaagaatagctaatggatgctgggcttaatacctacgtgatgggttgatctgtgcattttgtaaccaaatgtacctgtaatttatgatccaattcaagttgaattttttataaaagataaaggaaagattaggattatgtttttacatagaaatgcacaattgtttcagtacaaactaaagagattttcagaatttcatagatgaaaacaattcacatttgctaaaatgtatcctattaatactaacggttgtacttcagccataagaaaagaggacagaagggaatgtgtgaaagtcagtattaaatggtagtcaattaaaaataaaataaaaattttgaaaggtaaaataataattactgaaactgataaacaatattaataattttaatagccattaaattaacaaaataataataattagatttggaattttttaaagaataagatgagttaaatgggtgaaagtccacagaaagaaagttttctgggtccttgatgtgatcgggaagaaaacagaaatatttaacaacagaaattttgtaggaaattcatagtttactaagtatgctaaaattttatagataattacaaaaaggatataagtaatctataagttgcaaagcaacaaaatatattcttttgtgtaaataaaagggaaaatagaatggtttctcacaccaatgagaaataggagggaaaaatactttaagagaaaaagttgtgaaataaaaatcaaaatgtaacatggtaaaaatatatgcaggtacatcaataatcataatatctttaaatagaataagcacacaaaagactacaatgattacattgaataacaaaataaaatctaattatatgctgcttacaagatatacatttgaagtaaaaccaaattgaaaagttgaaaattaagtaataaaaaaatactaagcaaaggctaacacacagaaatctaaggtagcaatattaacacaagacaaagtaaaaattcaggtgattaatagtatacaaagatcacccaatttaataaaaggaaacagtctgctaggaaaatattacaattatgggtatgtagttaactatacagactcagcaaatataaagcaatcctggcagatttataagacattgatatatctatctatcttatcaattcccttaaggggaactgagttgtagggagccatttaacacacttctctcagcaactggtagatctgccctccccaacatagtaagcatatagaatatttgagtgatgaaattaacaaagttcattaaatatatatatagagagagcactacacccaaccaataaacaatatgcatttttttaacaagtgttcacggaactttttttaccatttggccatgtactagatcatgaaagaagtctcaagaacattttaaatattagttttacatacgtgcttggctctatgatcaaaatgcagttaggttataaatcagcagtaaatttatggtcaataaatcttcacatatctgaaaaccaaaaaccaagtacatgtctacttaacccattggttagagaagaaaacattttagaaacaataaaatactaaatgccatagaaaatactatatatgaaagtttctgggatgcagctaatgtggttcttagaggtaaattgacagcattaaatgaatttttgaaaagaaaaatgatagaaaataagtttaactaaaaaaaggagacatatgaaataaactaaagaaagtagattaaacaaaattttaaaaacaaaaattagcaaaaatgaaaatgaaaaaggagagaagagctactagatgaaaagctactcaaggaacacaatttgaagatttaaataagatatatatttttctagaaaaaaaacatgaacttccaaagtcaatttatgaatagagcttcatcataaaactggaatctataaaaagtatcagttcaatagatggatttactaacatattagacacagctgaagaaattatttatgaattagaatgtaagtcagttaaaaatattcagggtgaaacacaagagaaaaataatgaaaaatacaaaaaaagagtataagagatgtaaggaaaaggattaagagaagtgcagttagaggctgagaagtacagaagaaagtgaacagagcagaagtgatatttgaagagatagggactgagaattttccaaaaactgattttaaaaatgaagccatgggtgaaagaagtatttaaaacttcaagaaaaattactttaaggaaaatcagaatttcttagtgcatcatattaaaatgctgaaaacaaaaaataaagagaaaatcttacaatcagacagaggggaaaaagatatacaggaatcaccaataagatagatactgtatctcatttctcaaaaggaagattgaatactatagaaaattaaatggcatctttaaagtgctgaaagaaaataactacccacctagaattctatacctaatgaaaatgtcctttaaaaatgaaggcaaaataaaggctctaataattcaaggagcgttctgtaatctctaatgttttaactaaaataatgaaagaatgtataaataataatggggaaatatgaaacaaagaaaaatacttcattaatctaaaaagcataagaaataataagtccatagacaagtgtaacaaacagaaacattacagagttggtaaaacttgaggagaaatagatgaatccactattcaacactactttaacagaaacagacagatacagcatgctaaaaatcagtgcgaacatagttgaattcagcagcaccatcaatcaactggatctgattcatctaaaacgtcatccaacaacagcagaatacacattcttctcaagctcatatggaacactcaccaagatagaccacattctgcgtcataaaatacacttggcaaatttagaagaatcaaaatcatcctatgtctgccctcagaccacaatggaatgaaaactagaaatcaatgacagaaagataacaggaaaaatccccaactacttggaggttgaacaatatacctaataacacatgagtcaaagaagaaatctcaaggtaaactttaaaatattttgaactaaatgaaaataaaaatacgtgttgtcaaaatttgtgagatgcagcaaaagcagtgtttagaggaaaagttgtagcattaaatgcatatgttagaaatgaggaaagatctaaaattaacaatcagctttcagcatggaaaactgaagaagaacaacttaagcctaaagcaaatagaaaaaaaaagaaataagaaaaattaattaaaaataggaaataagtgaagaaaatcgacaaagacaaaagctggttctttgaaaacatcaataaaattgacaaacttctagtcaggctaagaacaaaaaacgggagacacaaattaccaacattagatatgaaagagagtcatcactactgatcacatgaacaacaaaatgatcatttaaaaatactgaaaacaacattatgctcacaattttgaagaactttgatgaaatggaccaattctttgaaagacccaaactaccaaaactcacacaaggaaaaatagatctgaataggcccatatttattagataaattgaatcaataattaatagacttccaaaaagaaagcaccaagctaacctggtttccctggtaaattctatctaacacttttaaaataagtgatattaattctctgtagtctctttcagaaaatagaagcagaggaaacacttcctaattcattatatgaggctaacattatcctaataccaagagcagacattacaataaagggaaactacagactaatatctctcatgaatgtggatgcaaaaattcacaacaaaatattaacaaatcaaatacaataatgtacaaaaagaattatacatcacaaatgagtgagatttatttcaggtatggaaggctggtttaacatttgagagtcagttaatggaacccaccacaccaacaggctgaagaaaaaaatcatatgattatatcaattgatgaagaaaaagcatgacaaaatccaaacccattcatgatgaaaactctcagcaaactaggaattcaacttcataaagcacatctacaaaaacctacagctaacatcatccttgatggtgagaaactgaatgttttctccttaagatcaggaattagaccaagatgtccctctcacaactcctattcaacattatactggaagttctagcttgtgttaaaaaacaagaaaaggaaataaaagacatacaagttgggaaggaaaaaataaaactgtctttttcacaaatgacatgattgtctatttagaaaatcccaagaattaactaaaatttcttggaactaataagtgattttattagtttactaagactgccaataacaaaatacaacagactgggtgagttaaatgacttaaatttattttctcatagttttggaggctagaagttcaaggtcagggtgtcagcaggtttgatttctcctgaggcctctctcctcctcttgcagatggccacatttttgctgtgtcctcacatggccttttctctgtgtatgaaaatccctggtgtctctttctgtttgtctcatcttcttagagggacaccagtcagattgaattagggtccaccctagaggccttattttaacttaatcactttttaaagtccacatctccaaatgcagtcacattctagggtactggggattagggtttcaacatatgaaatttgtggagggacaaattcagtccataatagtgattatattatagcaaggttgcagaatacaaggttgatacaggaaagccaatggctttcttatatactatcaatgaacaattaaaaatacaaatttaaaagcacaatatcatttacaatagtaccaaagaaagaaggaaagacattaattctcaggtagaaatctacaaaaacatatacaggatctatatgcagaaaactataaaactctgatgaaagaaatcaaatcaaatgaaaacaaatggagagatatttcatgtccttggattggaagactcaatgttatttaaaagacaattcactgtaacttgatctatagattcaacataatctccccaaattccagcaagctactttgtgcatatcaacaaactgattctgaagtttatataaaaaagcaaaagacataaaatagccaatacagtattgaagaacagagttgaaggctgacactactgacttcaagacttaatataaagctccagcaaggaagacaccacagtactggtgaaagaatagacacttaggtcagtggaacagaatagacaggccagaagaggactctcacaaatatactatagtcaattctctttgataaagaaccaaagacaattcaatggagtaagggcagtgttttcaacaaatggtgcataacaattggacagccacgtataagaaaacaaatctagactcagatcttacacctttcacaaaaactaactgaaatagatcatggatctcaatgtaaaatacaatattttcagatttccagaaaaaaaaaagcagaaaatcaatgtaaccttgaatttagtgatgagttttaaaatacaagccaaaaagcatgattcatgaaaaaaatttataaattatacttgattaaaattaaaatactatgttctgtgaaaaatactgttaagggaatcaaaagacaaggcacagattgggagaaaatatttgcaaaccacctatgtgatacgggaacttgtatccaaaatacacaagaaactcttaaaaaaacaagaaagcaagtaatgcaattttaaagtgggctaaagatctgaagagacagatcaccaaggaagattcatagaatggcagatagaaagatgcccatcataatttacggctgggcacagcagcaccagctcctcagaaggctgaggcaggagggccccttgaaaccaggagtttgaagctattgtaggctatgatgtgcctgtgaacggccactgcactccagactgggcaacatagtgagagctcatctttaaaataaataaacaaatgaataaataattaatttgtcattagagagttccaagttaaaacaatagcaagatgccactacacacctatgagaatggttaaaatccaaaagcctgacaataccaaatgatgacagagaggcagagcaacaggaactcttgctcatcgctggtgggaatgcagaatggtgcagccactttgaaagacagtttggctgcctcttacagaactaaatatagtcttagtacagaatccatctgctgtgctcctagatacttatccaattgatttgaaaacttatgttcgcataaaaaaatctgcatgtaaatgtttaaagcagatttattcataattgccaaaaactggaagcaactaagattctgttcaacagctgaatgaataaacaagttgtggtacatctatatagtggaatacggaatataattctgcaataaaaagaaatgagtattgagctatgaaaagttgtggaggaatcttaaatgcatactgctaagtgaaagaagccagtatgtttatagcagcatgatttatattcctttgggtatatacccagtaaactatgcaaccataaaaatgatgagttcatgtcctttgtagggtcatggatgaagctggaaaccatcattctcggcaaactatcgcaaggacagaaaaacaaacactgcatgttctcactcataggtgggaattgaacaatgagaacacttggacacaggaaggggaacatcacacaccggggcctgttgtggggtggagggggggagggatagcattaggagatatacctaatgtaaatgacgagttaatgggtgcagcacaccaacatggcacatgtatacatatgtaacaaacctgcacgttgtgcacatgtaccctagaacttaaagtgtaataaaatacatatatatatataaagaagccagtatgcaaaggctacatattatatgattccaattacataatagtctggaaaatgcaaaactgtagagactcgaaagtgatcagtgagttccagggttaaggtggagggtagagggtgaataggtgaactgcaggtaatttttagggcagtaagattattgtaatgtaaaattttagggcagtagaattatttaaatggtggatataagatattgcgttgcattgcctatgcaaccaaaggtgaaccttaatgaatgcaaattttgaaaaattatttaagaggttgggggatcccaagagagaatgcagaccatgagaagagaatctaactgtattacaaatataggaaacactctcactgaagggatgggtcggggaggggaagagaagaatactgaagtattttggaaataagtgaggcttataagattaaaggcaaagggaactgcatgtgagcactgtactctagttgaaaaaattgtttcccatagaggtactggttaacaattctgttattgctatgtatttatactggaatggaacaattacatgaatggatggcagatggtagaagccaggtttctcaccactggagtggctgtttatcaaaaagcaggaggagaaagaatcattcatgcagtgatggatttgagttggagagagcagtgtggactcatatttagctcaatagagaggctgatggttatctatagaagtatttatagatatgcatatatacatgatatagtataaacatgtgtgtttcttgctctgtccctgaaacagcctgaaagaaatgacatcccagtaacagcaaacgtgcacagcaccgtatcttggtttctaatactattctccatttaaacgaaccaggattctttggagaagtggctgtttctaagactgggacaggaaatatccaagatgagcctaaagcatctggtagtgccagaaagtaaggaggtgctcaagaacaaaacaggaccaaacaaaacattgatcagggtctgtcaaaggagcacagatgccagctaaaagagttcccaatggccaaagctggaacactttgcggtaataaagtagtattggattataacctacagtataaagtaaatatgcatggtataaatacatggttaaatatattaataaatgaggaagcagagacaaatctctcttacaaaagaattccatatattttacacaggtactctgtcttcaagaagaaggaatcaaactccccattccttcagtgtgagctgtacataatgacttcctcccaaagtgtacaatatagaaaaggggagaaaaagagtaaatttacagtggaggaccctgacaagcgccactcaggcaggcgaccaaggctaccttccgcactcataaatcatgctgacagtaggtacgcttgatatcacgggatgaaaatagcacttcacctctgtgattttctttccaataacttacaaccccagttttctaatgagaaaaatatcaggcaaattccaaaagtgggacattctacaaaatacctaagcagtcctcagaaccctcaatgcatctaaagaaggaaagtcggagaaactgccacagacagcaggtgcctaaagagacatgacaactaaatctaatgtgggattctggaacagaaggaaaagacattaagtaaagactgaaagaacaaaattatgaacttttgttaataacaggtcattatttgtttcattgtaacaaatgtaagatatcgataataggggaaactggatgtgaagtatattgaaagaattgaacaatgaaaacacttggacacaggaaggggaacatcacataaccagggcctgttgttggcgggggggatggggggagggatagcattaggggatacacctaatgtaaatgaagagttaatggatgcagcacaccaacatggcacatgtatacatatataacaaacctgcacattgtgcacatgtaccctagaacttaaagtataataataataaaaaagaaactctctgtgccatcttctcaacgtttctaaaaatctgaaactgctgtagaaaataaaatctattttaaaaaatttaaataagcaaactgctcactactacacaaaaaaagcaaagattagtctcttgagtataaaattgagcagaagaagccagacacagcctgcaagctccaactccattcataaagagtttgcaaactggcagcgatggcgcgagagcttaggaaattgtttcactgggggaagtggaacagacgttgactggatgatgtcacatgaggggcttctggggtactattaacattcgatctcaaatccaattggtggttatatttttgtttccttaaattaataagtattaatttatgaaaattaattgaaatgacactcataatctgtgcacttttctgtacaattcaataaacttaatgataaaaacaagaatgaatcagaactgtgtatatcaacatggatcaatctaaaaagcaatgttgattaaaaaaatttaaaaatatgtccgggtgcagtggctcatgcctgtcatcccatcactttgggaggccgaggtgggcggatcacctgaggtcaagagtttgagaccagcctgaccaacacggtgaaaccccatctctactaaaaattacaaaaattatcatgcctgtaatcccagcactttgggaggccgaggtgggcggatcacctgaggtcaggagtttgagaccagcctgaccaacatggtgaaaccccgtctctattaaaaaatacaaaaattatcatgcctgtaatcctggcactttgggaggccgaggcgggcagagcacgaggtcaggagtttgagaccagcctggccaacatggtgaaaccctgtccctactaaaaatacaaaaattagccaggcgtggtggcatgggcctgtaatcccagctactcaggaggctgaggcaggtgaattgcttgaacccaagaggcagaggttgcagtgagccaagatctcaccattgcacttcagctctgggcaacagagtaagactctgtctcaaaaaaaaaatacaaaaattagccaggcatggtggcgggcgcctgtaatcccagctactcaggaggctgaggcaggagaatcgcttgaacccgggaggcacagattgcagtgagccaagatcgtgccattgcacttcagcctgggtgacagagcaagactccatctcaaaataaataaatgaacaaataaataaacaaagcaatgttgaatgttaaaaaagtaatttgtcaaataataactaaaatagactactttttttatacgtaccttctgtaaaacaaactatgttcttatttatgggcttacaaaatttagcctaagtatcaaaacacacttgagattataaataccaaattcatgatagcagttatctctgcaaagagaggaaagaaaatgaaattgaggagggggactcacttttttttttttttttgagacagagtctcactctattgcccaggctggagtgcggtcgcatgattgcgactcactgcaagctctgcctcccagattcaagtgattctcctgcctcagcctcccgagtagctgagactacaggcgcacaccaccacacctgtattttttgtagagatggagttttgccttgttagccaagctggtctcgaactcctgacctcaggtgatccacctgctttggtctcccaaagtgctgggattataggcatgagccaccatgcctgaccaacttctacctatactgttgcatgtatatatatttaaaaatccaaaaaacatattgcaaaatgttaagttgtgatacagttgggttcagctacaagggtaaccatgacatttctctataactgcttctagttttgaaatacatatatatgtatacacacacacgagtgtgtgctctataagaacatgtaactaatattgtatagtgcaataacagcctaggagaattaacaagcattttgccatcaatacttatcctttgtgttgctgaggatgaatgaacccatagatcattagtctttgaagccgttggcttcttttaaaagtggttctaactcgaagactaatgacctttgcatttcaccagccccaccttgttaatctcatatctttcaagacatgtacactttgggaggccgaggcgggtggatcatgaggtcaggagatcgagaccatcctggctaacaaggtgaaaccccgtctctactaaaaatacaaaaaattagctgggcgcggtggcgggtgcctgtagtcccagctacttgggaggctgaggcaggagaatggcgtgaacccgggaagcggagcttgcagtgagccgagattacgccactgcagtccgcagtccggcctgggtgacagagagagactccgtctcaaaaaaaaaaaaaaaaaaaaaaaagacatgtaatcccaaagtttccttgaagataaattacatttgctgacaggactctttagaaccactgagaacagtcagatattggaggtcaatgaggaaacaaccccactgctgattcactccatagcatgcactgagcacccacatggtccacatgagatgtgatggggcttgaaccagtctggctgtagaggggaaagaaggagagaaacagatctgagaagcattttgaggcagagctgtcagaagtcaccaaatggctctgaataacatggcggagtccaagaggccagaagaagaatcaagaacagccagggccggtttgagcagctgtgtgaaggctggcaccattaactagggtagaaagcatggtggagaaatggggctggctaagcaaagttgcgggttcaatcaagaagtttgcctttggaatgtgtcatggttgagatgcctttcacaatccaagtctaggcctggtgaggtggctcatgcctgtaattccagcacttcgggaggctgagatgagaggatcgcatcagtccaagaatttgagaccagcctgggcatcatagtgggacctcatctctacaaaaaaacatttaaaaattagctggctgtaatggtaaatgcctgtagtcccagctacttgggaggttgaggtgggaggatggcttgagcctgggaggttgaggctgtagcaagctatgattatgccactgcactccagccatggtgacagagcaagacctcatttcaaaaaaaaaaaaaaaaatccaagtctagatgtgaccaggtatgtggaatctggagctcaaagaggagtcagactggaaagatatacacttggatgtcaccagcatattgatgttgcttcatgccatgggacccaatggggcccccccaccctggaggagggtagttagagaagagaggtctgaggatcaagtcctgggatggttagagtttcatagaggagcaggaacataaataataaaggccaaccacataaggaaaacaaaagctatatattcagggtatactgtaacaagggagtcgtcaccatcacttacattttggtagagactccaaggcaagagtgggaaagtttgacagtgatgttaaccaaaaactgacagaggcaggtgtctcaattgatagcggtttatttcgccaaggctgagaatgtgcctgggaaaaactcgagtcacaggaacatctatgacctgtgctttccaaagagggttttgggaattcagtgtcgaaaaggcaaagaacagacaggagggaaaaaagcgagggagggtgggcagtgaggcaaatggtaacattattgtgaggttctgattaacgctcagtaaattggcattttacataaaataaagcaaacacgtgaaaagaggaagtatggggaaaagtcaatgatgcatttatctcagggtggatgaagggatgatttctggtcttgtccttgtcctcttacctgtgaagataaacttgtaattgacattgttagggtgagattgaacagaactcagtttcggggctagcttataggggggatatgtatcctataagatttagggctcacacagaatttccttgtgagcaatttgtgaagaaggccatctggggagatatgtggcctcctatctttgtgggaacctggcttatgtatgacgttatgacacagggttttgaaattacagctatttgagaacaaaagaaaggcagtattgcatgactcagttcccaagcttaactttccctttggcatagtgagtttagggtcctgcgattttgttttctttcacagtggaaaggaagggaaggctgcaggtgcaccctgatgggagtctgttggcatggcgaagccctaggtgagctaattaggggcagggtgtcccatggaattggctagggatgcatatttggttttctctggttggtcctaaaattaaagtgaagacaaaaattaggggagctgtcagttattaatcaagtcctggtcattgtgggccaactgttatggatattattatttaacttcctgaattgttactagagatagcagtccggctttctatgagtctgacttatagcaggctggcttccggttgtttattgtagataaaggggttgggttcctggcaggtagctgcaagctgtgagtcatagttctatttatatatcatgtggccattgtccatttgtatatttagtctcttgggagaaaaaagccgaaaaggagattgaaaggagcagctagagagaggagggaaactaagacaatatcatcatcccagaacttaggaagataaagtcccaacaagaaaggggtggttcactgaagcaaatgctgctaaaatgtctgataagatgaggatgtcaaagtaggtgaagcttttccaggtgaaaaagagacgtagccatcattgttgctgaattctcagacacaggaaacattttcctgtggcttcaggcaatggtgaaataggaactaacagggtcagctaggaagagaaacttttaatgcctctagggggcacagcatatcatacctaacaactgagcagcaaataccgtcccctactctccagacgcattttccagcccaacatgggattcttagattggttagatggcagcatctgagaccacaattaacctgaaatccaagctcaggcacttgcagctccaaagcctcacactcgatgctccgagtttagggacttctatcaagtaaattgggaaatgggtcgttctcctttgaagactgttaggaaagagggacaaaaacggaaaaaaaaaaaaatcaatccctgagtttaatctccagtattccttcccagaaactttaagttagctacaagaatgttaatcatgagcagaaattgtttaataatcaaattatcataaatttgcttttcttttaccttagtaaggtaactatgtgacaaacatttgtgaagttgagaatagataaaagtacccatcatatgatctagccatcccactgttggacatatacccaaaagaaaggaaatcaatatcttgaggagatatctgcacttccatgttttttgcagcactgtttacgatagttaagatttggaagcaacctaagtgtccatcaacagatgaatggataaagaaaatgtgatacatccacacaatgcagtactattcaccccttaaaaagactgagatcctgtcatttacaacaacatggatggacatggaagacatcatgttaagtgaaataagccaggcacagaaagacaaacattgcatgttctcacttatttgtgagatctaaaaatcaaaataattgaacacatggatatagagagtagaaggatagttatcagaggctgggaaagctattcgggggctggtgggtgggtggggagagatggggatggttaatgcatgcaaaaaataactagaaagaatgaagaagacctactgtttgagaacacaacagggtgcctatagtcaataagaagttaattgtacacttaaaataactaaaagagtatacttggattgtttgcgacacaaaggataaatgcttgagggggtgaatacccctttcttatgatgtgcttatttcacattgcatgcttgcatcaaaacatctcaggttctccataaatatatacacctattatgtacaaaaattaaaattatttttaaaaagtgccaagaaactctgtaccctaacatagccctgttagaattacttagcactaatagttgcctttgctgagtgatgcaagcagatgtctctggccctcaaagatgaggagacactgctgctctgcttggtgtgaacataaactccagttcttctgggaactgccttaaagacagcagaaactggagagcagagaaaagtggaaagtggccaggcacggtggctcacacctgtaatcccagtactttggtaggccgaggcaggcagatcatgaggtcaggagttcgagaccagcctgaccaacatggtgaaaccccgtctctactaaaaatacaaacattagccagatgtggtggtaggtgcctctaatcccagctacttgagaggctgaggcaggagaattgcttgaacctggaaggctgaggtcagtgagccgagatcttgccactgcactccagcttgggcaacaagagcaaaactccttttcaaaaaaaaaaaaaagtggaaagcataaccttgcttgatggtgaggttgaatccccaccttcgcctttctcagatttattcccatcttcctactcctccaacccctatgttggctcaagcccagatggctctcacctgcattaacctaaccatctcgtaacccatctcctctctttgttcctttcctatgcaccctccacatggccagctgccagaggatctttcaaaatgactaatcttactattcttctcctctacaaagcttcagaggcttccagtctggactccttaacaacacataaaaaattcctcttctgttcttcctctggctggtggctctcaaccttggctgcacttgaggatcctggggagctttaaaaactgccctgctctggtttagtcagtctgggctgggtcccaggtgtctagagttttagttttgtttcccaggacctggtgactccttgaactatttgcagattcctgaacccctgtcggagagtaagctgtgttctaatctcatcagatctaaggagagatgtaggaacttgccttgaggcttgaattctttctcctactctccacttgtggtagtcagtcttttgcatttaagggtcaaaaataagaaggcctattgtgtttccaaggctggggtccatagtgcatacgataggtttcagagggagagatggcagtggagatggggaaagaaaatgtggaaacctgagtctaggatgttgcttgctaagtgtactagaatatgccaccccaaatatgcctctttggcatataattattttgagctgaaggctattgagaaccagcagatgcacgaaaggtctaaaaacagagtctaagttttccttttgtaaaggattgtagaggtgtctccttctcccaggaagaagactcttaactactcatcagaggagaaagggcagacttaattctgcacaacaaatcttactaaacacctcttgtttaccatccttttcctggttaacttctcataagttgcctcccctacacagaagccccaaccccttcttttttgttttagcctaagatggtatttaacccccagtctaaccacccctttgggttactcacctcttagtgttcctgtgtgtacacagacaacgaacttgtaagtagacttgtttttctcttgttaatcagtctttggccagtctaacttataaggtttcagttggaaaacctaagatgggtagaggaaaagattcccctgcaacacacttatattatgaaaccaaactggataccaagcaaggaggatcgggcatctaacacttaactcctgacctccacaatagcttgcaggtaagggtttttttttttttaatatatatatgtatttttatttaagttctagggtacatgtgcacaatgggcaggtttgttacatatgtatacatgtgccatgttggtgtgctgcacccattaactcgtcattttttttgttttgctttttgttttgttctgttttttttgagacggagtctcgctctgtcgccaaggctggagggcagtggcacaatcttggctcactttaagctccacctcctgggttcaagtgattcttctgcctcagcctcctgaatagctgggacttcaggtgcctgccaccacacccggctaatttttgtatttttagtagagacggggtttaaccatgttggccaggatggtctcaaactcctgacctcaggcaatccacccgcctcggcctcccaaagtgctgtgattataggcataagccactgtgcccggccacaggtaagggttttaaaggcaggaggcagaggttacaggcaaaataagaaatcatggaggttatacattggtttaacctagaaaggtggaacatcttgaagtgggcccacaggtcataggtgaggcaaagctttgtctaaaactgtgggatcagtagaaaagaatgtcagctctggctcatgggtgtgacttcctccaggctccccagggagaaatttagaacaaagaatggcagtcagaattcagtcctcaattcctctttatctgaagtctatgtgtcagtggatccatttggtggatccattggtgggggtccaggtttctgaaacaactctgggacatatgttaatggcacaggacttttttggggtgccacttcaccagccagagacctctgcagctggctgcacccctgcctgggcctcactcagctctgagctggcctctggccttgctccatccagttggcccagcaggctgcacccagctcaccctaccagccaccacaggtgagccaggtgtggagtggcaagtttgcagggtccagttactgtgcacagtcaggtgcatcagctgctgcaatggaatgagcagctccaggtgctggcatccagactaggggaacacagtggcacccaaaaacttggagatgccagcacctgtgaagccccaaagggggtgttacatcatgtcacagcactggctccagaagctctgaggtctagatgtccagaagggttgcagctcttttctccttcccgccactcacagtgcagaaaatgggggtatgttaacagctcattcagtcctgctgccctgctctagcttgtggctcctgggaaggcccggccctgctgccatttcccatcacgtgggacggatgcccagcactggcggagggtgggagggctacagtgttacagcagctacttttgcacccactgtttggtgggtcctgggttcttgtcccatgtccatgaagaatgagattatgctgacaactggagagtgagcaaggcagagaagagctttattgagcaacaaaacagctctcagcagagaggggagctgaaggtaggtagtctcaatgtgtggctgagtctctccagtttttatgggctcagaatgtgggaggtgtcagctatccatagccttggaaaaggcaacacttgattggttaaaaagcattattcagaaagaaccaattgggaaagagcaggcaaatgaaaatagaagttctcattctggtcatggactccatccagaactgacagcctggttttcaggcttcaggctgtctttggcttggaggttgggtttcatgggggacccaccccaatctgcctgggaatttgtctgtctcctgctgctatctttaagatgctatctttggctgggcatggtggcttacgactgtaatctcaatactttgggagactgtggtaggcagattgctcgagcctagtagtttgaccagtgtgggcaacatgacgaaaccctgcctctacaaaaaaaaaaaaaaatacaaaaattaacaagttgtggtggcatgtgcctgtggtcccagctactgacagagctgagatgggaggattgcttgagccctcagatcaaggatgcagtgagtcatgattgcaccactgcactccagcctgggcaacagagtgagaccctgtctcaaaacaaaacaaaatcaaacaaacaaaaaaagatgttatctttagtttttacagggagccaaacatcccatgattctcacttccatgattattgttttaagctactattactctcttgcttatcaagttgttcatttacttctcaggctagctaggtgcctggaatttccctttaagaaactcaagattttttaattcctctgtttggtgctggggagaccaggcccctaagaggggtccctgctccatctcatttgtaagagcttatgagacagccgctccagggctggccagtagctcaggaggaggaagagtcagtggcagggaaagggaggtccagctcgcctgggagataggagctcttccagcactgggctgggaaaccattctctggcagccctgccactcagtggaccctcaacttctccttaatttcctaggcagtataagggtaagtacaagtaaaaagaaattgaattttccctggtgccaaaaggcaaagagaagtccctccctcccttttcttagagtatttcctttataatcctttctctgtctctttgggaggtatataaacctttctgaaagctaaacaagccctttgccactttggcttcccaggaatgtgcttctcgggggcctcggagccatctctttgaaatgtgaacattaagatggatggtgccctgtctcctgtctctctgggagctttgcctaggagtctggctacaagttgtagcatatgagagttttcttcttcctttggatgagtgcaattaacacatatgtaatagattctatctgcctggctatgtaagagggtgatacattttttctgtctttgcaatttctttagtggattgcttttgatgtgtgttgcaatctggtttaatgcatatgtaataataacactttttttcatttcgtatatttttggacaggttttctagattggcagattttattttaaatttccgcaacagcagcaagtcctagcatacctcaacatcatcccaggaacaccccacccttggggaggaaatatgccagagataggaagggccacttctaaatacaagagagtcatcaggcacctgtcaggagggagagtatccagtctctagagatggaaatgtcaacctaaaaggaagaagcaaaggcagaattaatatagagagtttatttgggccaaggttgagagctgcagccatggatgcacttccaagttgccttggggagtgctctggaggacaaagaagagcctcaagtttttaaagaaaaaaggaagaatcatgagagaagcaattacgaaagctgctcatcaggaattttcattagtttacagaaataacattggttagtgattggctatacattgttgcaacttggcattcatctgcagcccacatagcaagtggcttcaagaggtcattattcagttccagggagagtgagacctgattgtggtcacattttaaatgcctttctgggcctgatgatttaaagggctcacattcctcagataaaggttttttttctttctcagattgaagtattctggtgcactcagcctttggacagaaaggagtggagattctcattacatatgggtgcttgccttagttgttttaaatttatgtgcaaccaggctgtttctcccatataaaagcacccctaaacggctgggcgcggtggctcactcctgtaatcccagcactttgggaggctgaggtgggtggatcacaaggtcaggagttcgagaccagcctggccaacatagtgtaaccccgtctctgctaaaaacacacacacacacacacacataaaaattagctgggagtggtggtgggtgcctgtaatcccagctactacggaggctgaggcaggcgaattgcttgaacctgtgaggtggaggttgcagggagccgagactgtgccactgcactccagccagggcaatagtccgagactccatcttaaaaaaaaaaaaaaaaaaaaaaaaaaggcacccctaacaagagccaacagtctctgttgagaccttcctacccttcaagagaacaccaaattggttgatgaacatagtggagaggaacggggatctccatcattgggaccaagagaggctgtgaaacatgataaacgctggtctagaacagtatggagaggcacatgtagtagcgggttcaactagcaaagagaagacagcgtcctttgcaattttatgtgagtccttccaatcagatgaccttacagaggttttaagtttaggttttgttttttttttgaatttgtgatgactttttggagtttggctcaactgtcttgtagaacatccctcattctagctttgtcagacagcttcgtcagggcctccttgacttgtccttctctcctctgtatttcctgtaactggatgtggatctaaaggctgaactgggctcatgagaagaatccttcacaggtgtgatggttaatactgagtgtcaacccgattggattgaaggatacaaagtattgatcctgggtttgtttgtgaggttgttgccaaaggagattaacgtctgagtcagaagggtgggaaaggcagacccactcttaatctgggtgggcaccattagctgctagtgcagctagaatataagcaggcagaaaatgtgaaaagagactgtcccagcctcccagcctacatctttgtctcgtgctggatgcttcctgccctcaaacatcggactacaagttcttcagtttggatctccctgctctcagagactggctctccttgctcctcagcctgcagatagcttattgtgggaccttgtgattatgtgagttaatacttaataaactcatatatatatattcattccattagttctgcccctctagagaaccctaactaatacaacagatggatcccatcaggacacatgatgacagcccatccctgctggcattgctcactttgataatttagggaaggtgacagtcaccgtatctttcatagtaaacgtgcattttccttctcaaaattagtaaatactgtaatttgttgaattatactttgacatcctgttcctcaacaacctttcacccaataaggtttggcatccactgaaggtgcttccctgaatctatttcttctttgagggttgcaataaatgtatatcttttttctacatttattggaggaagtcttccctaaagaagagttctcttttctctctctgttcctttttctttttttttgagtatcactgtgaattcatggatttctttataactcaatgtcaactgccatcattattatttctgatacttaatctcaatttggccggtgggaccctcttcaagctgcctctgctgttcgtttgacatgatcccattagtccgtgatttccttattttctggtacaataaggtgtcctaggctcaacttgtaatttacctgcttttgacttgtaatcagccggttcaatgaggatccctggttccctttcctggggaatggtacttagataccaagttcaaggcatgaggtgtgcccattgctattacaatgttatgacttctaggctctttgactgaaattaattacagacacacacatacatacgtgtacttatgaattcacactgacatttcttgtttttttttatttcaatagtttttggggaactggtcatgtttggttacttggataagttctttagtggtgatttctgatgttttggtgaacctgtcacccaagcagtgtacactgtacccaatgtgtagcctttttttccctcaaccccctcccacccttccccctgagtccccaaagtccattatatcattcttatgcctttgcgtcctcatagcttagctcccacttataagtgagaacatacaatgtttggttttctattcttgagttacttcactttgaataatggtctccaactccatccaggttactgttgctgtgaatgccattattttgttccttcttaaggctgagtggtattccatggtgtatatatgccacattttctttgtccactcattggttgatgggcatttaggctggttccatatttttgtaattgtgaattttgctgctataaacatgcatgtgtaagtgtcttttttgtataatgacttcttttcctctgagtaggtccccagtagtggaactgttggatcaaatggtagttctacttttagtttttaaaggaatttccgcactgttttccatagtggttgcagtagtttgcattcctaccagcagtgtaagtgttccttttcaccacatctatgccaacatctgttatttttttattttttaattatggccattcttgcaggagtaacgtggttctcattgtggtttcgatttgcatttccctgataattagcgatgtcaagctttttttatatgtttattggccatttgtatttcttcttttgagaattgtgtattcatttcctttgcccacttttttgagggtattattttttgttttgttttgttttgttgctgatttgagttccttgtagattctggatattagttctttgttggatgaatagtttatgaagattttctccccctctgtgggttgtctgtttactctgctgattgtttcttttgttgtgcagaagctatttagtttaattaggtcccatatatttatctttgtctttgttacatttgcttttgggttcttggtcatgaacactttgcctaagccaatgtctagaagagttttgccaatgttatcttctagaattgttatggtttcaggtcttagttttaagtctttgatccatcttgagttgatttttgtataaggagacagatgaggatccagtttcattcttttacatgtggcttgccaattatcccagcaccatttgttgaacagggtgtcctttccccactttatgtttttgtttgctttgtcgaagatccataggctgtaaatatttggctttatttctgggttctctattctgttctactggtctacatgactatttttatacaagtaccatgctgttttggtaactatacccttatagtatagtttgaagtcaggtaatatgatacctccagatttgttctttttgcttagtcttgtttcagctatgtgggctctttttttgttccatatgaattttaggatttttttttctagttctgtgaagaatgatgatggtattttgatgggaattgcattgaatttgtagattgcttttggcagtctggtcatttgcacaatattgattctacccatccatcaacatgagatgtgttttcatttgtttgtgttgtctaagatttctttcagcagtgttttgtagttttccttgtagagatctttcacctccttggttaggtatattcctaagtactttattattattattattgcagcttttgtaaaaggggttgagttcttgatttgattctcagcttggtcattgttggtatatagcagtgttactgatttgtgtacattgattttgtattccgaaactttactgaattcatttatcagatctagaagctttctggatgagtctttagggttttctaggtatacaatcatatcactggtgaacagcagtttgacttcctctttattgatttagatgccctttatttctttttcttgtcttactgctctgtctaggacttccagtactatgttgaatagaagtggtgaaagtaggcatccttgtcttgttccaattctcagggggaatgatttcaacttttccctattcagtataatgttggctgtgggtttgtcatagacggcttttattaccttaaggtgtgtcccttctatgccaattttgctgagggttttaatcataaaaagatgctggattttgtcaaatgcttttcctgcatctattgagatgatcacatgattttagtttttaattctgtttatgtgatgtatcacatttattgactcatgtatgttaaaccatccttgcatcccttgtatgaaacccacttgatcatggtgtttatctttatacatgatgatatatctttatatcttaatacactacttgatcatggtgtattatcttttttgatatgctgttggattcggttagctaatattttgttgaggatttttgcacctatgttcatcagggatattggtctgtagtttttctttttgttatgtcctttcctagttttggcattaggatgatactggtttcacagaatgatttaaggatgagtccctctttctctatcttttggaatagtttcagtaagattggtaccaattctttgaatagctgatagaatttagctgtgaatccatctggtcctggacttttttttttgttgggaatttttgtattattgtttttatcttgctacttgttattggtctgttcaaagtttctgtttattcctgatttaatataggagggttgtatatttccaggaatttatccattcttctacattttctagtttgtgtgtgtaaaggtattcatagtagccttgcatgatcttttgtatttctgtggtgtcagttgtaatagcttctgttttgtttctaattgagcttatttggatcttctctctccttttcttggttaatctcgctaatggtctatcaattttgtttatcttttcaaagaatcatcttttttgtttcacttatctttttgttaatgttgttgtttacatttcatttagttctgctatgatctttgttatttcttttcttctgctgggtttgagtttagtttgttcttgtttctctagttccttgagggtgtgaccttagattgtctatttgtgctctttcagacattttcatgtaggcatttaatgctatgaaatttttcttagcactgctttttctgtatcccagaggttcagctcaaatacttttttttttcttttttagatggagtctcactctgtggcccaggctggagtgcagtggctcatctcggctcagtgcaagctccgcctcccaggttcacaccattctcctgcctcagcttcctgagtagctgagactacaggcgcctgccaccactcccgtctaattttttctatttttagtagagacagggtttcaccgtgttagccaggatggtcttgatctcctgacctcgtgatccacccgccttggcctcccaaagtgctgggattacaggagtgagccaccacacctgacccagttcaaatactgtttaaatttctgtcttgatttcatggttgacccaaaggtcattcaggagcagattacttaatttccatgtatttgtgtagttttgagggttccttttggagttcatttccagttttattccacacggtctgaaagggtagttggtataatttcagttttcttaaatttattgagatgttttttgtggcctatcatatggtctatcttggagaatattccatgtgctgacgaaaagaatgtttattctgcagttgttgagtagaatgttctgtaaatatctgttaagtccatttgttctagggtatagtttaagttcattgtttctttgttgacttcctgtcttgatgatccatctagtgctgtcagtggagtattgaaatcccccactattatcatgttgccatctatctaatttcttaggtctggtaataattgttttagaaatttgagagctccagtgttgggtgcatatatatttaggattgtgatattttcctgttgcagcaatccttttatcattatataatgtccccctttgtctttttaaattgttgttgtgttaaagtctgttttgtctgatataagaatagctactcctgcttgcttttggtgtccatttgcatggagtatctgtttccattcctttaccttaagtttatgtgagtccttatgtgtctggtgagtctcttgaagatggcagatacttggttgatggatttttatctattcttccattctgtatcttttaagtggagcatttaagccatttacattcaactttagtgctgagatgtgaggtactgttctattcattgtgctagttgttgcctgaataacttttctgttgttgttgttgtttgttttttctatttgtattgttttataggccctgtgagatttatgctttaaggaagttctatcttggtgtattttgaggtttcgtttaaagatttagaactccttttagcatttcttgtggtgctggcttgggagtggcaaattatctcagcatttatttgtctgaaaaagactttatctctctttcatttatgaagcttaattttcctggatacaaaattcttggttaacaattattttgtttgaggaggctaaagataagaccccaattccttcttgcttatagggtttctgctgagaaatctgctgttaatctgataggttttcctttataggttacttgatgcttttgcctcacagctcttaagagtctttccttcatcttgactttagataatctgatgactacatgcctagatgatgatctatttgcaatgaatttcccaggtattctttgagcttgtttgatatctaggtctctagcaaggccagggaagttttcctcaattgttccctcaaataagttccacacttttagatttctctttttactcaagaacaccaattattcttaggtttggcagtttaacataatcccaaatttcttgggggctttgttcattttttaaattctttttttttcttttttttggtttttatctgattgggttcattcaaaagtcttgccttcgagctctgaagttctttcgtctgcttgttctaatctattgttgacactttccagtgcattttatctttctctaagtgtgtcttccatttccagaaattatgactgttttttctttatgatatctatttatctggagaattttcatccatatcctgtattgtctttttaatttctttaagttcattttcacctttttctggtatctccttgagtagcttaataaccaaccttctgaattctttatctggcaatttagatttcttctgggtttggatgcattgctgggaagctagtgtgatctttcaggggtgttatagaaccttgttttgtcatattaccagaattaattttcagattccttctcatttggtcagctttgagctcaccaaagagaatatttcaatggaaagatctggaactcaagggctgctgttcacattcttttgtcccacaggtgacccttgatgtggtgctctcccccttcccctagggatggggcttcctgggagccagactgcagtaattgtaattgttcttctgggtctagccacccagtggggttaccaggctctgggctggtgctgcggaatgtctgcaaagagtcctgtgacgtgatccattttcaggtctcctagccatagctaccagcacctgctctcgtggaggtggccagggaatgaagtagactctctgagagcctttggttgtagatatctttagtgtgacggctttctcaaatgcttgttatgttaacagtgaagttgtcacatggacagattcaagacctctggttagccaggatgttgcaggcagtggaattagctgttgttttctctttccttgaagcagggttattccgtcatgagttgttgtaatgtcctgagctgcttggcctccagccaagagatggtgctttcaagagaacaccagctgcagtagtagtagagggatctaagcttgcccgaatttggccaggattagtatttgggtttctcaggtgatgggtggggccataaagctccccaaaatttatgtcttttgtgatcaactaccagggcaggtagagaaatatccatcatgtgggggcagagtttggcatgtctgggctcagactctccttgagcaaggcttgccacagccactgtcgggggtgagaatgtggttctcaggccaatggggctatgttccaaggggtattatggctgcgtctgttgcattatataggtcaccagggaagtaggggaaagcaataggcctcacccagctcccacacagttggtggggccgatcttgctccttctgtatcccactaacagcaccaagtttatctctgggcagcttatgctctggactcagaccttgccccaggctataagcttccctgctgagaaagcaagcacagctttcgggccttgcccttccctgtctgcccatcctgttggccacagctttgcactcctatctgtagcagttcccttttgccctccggattctgttcaagagaatttgcacccagttgaaattattacaaagctcacttggaagcttctttcaccctgtggcccctgctaattctactggctgcctctctcaaggacccctgtgagatagagtcagagatggcttccccgggctaaagctggagcatgggaatgtctacaaggctcttcccactgctgcttctacttttatagaaaatattttgtactaaatccatttcagctgtagatacggttaaatccttctcctgtaatctggattttcaggttccccattggggatatgtgcttggaggcaggttttctccctctcacactttgggaatgcacagttttttgcctgtcttgtggaatttgcagcggtgtgccacttctttaaaaggatcagtgaattattttggttttcctggtacgttcctgtggtcgttcttagaacaaaagttcatgctttgtgtctccacatactcctctgtctgtccattcaagtgggagctgaacagtagccctgtctcctatctgtcatcttcctcttaaaacctggcaatttatttttattttttatagagacaaggtctcacaatgttgcccaggttggtcttgaactcctgggctcaagcttcccaaagacaccgatatttataatttaaatttaacattactgaattattatttaactttattttatttaataattgtatctattttccccttcaaaggaaattatgtttcctaaaaacatgtttgtataacatacatatatatacacatacatatgattaatatatatacacacagtactttcttgttctatccaaaaacattcacatagcagtctcaaaatgataataatagctttgttacaaacaataaatccagtaagggcaaagcttatttgtaacactttctgttcccagagagtatccaactaaggctgtgcagcccaagtgccacgtttgacagtttcttaaaatgattctttttgccatgttatcagtttgatatatagttggcctcatttctttgtgtgtacaattttggactgctttctctgatcttttttatttcatttatgttttgcataatgtaaaacacttacatggttcaaaagtcaaaactatttttgaaagtacagagaattctttcttccagccctatccctctacaccattcctacccacttgtatggttaatcatttttattggtttttggcttatctttccagtgtttctttacaataagcaaatatgtatatgtacacacatatataatcttatttttcaaaaaataacaccatatatgcactgtctgtatttggccttttctactaacaatatatcttggatattattccatagtggttaatggcaggcattttttattcttctttcttatggctgcatagcacttcactatgtgactctaccataattcactcaaattcatttcaaccagtttcccattggtggacacctgaaaaactcctatctctcgatatttggttagttgcctcaactgcatgccaacttctgctttggagtggataaggaaggtaagacctttggggacaagactcaagactcagccacttttgtcccaaagctacaggacttgttctgcctgccaatgctgtctctttcttcagcaaaagtgggattaagcgtgtgtataatgccaggtatgaagctgcactgctatgcaagttggacttctcaatcagcataaaagagctgaccattggaaccatccgaaatctcatgaagagggttgagggactctacttatgtacattttacagcagagagtaggaccgggtaagtcaaggttatccactatagtaagttactgctcaaaggaaaactgatagaaaaagggtctccaccttcttaaacacagaagcagtctgcttcaggcagaagatgacaggcaactcttctagtagaacttgaggtatacattcatggctccattgagaatggagatggggtttcaagcatggaagtggggacagtgacccatcagtctgagaagacacttttatgcccacatctcaagcattgctattattttagaagtagatgctcagttgtctgataaagagtatgatatcatccctattggttttaggacctagaaatagatttgcaggaccctaagggcaggatagaggtggatgagaaggtttatagtttttgggtccaagaggtggtggttggttagcgtatgggagaagaaccagcagaacctgagggtgtaagggttgatagacaaaacaaagctctaagtacatgggccccaggccagcgcccagaaacaagcccagacacaagaacccagccccatactatgatctcacccctagcaggcccccattcactctgcagctgaatgtccaggacttctgcaggttaaagaatgacatctgctaatctccagtcaaggtgcacctcagctacactctggactgtagtaacaatgtgcaccattgtctgtatgccctggggaatcactagactccaaggtgggctttgaacttggtgttgtcaccaaccagtgggtggggacctgggagtcccataccttagtgtaggaatgttgatgtcatgggtattggggacagaggagatggactgcattcatgcatgcttttgctgttgtgccagctctctaaaataccttgccttttttggtctatgtatcagagacctttccatctgtcaacaatcaacattagcatcaccttgctaatagagcttttcttgggccccctttggtagaagggtagtctactccttccttttggttcctaatccagtcctgactggattataaggacttcaattcatctctataactagtatttagcactgtgtcaggcacctagctggtactcagtaactgttcagagaatgagtgaataaatgaatgaatgattccaacagatgaaggaactggcctgaaaatgacttgcctatttgccaaattcacccagctttttagtttctcaccttctgacaccaatcaggaataaaagccaaaacctagattggcttttcatcccaagacatgtcctgtcctttatatgggtgtggacttacgttagagcccttgtcattcctaataattccctcttgtgcctacctggatggagctcaccttgggctatgattaggagagcctatctccagcacctgcactcactcacctgactccacctgatgacttgacctatttgttcctccatcagtcaacatgagtgcattggagacttactgtccgttgttctctgtggacacatgtgaagtgcaaagacatgctaaggcaactggcctgagcctgtaattcagccaaggctggtaatgacacatgatcagaggtcacaacactctttttaagtcacagcagtttcccttaagcatggctttagagtctctgagctcaccatgacttctattagagatagcataagcctacagtgctttccctactctttgttctcattcaccactcagcaccacacttttggcaccagatagatggggatttttcccacacgtatcagtaaagcaattctgcagcacacaccaatgaggtgtcctgcaattcaattcaattctgatgctaactacccaaagatgtcatcaaatcccacagggtgagggcttagtcctataagactctccccaaccttgcacaccaattgcaagccctaggatgtgacctgtgcctttgaccaaccagctacaaattgaggttcctacaaccccctccttgggttcaattaatttgttagagcagctcacagaattcagggaaacactttgcttatgtttatcccttatgataagggacattacaaagggtaaaataaacagccagctgaaagggaggcacaggatgaggtatgtgggaagggctgagaagctcccatgccctcctagggaccaccctccaggaagctccacatgttcagctgtccagagctcccaaaactcagcccttttgggtttttatggaagcttcattatataggcatgactgactacatcatgggccattggtgatcagcttaactttcagcctctctccccaccctggagtttggaagtggggctgtaagtcctaaccctctaatcatgccttggtctatggacgaccagttcccatcctgaagttacctagaggactcatccacccattactcattagcatacaaaagacactcatcactctggagacttcaactgtatatcaggaaacatggatgaagaccaaatatgtatttcacaatattatagctgccatcagccatgggtgagtttctcatcattcaaagtttccttcttttttagaaaccacctgttttactctaaacaaagtagattcttatgaaaggtaggctgtttgggggtccagaatttcaacatatgccaccaaacccttttcttccctctgaatttttggaggcgcacctcaccttgtgaatttgtagcaccccaaaccagtaagcacacacattcaaatacatgtacatgcccacagctacccactagtaagcaccatcccccatgtccggtcacacagatgtgagaagatggagaaatgttcacctaaacagctggtgtgtgaagtcctgcctctgtcagctgagctcacatgggaaagatccccagtccctaggccccacatcaatgggcacagggccttcggaggaaaggacaaccactccgtcgtggagggagaacactttggactcgggtgtgtgtttgagggattccagagggtagaggttgaggaagaggagttgggagagtgagaaggtaggatgttgcacaggatgagacccttcctctcaaaccaaacctaatagccaataagtacaggaaaagatccttgacatctctagtgatcagggaaatgcaaatccaaaccccaataagaaaccacttcatactctccagggtggccagaatacaaaaggctgagaacaagtattgggaggatgtggagagatcagaacactcctacgctgctggtggcaatgtaaaacggtacagctgccttggaaaacaggtccccaaatgttaaacacagagctatcacaggactcagcaattccactcctacatatataccctgagagaaatgaaagtacatgtccacatggacacttggacacaaatgtgcatagcagcattattcatagtagccaaaacccaaatgttcatcaactgatgaatgaactgacacaatgtggtctatccagacaatggaatattagtcatgaaaagggatgaagtacttatacttgatataccatggatgaacctcaagtatgttaggctaagtgaaagaagccagtcacaaaagacctcctgttatgtgattcattcatatgaaagtccagaatagggaaatctatagaaacagaaagaagattagtgggaacttagggctcagcttgcgaggtgggggcaggggcaggaagatgggaggtgacagctaaagggtttggagttttgtttggaggtgatgaaaatgttctaaaactgaccgaagtgatggttgcacatatctgtgaatagaccaaaaaccattgatcatacacattaaatgggcgaattgtatacatgcaagttatatctcagttaaggcattaagaactaaacaaaaactaagaacacagatcttctgtctttcctatttatttatttattttgagacagagtcttgctctgtcacccaggctggagtgcaatggcgtgatctcggctcactgcaacctccgcctcctgggttcaagcaattcttctgcctcagcctcccaagtagctgggattacaggcacccgacaccacacccgactaatcttttgtatttttagtagagatggggtttcaccatgttggccaggctggtctggaactcctgacctcaggtgatccacttgcctcggcctcccaaagaactgagattacaggcgcgagccaccacgcctgaccaccttgatcacctttttttttttggaaagcaatgagggagcaacactttgttacctgggaggcgtggaccaaaagagaggcagaggctggagggagagtgtgaggcagggatcaatgggcatcatgccaggcttagggcatccccaaagctgtgggattggggcttgaagcccaggtcttagagacctgagcaggcccagctgacacaggctgcaaacaaatgtcctctcatcctcaccgcaatccctacaagctgctcacctcctgttgccatgtggatgtgtcctgagtggcccacgcagatttctacacttgatcccctcgcttgaaataaaaggagataaagtgagtacaaacacccttatgcattactgtagctcaaacgaggccagactagatcctaaagaagacctggcgtgggccatcttctagagtcatcccacctcccaggacaagcaaaggtcctgcctccaagtcattgcaacttatatgacacagcaaggcaatatagactctgggggaaaaagttttttaactacagtatttttaaaatagaacattattttgaaattacttcgacatctactgtcaggtgacttgtaaaagcgcttgtatgttaaatgctctacattaggagattattttgttcttgagtccctacagagaattccttgggaatgaagtgctattgtgcattcagaattatgtggctatagccatattgcaggccgggaactcaggaatgtcccctctgtcccagctcttcaagttgggccctacagatcccacggggacaagcttttggaaaattgctgggtttctagaccaatcacgtctttgaaatgtcttcttgtcactccgtggtttcttgcttcagcttaaccccactggccccatagatcaggcagctcacaatttgaacacagccagggggcatggaggatgagaaccaatctatcctgacaatcctggcagcacgtggggaaagccaggcccaagtttccatatgtgaacacattacattgtctccaccaagaaaagagcccctgtgaaatattcatgtgcgtcacccactttgccttaggttccattacctaagggacagacctggtgttgctcaacagtgccaggcttagcactgccaggggagatctgcagctacaaagagttaaagaagaaggaattgaattgagttataagcaatacatctaataaatatttattgagtgactatttcattccaagcattctgctaggtgctgagaaatcagaaacaaatacattgaactcattggcaaactagctggggagatgggcagggaagccaactgttgcagtctggtgagagttgtgctggggaatgcagtggctttgcaggagcccggagcagagacatgtagttctgcttggtgggattgagcagatgtcaggcaaagcttcccaaaggacacgatgctcaagaagggtcctgaagaatgatttgaagctggaaagtcagaggaaagcatcgaaggtgaaggcacagaggtaggggacgcatggcacacccagagaactgcagacgccctgtcatgcctgcagtcttcacgggaggtgagaaagaatttccagggtacatggatgcatgttaggaggctgagactggtcttcgaagatgatcagacataggcttgaagacttgatgctttcaaaagctcgctctgacagtagcgtagagaaggaatgggggaagctttgcttataataaagtgagaaatgatgggggctgaattaagagaatggctctgggggtggagtatgagagtatttcctaaagatagaagagagaatggccaggacttgagagtggctgaagtcgggtacagggagacaggagacaccttttatggccatagcttgagtcactgtgtggacaggcgtgctcatcattgagaccaggaagcttggaggggaaaacgctcatatgcaattctgaagttcctaagagacaactggataacacacaaggatgaatgtgaaacaaacaaggggctaggtcccgtaagctcatcagaacttctttctgaaagaagtaaagcacatctctaatgacaacagaaataaccacaaacctgcgagtcagcctcaaatatctttcctgggggattaaatgatggctgagggacggggtaccccagaatgtcccttgcacaggaaaggacctagagaagagagactgttttttgagcaggtcacattcagcttactgcaatgtctttgctttaaacggtcccctgcattataagaatggagtttatatgagaggtgagagggtcccagtgacttagcaaccgtggcatgcttctgcaaacatttcaaagacctctactctggcttttagaatgctttctagagcaagtagcatgcataacgacaccactacctggaattatacactgtctttcttcagaggcacacaaagagcttaacacattaccttagttctaggttagctgctttgtttcatgcatgcttgctggtgtttctggaagaacatttatgaggtgattgctcttgaaagacttcagaacaatcaagatggtttgttgctgttgggttctttttttttttgagacagggtcttgctctgtggtccacgctggagtgcagtggtgcaatctcagctcaacacaaactctgcctcctgggctcaagcaattctcccacctcagcctccagattagctgggactataggtgcatgccaccactcctagcttttttttttttttttctgtagaggcaaggtttcaccatgttgcctaggctggtctccaactcctgggctcaagcaatctgcccgcctcggctttccaaagtgctgggattataggcgtgagccactgcactggctgggttttatattttattttatttatttatttatttagactgagtcttgctctgtcacccaggctggagtgcaatggcgccatctcagctcactgcaaactccacctcctggattcaagcaattctcctgtctcagcttccggagtagctgggattacaggcgcacaccatcacactcggctaatttttgtatttttagtacagacggggttttgccacattggccaggctggtcttgaactcctgacctcaggtgatccaccctcctcggcctcccaaagtgctggaattacaggcatgagccaccgcgcccagactggggttttttaattttcactattattttttaatagaaagcatgcaaaaagagacgacacagtcattggacagtattacaaaaaatagtcatagaagtgaatataaatgatgcaaaatgcaatacagctagagtcccttcttcaccctttttattgatatgttcacccaagtgttctcacacatagaagcaggtggttttctttactacagtagtatagtttggagtgtttatgcttcactaatggtacaaaattagctgagaaaagatttaaattggtgttttaattatccagtgtgataacaaaccacctaaaaatgtagtggtataaaacaactactgtgtattttctcacactactttgtggaggtttaaaaacaccacaaattcatcaccttggtttctgtgggtcaaaacaacccaaattcatcatctcggtttccatgggtcagaactgcaggtacgggttggctggggcctctgctcagggtctcaccaggttgaaatcaaggtgacagccagagctgtggtctcatctgaactaatgcagaactcaccagagcacatgtagtgttggtagaatccatttccttgtggttggaggacggaggtgtcctcttccttgctggctgctggccgggggccatcctcagctcctagaggctgccctcaagtcctggccacatggcaccccagtctcaccttgtggcagctccaggccagcaggggacaccactgctccctccagtgtcctctcagggttcacctgattgagtcaggcccatcaggataatcttccttcttttttttttttaactttttttttgtttttgagacagagtctcgctctgtcacccaggctggagtgtagtggcccagtctcagctcactgcaagctccgcctcccaggttcatgacattctcctgcctcagcctccccagtagctgggactacaggtgcctgccaccatgcctggctaattttttgtaattttagtagagacagggtttcaccacattagccaggatggtctcgatctcctgacctcgtgatccgcccgcctcggcctctcccaaagtgctgggattacaggcgtgagccaccacgcctggcccctttttcaacttttattttaggttcaggagtacatgtgcaggttcattattggggtaaacttgtgtcatgggggtttgttgtacagattatttcgtcacccaggtactaaacctagtacccagtagttatttttttctgatcctctttctcctcccaccctccactctcaagtagccactgtgtctgtcaatcatccttcttgataaactcaaagtcaaacgagtccagatcttacctacatctgcaaaatcaatttttcctataaaggaacgtaatcacagaagcactgtcccacagtagtacgagtgctgagccgttgtaggcagagagggttgtcctgcccacactcaaggggagagagtgcagggccagttcacccctcacgcggaagtggcagtgctgggggctcacttcgtgctctgctcaccacaactccaaactcacaactttattcccaccaatcccatcccctccagtccagggggcacacactccagcaggacttcagctgagcccagggaacgctttgctgactggtgatgagggacctacctcttcacacccatgacacccacccgctgagcccctcaccggggctccgaaggccctggtcaggtcacctctggtctcactttccattctcccctccttcctcccctccagccacagggtccttctcgatgtgcccagacatggtgggtgcacacttgtctgacagcctctcttcttttccctttgcttggaatgctctcttcccagttaccaaagatactcaggctctctccccaatttccttcaggcccttgctccaaaagctccttccgggtgaagcctcccctcccatcctccttaaagcttcagcctctacctgggacacttcctcccccactgcctgcctccttgaaactctccttagtcctcttgcagcccacacagctgaacacaggcaggagggggcgctgctgccctggctggtgtgcagccaccagaggctgaagctcactgacgtctgtctggggcccaggatcaccttccttgattccagctctctcaggctgtcaggacctggcgctgggaggcactaggccatgccctggcctgaggccttctctctccctctttgccctgtgtctctgcagggaagcccggccctgcccctgggagggtgggggcagacgtgtggagagtgggtgtacaaggccagggtttgccaggcccaggacagcctggcacctgtcaatggatgagcgcctctcccttagcctgatgtcagggtgggcatgagggtgggagcagagggtgcctaactgaggaaagggtctgtgcaacccccttctcctaccagttctcgtttctgaagtctcctcaagcacactgcggtgtccacaccattggcagcaggctccttctcttcaggtggtcttaggaacttctcagaactttttgagttatccttctggtctcttcctcctgagcacggttctcctggttgagctccaggccatgccattcaacgccctccaggacaggccgaagggcttgtctgtttggtggttgctaaggtttgaaaaaagccagctggaaacttaatccccaaagcaacagtgttgggaggtgggacctaatgggaggtgtttagtcatgagggctccacccttatgaatggattctctctctcttgttctctctctctctcttcccgccccgcccacccctccttccccaaccttgtgataccttccaccatgtcatggcaagaaggcccttgccagatgtggcccctccatcctgggttcccagtctccagaaccatgagccaaatgcatttctgtctgttacaaattatgtacggtgtggttttctgtgatgaacacagtgctgtaccagggccctcttgccaagacagccagcttataggagcctgcatgtgaggcccggacgtcctacagagcagcagttagaggtctggccttctggataggcactgccctgccctgcacacaggaccttggtggggcatgatggggctcttcaccacgctgccctcattttaggaggtgggcaaccctttctcccccttctccatgtgcttctgcagttggaagaagtgaggggggttcagacacacttaagctgagcttagagcaaagcatgtccctcaaggtgaccttgccgcatggcctgaacctagaattcccctgaccagggtggacagccatcaccatgggcctttctgcctggcctagtatggctctccttcgaactcacctagacccttgcatcaaaggactcggggactctgctgcagtcatcctagcacggtcgagaggagtaggaaggtgcccagcggctcagcctttaaggaggtctattggtcaccattgcttctgccttcttgagaaccatcaccctcggaggatccggtagtgtatcccagtcaagtgtcaaatgcgttgttccctggagaggaaggcttatttccagaaagtactctgacgttttgtaatttgtgatttctatcactggctcagtggcctacccactgctcagctcatgtggcatgaccaggctggggcgtcgggtcatcttgttctctgggtgtgtggcaacactggtttatggcgtaatttccttcctgagaagaaattcagtaatttctaatattcagggctttaggtagaggcctgaaaatcactctccatgcctctttcagtattttatatatagttgtctcttggtatccatggggtttggttccagaatcccctgcagataccaaaatttgcgaatgttcaagtcctttatatatagtggcatagtatttgcatataacctatgcatatcagccaatcatagatggtgatttaaatcatctcttgattacttctaacacctaatactatgtaaatgctttgtaagtagttgttacctggcatttttttatttgttttatttttgttgttgtttcattaattttattttatttttggaatattttcagtccattgttggttgaatccacagatgcagaagccttagacacagagggccgaccacacctatgtatgctgttcttaaagtagcaacatatttgttctgaacatagaagaaattagtcgtctattagactttaagggagtaaatatggtccaagttgatttttaaatttagcaaatagtcatagacatatcagtgtcttacagaaaatatttattggaatgctcactctctcatttgggatactgctttgccttgctgtgtcttaagaatgtcatcagagcatcacacacttgaaaaacgtttttaaaaggatatgatgataattaagaccttctccccaacccctgcccattatccaagatcaatgtttttttcctttatcctgattttaaaatcaagtacactttattgaggcatactttacatgaagcaaaatgtaccctttctaaatatgataagtttgatgagttttcaacagatgtatacagctgttaccatgactgtgtctttacccaggttcttgcattgctcaatccagatacagaatgtctccatcaccctgacaagttcctttgtgccgcaccctctagccaatcatctgttttgaggagagttttaaaacaaaggtttttgttctttttcactgatgaccataacctaccacagacagggtctctctctctctctctctctctttttccctgttcttgcgccagctgcctgacaatttgtgggattaaagctctaagctgcttactggctcttctgactagggagagggagcaagcctcattatttttctattcttttcagtgactgctcactcctcttcctccaaaatccctatccatccatccatccatccatccatccatccatccatccatccatccaactttccatctacccatctatccttccatctatccaatccacttgcgtgttgaacgtctactatgagccattggctaccaggaatcccacttccacccaaattatgtttcaacagggaagacaaacaatttaacaattacgataaaaaagaaaatatgccatacaatggaaaagaagggggcatgatgggagacccagcgggagtagctggcaacgattcttagggggaagagacattcctaatagacacctgcaggagaaatattaaagagtcaatcatttcagtagcgcttattgtgaccaataatgcaagaagtttctgggttcccaggctgatgggtttgaaagtcactgcatcatgaatgtgcccaggacccacacgttgttttgtaagagaggggttcagtaaaatgtgaaatgaccgacattcaacaggcagaactgtgcagaatgcacgctttgccactgattgaaagtgtttcttcagtaggttttgatagaatatattactaatctggtaagaaacagcttagggccactcaagaaaagaaaagcagcccctagaaacatgttctgtggctgggcacagaggtagctgctggaatttgaacaggggtgagcaggacctcgtggacctcattgtggggttagcagggctgggctgggacaatgagatcattttctaggcagagaaaagacaacatggtaagttaaaaacactgaaaagtctgcgctgccagagtacaaatgtcagccaggagggccctgacactcttgaaagagggatttgagcagtggccactgcatctacttggcactcgttcgctgtgtagaagggtcaccgagtccctcatcagaatcctgaaagaaggagaaacggtgggcacaggcagcacacctcaatcacttgtgaataatttccttctgtctttcataaacatagctatgattgaaatgacctttcacgaacagcagggaaggattgtggaagaaaatgaggtatgtgagaagcaaatccatctacctgattgccatgtaactttcggtgagtcacggagtgagaatttcagatgtgaattaaggattgccaagagtggtgatatacttgaaaagtttcctccacgttctactccctgttctactttagaatcaggaggccagagaggcaggagggaagagtacttgttattcatagtggaccttcttcctgaataatttttagggtaattatgtatgcagcttccacctgagtcactgacctttgggtgaatgttactggatatgtacctatgatacccaggcaaactttctgcgggttctacgggcactgtgaagtgtgacagactttggctgcgcgttcacttttgatcataacacgtccatagagtgcttttaatctcctgcaacttaacatatgagaaaatcgatttattttgtagtgagttctgcacatttcacagaaaattaaagctctctgaaaacccaaatcttctgtgggcagtaattcacacacaatattctggaaatgtaaaatcccaaatgcctgctgacttcaaatcaatgtttatagcttgtgtctgaatagctccatgaattgctccgctcctctccttctactgcccttcgctttgatttagccactcatttccaggggctgattttctttttttgcatggccctaagctgtttcccatcagattagtaacatattctatcaaagcctattgaagaaacactttcaatcaatggcaaagtgtgcatcctgcatgatgctgcctgttgaatgtcggttgtttcacatttgactgaacccctctcctacaaagcaatgcgtgggtcctgggcacattcatgattcaattactttcaggcccatcagcctgggaaccagaaactttgtgcattattggttttacaatttcagctgaggcttccacagaacaactcagaagaaataggctgtcctgagtgagccttttccttgacttgtattttctattctaaggtctattggcttcactggcagtgggaccactgactttttccctcctttatctaaggggacctgttgagagtctctatttggaaatatttcctgcctgtccttagtgggggtcaatgcctgaatctgtccaataatcagatttgaccaacttggtggaagtgtggattttccagcacgattaaaccttgaacatatatggcttgaaaatgtgcaaatactcttggaaatgacaggatcatggttctcaagacagagaaaaaaaagtagcatgtgaattttcatagataaacgcctaatgctaatgttgatcaggattaatgtcatttcctagatttcagcaaataaacactgggttacttaggcctttgtgggcttcccaggaaggtcaccaccatttgaaatgagactttcaggggaaaagctgccagagattaaacagaaggcttacagatgcatcttctgaagataacttagtatcttccatggacatcttttctaatagaaaagaaagctcttcaaatgaccaaaaccattgctgttttgtggaggtgctggtgaacaggggtttcatcacagtagcatctacctgtacaaacgaaatactcgaagttctgatttcagttttatccattttcttcttttgcaagtgatgcattcttagtgtggtggactctccatgaaccacagcacagaattaggagtttctaagctcaaattgacaaaggatgtctccttctgaatttaaaatgtttaaaaaggtttaaaagccttttaaactgcagaatttagaaggttcacagatttattctagaaataaaatgacaacttttctgtaaggagcatactgtgcccatttattatagaatgcagttaaaaaaaatattttgaggttagcctctccagtttaaaagcacttaacaagaaacacttggacagcgatgcaatggtctctcccaaaccggctccctcttaccaagtaccgtaaacagggtttgagaacgttcaatcaatttcttgatatgaacaatcaaagcatttaatgcaaacatatttgcttctcaaagaataaaaccatcttccaaatttccaaagcatgcattgttacttggcattaagtatttcaaaatgacaaacattgttacggtattgtaaggccaaaatataatacctatttaccagacatacacattacaactagaaaaaaattacaaatgttaacctagtataacaattccatcaggaatgaatggggaaaggcactgcatccctctcatatcgccacagatctactatccacttgacatgctttgaattcaagtcctgttagacatgggaacagcttttcctacaacatatgattcacaggtaggttaatacatcttagtctcccactgccatacttttcacccaagtgtacaacaggtatgaatatatgctatcagctttatttacaagtgtatcttgatgtcttcgtggggtaaaagaaccaactatctcaaccaacagtttccaaaaaagtttttggctatgattcatgtatagaaaccaccacataaaagaaacaacagaaactgaggtccgatcccaaacacctaaactaaaatttctcacccactaaaagttggcagtgaaactgctattctctgaattgtataagctaaattctacagaggaatttcagatcaacttcttttgcaaaagcacaagttacacgttgcacggttggggatgctgagtgaatgcattccaggaagagttccgcaagcaagtgctgttgcaaagagtcgagaatccgagaatctgggaaaggtgatacgttttccaaacgctttcctggcttcccaaaagatgtaaaacaacaacggtgtaactttatatacgaacaaaggttagtcttgtaaatcagtaatatacatgcacaaacatgagaacatgagggaagaaaggaaacgctacaatttccacattgcattgctgctgttttcacaacctctctgcactaggcggcttcctgtggtacctcttcctaccagtagagagtggcccctgcaggccacttagaaacaggaagctctctcctgagctcactgatcaacctgcccttggcacagacagaacctaccagaaaagaacaagtacaaaacactatcattatctgttttctcaagacagtcccaaatgtccttgtgcgatcaccacaaactcagtgattggcccaagtcattcccgggtgccatgaacagtaactggtgtgcagcattagaacaaggggacacggccttgattctcttctgagcaacatgaactgggatttctgccaccccgatctcggctgccacctccgaagaagtcgtgaccagccacctccacagtaaaagattcctcccgtgagtatgatttggaatgcgtcctcgtcgcgtgccagttcagctgaggtggatcggcgtgtactccggcctcctggtctggataatttttggcttaggtctcctcattctttccatttcctcttcttcctccttctcttgatcactctcacatacatggaccaccacgctgggagtggtgtcagtcgctgcgtgcaattcatacttttcccctaaggagggaaaataatcgcagggtcactcagacaagtccttgggagtcaaaaggcaaacataaaagagcattcagggctctgctgggccagctgctcgtgaccattcgattgggctgagagacacagccagacatattttgggtttgtatttctttgctagctcattcagaaaaagagagatttccattgtgcatgactctgtttttagtcaaacattctgggagtccaggcacatgagaagtatagaaggaatgcatttttctagttatacttcacatgtccaccagatatctaaactacccagagaactccctttctgtcagcatttcctcaagtgtgaatgtgagaaacttcggttcaggaaaaagatggatgaagaaacgtatttggaaacagaaccctgggcctccctcatgcagctcctatttgagggtcgcagtgcacgcccaggaagggcgccacaggaggccctgcagcagacgcaggggtggctgcacggagccaggtgctctggaaacgtttttgacctgggcatcttttccttagaacaacttctaatccccgggaccaggagtgtcctgctgttctatgtcagcctgagttctaccaggttggccaagttcaggccactctggtccagcaagggtggggagagctttctgcaactgaaaaacccggcaatgtagaatgaagggactggggcctcccgctggggtgccgctctggccacgggaagagtgtgcatctctggtgctcatgaaggcagctctgagcctggctccttagtacccagggctcatgggcactttattctgcttccctgtgcacctcagttccctcctcagtaaaggagacggtaaaggtattgacttcatggagctaacagcatgagtgagtgcccgaggcaatgagaacccggctcaccacatgcttgtccagcccatgtcacctagaaagatgtttaagaatggagactgcatcgttattggtgccctgctgggcagggatctgaaataggggcaggaggtttgcttcaacctgctccacccacagggtgtggcctcatggtcagttttcttccagggctttgtgcttgggatttcttttcttttcttttttctttttctttctttctttcttttttttttttttttttttgagacagagtcttgcctgttgcccaggctggaatgcagtgacaagatctcggctcagtgcaacctccgcctcccaggttcaagtgattctcctgcctcagcctcccaagtagctgggactacaggcgcatgccatcatactcagctaatttttgtatttttagtagagacgaggtttcaccatgttggccaggatggtcttgatctcctgacctcgtgatccgcctgcctcagccttccaaagtgctgggattacaggcatgagccaccgcgcccggcctgtgcttgggatttctttgcagttcgggtaagcgaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatgctggttaagagcctcttacaaatctacctctttgcaagtctcttatctacctactaatcatcgaaaatccagaaagctcagggtttaggaccataatttgcaaaatctccgcaatcctgttggttgaaaagcacaggtgaaatatgaaatctcactcaagctcactgttaagtgaaccaaggacaaactgattttattacgtctatttcctaaaaagccttctccaataagccctcggtgaaggaagtggtatattctggagtatgcagaatttttattaacagcatttgcctctggaactgtggacacctctttgcaagtggagaccctgttttctcccattcctaacctaggggaagactccacaccctcagccatgctcatgcccccgggccaggagctgctgtggggggagcacacgcttcctcaaaatggccatttctgatcttgaccttcacgccacaattagcagtaagtaatgtgagtcttgctttatcccacagagggaatttccgtttggacaatgttttcagaaatgtaatcttttcaatatgaaactgctgatggaccaagaaaacaaaaccctcaacccaagggaacatcagattgctggtcaaggagaaatgaggagctgacggtctcagcatttatttgacttgctccacggacagagcaggagaaggctcaaacctcttcaccccaagactctccctcacacctgcctcctcacccaaaccctagaggacaggacaggaaccaccaacattttatggttttcaaaaatcctgcattgaacactgactgtgagccaggtgctgatggaagtgcctttcactcgatgatctcatctactgctcacaattccaccagttaaggcccacattttggacaaagagcctgaggaacctaccccctccccgcagtgctcacacttttgtccctccagaggacgggaacttcctctttctttagcaagctctgtaggggaccagcccacaggccctggggtagggcagcccgaccgcggcccttccctcaccatggcctatggttctccttcccttttcctttaagaaggccaggtgagaatcacaggaaagggagaatttattttgattaaaaataacatttcttaaagggggcatcgattttccctttccaaagtccaatcactcatccctatccggagcgacagaacctggggccggggctcaggcctcccacgcaggctgtgctcagtggacacaggaatggattcctgggacactgcggggggtggaggggcgtgatgcagggtccccacgatcagccgcagtctctctaacactgcaggtggtgccaagaggcaggcatgctcccagcacaagggacggtggcgcagaagaatacagagaagctcacaaaacatgccggcatgggctcaggagagctacgggggtagtggtggtactgctccctggtgcagggcagcagctgtgtctccccctgcctccctcccacccgagggccctgctcacctggccccagcttggagatggcatataagagatcatagtttatgactggggtcgcatcttccacttgtttccatcccactggcggagaggcgggaggggagatcagaaactgcttgtctggatttggcggagccaggtgtgagcttcctatgtgtaaggtctgaggagagaaaataagcacaggtcagttgttgccagggaagaactgcagtgaggcaacagcacctaacgccagttccgggagatgggcaggtcaatgtccaggcgtcaggacaggtgtgattccaggaccaattgtaagatggtctgtaatggggagggcaaaaggacatatgaactctggttgtggcacagataggatgacagccccctcccagggctatgggagtcacaggcacagggactgcaaataattacgcttgacctagatggacagaaaatcagcagaggtgactttagtatatatggaaatttaagtcactgtcattgaggtcaggagggctcttggaatcagtctctccccgctcctcataccacagaggcaagctctgaaagtccaaagcctaggccacagttctgagaggacacagcttctcagggacagggagccagggctccacctgcccctagggttccccacccagcagcagctctgcacctccctctccgggactctggatcagatgccagaaaaaaaaaaaaaagccacttcccaggagactttaagaaataagaataaggaacaataacctacgatcctagtttggttttagaaatgctgaccagtgatgagagggctgtccatagagctcttacatctcaagctgcgcggtgtaggttttctctgcacttccagattgccctccccaagttttcacaatgaatatgcattgttttacaaacagaaaaggtcagaggagtactaagtaattatttgcataaaatcttatcccgtgcagaaaggagtgtactcacacaggaaggcctaggcacccaaggtcaaagctcagcctgtgcctcccagggcaaaaaggtcaggggtggggcggggatcccaaatgctttatttatacttgaagggcccagcaagttcgctgtcctcactttgaggaagaaaagacactttggctctctggcgtggtgtcagatgagcttcctcccactgggggaggcctttggacagggtcctctcccatcccagcaaggtatgtgtgtatgtgtgtgtgtggtgggggcgggttgggggggtgctcagagcctgagggggacttgctttactgaggagctggctgcattctagaagctcctctcttcttccctgacaatctgtcagcccctaaggacatcaaatggaactctgggagctgccttgaaggtgggtcacctgtcctaagttccccagaggagggtcaaaatggtagtgggcaggagaaaaggcaagcccaaccccagctacccctctccctgccgtgggtgccctggggctgggaaccctgccaaccagagggtttcttagcatctgcgcccagtctggttatcccctattttcctttcaagccagacctggcagtcctgggctgatttgcaggcatcttctgcagactcctgtttctctgctgagtacccccagcaccacatgagcagggaaccactctggtctgctcagtctagagtgggtcatgagctccaacccttgagcaaattcatggaaacctgctgcgcaaaccttagggtgtttgcatagccacgcctaccccgctgcaccctgcaagctccccagtgaacagggaaggctttctttcccccatcattatcaacccaggaaggtcaggggcaatgtctgaggttgctttcaaatgcaccttgatatcttcttaaaacaagtgagacgctgaacattcagagtaggaattttgtctttctcaaggtgaagtctcagagtttccggtcagcatataacataagcaacgtataagctgctttacaaaagggagggagggaggagggagaagcatgcatagcaatgaacccaactcacctgagcaaaatataacttcatttcctttcccagaaactcagtcttatgcagctggagcctggcatctgctgcggagaaggggttgctgaagtttattctgactcgtttgaagctcttaaaatactgaaaggtgatgtccttgtcatacgtcctaaagagggactcaaatttggcctgaaaaataacaataaaaataaaaggagttgaaatttacctgcatatgacccttgactagatgatgtcattacttttttttttttcttcgagacagagtcttgctctgtcacccaggctggagtgcagtggtgcagttttggctcactgcaacctccacctcccaggttcaagtgattctcctgcctcagcctcccgagtagctggggttacaggtgcctgccagcacacctggctaatttttgtatttttagtagagacggggctttgccatgttggcaaggctggtctcaagctcctgtcctcaggtgatccctcggcctcccaaagtgctgggattacaggcatgagccaccgtgcctggcctcctcaatacattttttactgaggaagtggatcatcaatcctttcaagaactcctaacttctttcttagagaaaagcctttcccctcttaggggactatggcctttagtcccaatgcaggtgattttacaagaaggtaagaaggtatgatttattacattcatcgaatcagcagaacagttgccaatacatagacactacttacggtaacaaacttttttaaaaagtagaatgagcattttccagggaggtacagtttggtaatttgctccccatgtttctctgtcctatggccttcccccactcacccccccttttttctctgtcctatagccttccccggctagccaactccaaccccaccgttcagctcagggcagtgttgcatatatcaaagatttctttaaggcttaaaagaactgcagctaatttgaaaaaaagaaatactgacttgaaaaataacaaagttggtagaaagttttgcatttcttaaaataagtagtttttaaaaatttccacgatcgcttttatctcagtctgttactttttaactctctaaaatgatactggtttaaaaattaatgttctgcaaatggaccattttctgcatcctggctttcgtgtctgtgcacacctcgctctggtgccatagggctagtgagaattaggagatgtcctgagctcttagaatgcaaagctcgaggtgggggattacaagcttaggttgctcaggggacagccccctaggctgggtcctggagtgtggctgtcggtgggggcagctgggggccactgcaactcctcagagagggagtttaactggtggacagtcaaagctccaaggaagactgcatgggcttctagtcgccgggttttgtgaatctttttaccaggcaaaaacacttaggacagtttgtgggagcccgtgtgaaaggcagaaggggctggccaggaagaaggggatggcgcagggtgtggatggtaggcagcgcggacagagctcactgaggaccttggagaacctatggaaggcgcagtgtctctgcagtgggagcgaggattcaggataagagaggagagtgtcttcaggaatgttcactgctagcaagcgcggggaggcactggtggatgcctgctccacatggggctgcgggtaggagcagggtagtcggtccctgccaggcaggtcgttaaggagcagtcggaacaacctacgaccttgctctccttgcattccccggcttttcttcagtttagggacatttctgagactttcccacgagggatcccgcagaggcacgtgcgaaggaacgcggagctggcggacggtagagttcatctggccgcctctcactctttttccccacctctcttgagcacgggcaagtttctggcaaaagtgtgtcttcgtacatttggaattttgtatgacctcatcaataggcactgtgacccactgtttagttttgaagttatgattcagaatttgggagagatgactttgaagaatatttttagaatacaggttcagggcttaggaccagaacaaaagagaattcacattatctttaaaatctagattactatgatgcctttctcttataaaagaatcttatttgttctaataactgatacctagttattatagcttttggatggcatctctacttcatttaaaaaatagtgattttactcacataaggctcatgttaagtgaactcactttgtagtactttaaaaacatagaatgtgctctgcaatctagtccaaacactatggtgcgagcccataagcattatatacaattatggagttacatttgattttttttaaaaaaagaaaccttcgcatgtcccaatatggctttggatataaagcatataacaccaccaggcacaaataccacccctcaaatagagcatacaggattcattcctatacagtattattaaagctcaattagccggatagctgctgatgaaaaaacttacattttaatcaaatgaagaagaaaagtgtagtgattaaaatgattatattaatcaccatcaaagagagctgctgcccaggaggcacactgatctcacacttaatttctccagttttattatttgctctggcggcattttctcttgttagagaaatctgggagcttgaggccaggccctcataattactacaaacatacaaatatctttataacatttatttcctaagacgaaatgaaattattcacaacgctggctacaaaagtaaaacactattcactgtcagaagaggcctctttctgaaaagttcacttacaacatacacagaatgaaaaacacacgatgccccaactctcgccttcctagtgagttggttcaggggcctggatgttgtcaaatattgagatctttagaaattccttcctcagttaattcctcaggcaacagcttttgattttcaaggctcgaaagactttggatttctttcaaaacccccaaacccacaagagagccacattctcccaagtattcagttaatagtcccagttagcataatgctttgaaaactaaagaaaatcacgttatattagaagccttaccctggtttcactttcgctgaagatatcactgtttgccacacaggcaatcagggagctaaaactgtagttaaagtttctaaaatgcatcttgctttcttacagtgaaagcgctacagacccacgcagtcaagcccctagtgagattcctttccaagaggctgtaggttccttcttgagctggtgcttataaagcagtaagggccagcccccactccctggggaaaaaaaaagtgcagcttccacagcatcctgtttggacagcaaattcctgagtcaagtcctgcatgcttgcaggcagacagggacaaagtgtaagtttctactggaaagaggtgacgtcaacaccttagtcattttccctatgctaattaactttgcttggggagaatggaaaaaacagctgaggtttgcttcacagctgctttatcaacctctcttgcagcatagtttccactggtagtaattccattcagctactcagacaacacgctcctcggccgaatgggacgacccttcttaagatggaaaatgttacaaaagaaaaaggatgaaggtctgtggcaataaacagcaattagactgtagggaaatttcaaggctttgggaaacctggaaaccaaagtccgggtgacatacttgatccctggaatttcctgaaaacctcaatcaaagtttcactttggggtattagagaaaacattttgaaatctgtcttggtcaataaaaattttaaaggacaaaaagaggaatcattttgaagtgtagttaaaatttttttccccagtgacattttattggatgaatgtcccaatttctacttgtatcccacagtggaatggagcaaacagaacctaaaacaatcctaggattttcatttgaaaacttcattattataatttgagaactggggatatgaaacacttcgatcattttcaaagcactactgaattcaggcaaaggatacaaaaacactagcctttgaaactgagcaatctagcctttgaaactgagcaaagaagcattaacccatttatgccagaggttgcaattttttgaatttttgccatcagaccttggcaatgaccttgagcaataggatataaataactcccacatgcttagcgttccaataatggaacactaggcataaatgggttaagaggtcctgcttaaagactcataaactaaatgtaaaaaaaaaaaaaaaaaggaaaggaagaagaaatggaaagaatgtacactataattgaaagggaagatgcagggaagatgcctggtttggagaagtgctctgcgatgcaagactgactctagttctttcaaaaggttgcaactcttgaaccttctaagtattttaccagtttagatccctatggcagcctgggtcctatgttcttctcactctctccaattttattatcacctaaaagcactcaagttatttaagcattctctgatttaggggcacacagggacagctctcaagcttccagaagttaaatggaatcctgccattcacatttaaaaattaacttcaaagaatcattaaagtcagccaataatttaaaatacatgcaagaggaagaaacaaagcagggcatttagccttccaaaaaaggaaaagcaaagtccttttggatgagtgagtgttgcttaatttcaacgcactgtgccttgctgccaactgtagagttatgtaagaaaccagttatggtgtttgctttgccaaattatccataactcccaacctgaaaagacataaacgcatgtattccaaaaaagtgtagaatactgaacaatgcaacatgcatcaaacaccaaggggaagtggtcatcctggatgatgcttcgagagggaatgtgtatgcttgcagtcctgcattttcagtacagggagcctttgtctgtccagcaggcacatgaagattgtggtggtgggcaggagaggctaaggggaaacagaggtgaggggagcagacacagtcctgcattccactcctccagaggggcttggaacttctctgatgttccctccccctctccaactctttgtctcccccttttctcttctcctggcatgcacctgggcaaattccattaaaaggtgatcagaagagacagaagaggctaatttagacacaagaggctgatttcactgtcttcttttctcttttaaaatcatgacacaaagttccagctcaattttgtgggcaaatctcaaacatctctgttcatctgagacaacagtgtgggctcacccgaatatacaattttgatttcgttatatggatggaaaaaaaaaaaaagaacggtgaggtatttgaagattattcaactgtctttgctcatagaaatgataaatctttcactagattgcccaaaaacatgtaattctatatctgcctttgaattgatcggttctatctatctgaattgaatttagtaaacttgagcacttccatttttagatcaggagtaagagccggtcaaaatggtggctgccactttgtagggagactggaatgcatgttctctggcaaaaaaatcactggttcacaaattgtaccagagccctggatcagggggagggcacttaggatctgccaccttggttttccttggctaaaatgtgagaggtatggagcagatttgagtttccaaagtgcgtcttgctgagtagcaggaatccttagtggcacttggacactctggttggccaacagggcaaagcacagggtttcctgggacacctgtccctgtacccatagggtaagactgccttatgctcatatcaatgcctcctcatctgcttatctgacaattcttgctaagagagtctgtctttgactgcatgtctattatacgtgaacttgcatttctaaaggtcctatgcaaatgaatttactttataaatagtgattctccccactgagaataaaaacggatccaaagcaagtatttaaaaagctgactttcctacttgtatattccttgtggttttggaggcaagtatattcctgattcttgcttgctggttggatgtcagtgatctgaagaaagcagagcaagacccacagcaagacctctgatatggttgggctgtgtccccaccaaaatctcaacttgaattgtatctcccagaattcccacatattgtgggagggacccagggggaggtaattgaatcatggggggccagtctttcctgtgctattctcgtgatagtgaataagtctcacgagatctgatgggtttatcaggggttttcacttttgctttctcatcattttcccttgctgccgccatgtaagaagtgtctttcacctcccgccgtgattctgaggcctccccagccatgtggaactgtaagtccaattaaacctctttttcttcccagtcttgggtatgtcttgtctttatcagcagtgtgaaaacggactaatatagtctcattagagctcttgagaagcattctaaaacctgcactcaacatgataaaactgaacccagaagttaaagtaaatgaatgttttagtcaactgagagctttagaagttttgcatttcttccactcacaccataaaaatcataaatgagtctttttaacctgcatttgcctcctctggctccaaacagtttccattaggaagtttccattttcagtgaggaaaaattaaggtttatgatgaattccatcattcccattacagcattctgaaagcatcattaggatgacttcagcacatccattatgaactctaaggagttgacaactgcaccaagaatgtgccccctgtgaagctgtctgcaacatgaactgaccaaagacagaaactgagttttgacttccaacactgagcaaaaaatgaggcaacttgcaaaggctctcttgtgaatgaacatgatgacagttacattttatttcagttttttgcttctaagatagtgaaatagtttttttttttttttttttttttttttgagacagttttgctcttgtcgcccaggccggagtgcaatggcgtgatcttggctcactgcaacctctgcctcctgggttcaagcgattctcctgcctcagcctcccaagtagttgggattacaggcgcctgccaccacgcccagctaatttttgtatttttagtagagatggggtttcaccatgttggtcaggctggtctcaaactcctgacctcgtgatccacccgcctcggcctcccaaagtggtaaagtagttttactgttacttcacatgtgtaaccattccctatagaatgtggagcattgttccccagcctaagttactacacaaaaacaaaacaaaacaaaaaacaaccccacaagggtttgctctcttcctcatctttaccactttgtggtctaaaaggcattattaactaaggagaaggttcttattctcaacttttaagagggattaatatcaaattcagagttgtggagaggattcatctagtgatggtggcaaagtgcctagcacaatgcctgaaacacaggtggcggctaaagcacatcagttgcctttctatttccgatttcatcgataaagatattgaggttcagagtggcacacactatgtttaggagagccggaactcactctgggcttttcattgcagattccacgcttgttccaaggaactatgcccgccttgggccaatgccctgtggtactgtagctcatttccccatctctctgggtggtccagggcaccttggatgtcctcctatgtgccctgcaggtccacagaaagtcctgtaggttctctatcccatccttcaccgtgcatagtgctgcaggtaggcagccctcagcaactgtaatatcttcccaactggcctcgcttggcctgtgtcttaccactccaacataatgtgcaagtctgacacataaaaatccctgatgctgaccaagctcggtcacgttcctctcccgctgtataagcttcagtgataagcactgttcctgctgtagcccaggcagactgttcaaggtcgtcttgtgtctttcttgtcacatatcctgccagtgctgctctcacttttatgttcctccaagacaaatggcttatatgcctcaaaacacactcccctcttctcttccccaagtctctgctcgtgctctccctctccctggattattcctcctttctcccctttcctttccttccttaagattgagtgcaggcatgtcgttctccaggaagccaacaatgaccccccgtgttaaaaaaatattattcaatgatgcctgctgaagcccgacaaggcagactttattcaggaccaccacgatgggtatagagaccaccacaaccaggtcttgcagtgggggctgggggcgggggtagattgagctcaactccgaatacagcatggccaagaagcagtgtcagggtcagtggtggaaaattactaagaggaggcatcggggtaaagaggactctggctaagctgacctaataggattcttgctgaagacaggcccgggtgatcagacatcacctgacggatggtagaagatgaagaacccaatcagatattaagggtgggggggttcctgttaaactgactttgcggggttctttgctaaaactgggttttataaggaagtgcacaggtgagcctaggaaaaggttcagaaacctgacccaaatttggccaagcaaaaaatgtttgtcaccccaaacccactcatacccttgtccaaggtttgttaagcactctccaaacttcctacgtctgtctccagcaccgtgctcacttcagtaggtgaccacctatgtgatgacaccctggttctaaacggtgaacctcctgacggcttgagccacatcttattccacttgatagtcctggtgctggtacaaaatagtctctcaaaaatgccagctaaagaaacaaactgatgtctttcttcctgtcactgtcatccactgcttctactttgatcacatagaactaaaaactagttcctctttgacacaagagtcattcatacatttgacgacagatgtcatctcattcacatatccattcatttgatcagcaaatactgaatagccttttacatgatagatatgattgtagatactctagaaaagaatagataaatgaagtgtaaaccctgc

SEQ ID NO: 196 - DNA, 177498 bp, Homo sapiens
ctcttcttcagagaatgcttgtagaactcgttattccaatcacaaggtttgtctctttaaaattacagagtgagatatgtacaaggtatctacttcctaataacagatttgcaattatgccaactgaagcattcagtacagttagagaaaaccatccatattccaagagcagatgtaggaagagtggcttccctcctcagatcagaaacccagaaatgttgtcccacccagaaacatccatctcagagaggccagagcagccatcaggctttaaatcccagccctctgctctgcatccagacagaaatccgaggtttccatcaggtgacaaagaccctctccttaaccaaactgtcaagctcctctgagccctcttcttgactagagcccaaccatggccctataaaaactgcagactctcagcacacatgatttcgcccacctttgcacactaagagacataaacgctagcataggttctaagagctgaaagctaaagcgcctgcccgagaaaagtgaatgcggcctgaagaatttactaattgttccaaccaaaacctggtgacaggcagatagtcccctgatccctctcttaaggcagttactttagaaagtttgcaattataaatcctttctctctcccttgagatgtatatcttctaccattcagaactgtattgtctctctgaaatgcaaacattcaaactctccttgctggatgggtgccttgctctaacttactgctccccatcacagacagaagtttgtttctactctagataggagccaattaacaaacccagatcacactgaccaaccccttcccactttctatgcatttccacttcctggactctgctcaagccccatccccactcagttacctttgcacaaagggaagttgagctgggcctcttccctctggcaatagctaatgatttcagtcaatccttactgctttaactggctttctttacctttgacacaggtaaacacatggagagcaaaatcgaggtttttctggccgggtgcagtagctcatgcctgtaatcccagcactttgggaggccaaggtgggaggatcacttgagctcaggagtttgagaccagcctggccaacatgatgaaaccccatctctactaaaaatacaaaaattagctgggtgtggtggtgggtgcctgtaatcccagctacttgggaggctgaggcaggagaattgcttgaacctgggaggcagaggttgcagtgaaccgagattgcatcactgcactctagccttggcgactgagtgagactccatctcaaaaaaaaaaaaaaaaaaaatcgaggttttcctaattaagtacattttattatcatcactgaaagtacaggtggtaacatagagggttatcagccaacttcacttttggggaatgggagaaatgctgactctctccaagcatgttgggtgtctagtggttgaagccatttgccaagattgtcaccctaggatccactcccaccaaacctgggcttttcactttcaacccagcaactgaaaatgccagttcaaacaacttgctgtttttttctaccccacttgcttttagagttccttctgcctgttttattggctccatataacctgaataccacttatttcttaaagcatagctcagatgctattttaaaaggagcccaggatagtggctgatttgatagaatctatacccagattacccagggtcaagtcccagctctggtacctgcggcctttaaaaccacgaaaaaattactttaatctctgtgtctccatttcctcatttgtgaaatggttatcattatagcacgtcccttacagccttgttatgagacttaggcaatagccactagtgcttagaacaaagctatttttgtaactttctccaggaacacttcccttaacagaaccaacccctccacccctcagtttgttcttccctccacaccctctaacattctaacataaccacaaagagtcctgatgggatttggagttacactgcctgggttcgaatctcaattccgccactgccattcgcgcgttttctattgccagccaccttactctcccctggcctcagtttcctcatccttagaaggggagcagagcacatggtggtaactccctgcacattcctctctttccttgtattgggtgcccagtttgtgccctcacatggcgctagcactgagtgggctcaaactctgtacgcgtttactaagcatattgactgaagaaatctggaaacctagtaccgcggcaccatatcgttaccccaaaggaaaatgcatgcacgctgtcagagatgacgaacactgcgtctggaaacttcttaagggcacccacgtgtcctcagctgcagacagcagcgaggagacacccagggaattcgagacagcggaaggcggaagggtcccgcaacaacccaccctccagctcaggtgagttcagagtgagaacgcaccgccaggcttggacaaaggcacccggcctacaccccagcggctccccgccggggcctacgtggacttcagcctccagccacagggacaagagctgctggccagggctgcccgcctgggctcactgcgcctgcgcagtgagcagcgcgccccaggtcttctgcccgggcccactgcgcctgcgcacggagtagtgcactctcgtcggcggcaccggcccactgcgcctgagcacgtagcggtgcatttcgggacctgtagttttccccggcaggacggtagaagtcgtggtttgtgcgcggccaggcgctggagcctccgctgccgggagcagtaagtgtgtgacgtcggggtagaagggagtgacccaaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatggtgggggaagcgatgacagcccctggtcctcatccgcagctctgggggaagtcggggggtggggagggcgggtgttgctccctgagtgttgggggaagggtatggggagaggaccctgaactagcccccaggttacccaggaggagctgaggcccagagaggttcagcgactcgcccagggttgcacagcgagcacaggcaccgacgtcgccctccgaggcctgggcttccagcagggagagacccggacacctgtcatcgcttctcggtggatccctgaaatgttgagttgtggagtctgggcagctgagatcgggcagggctggtttcttgtaggcccaggcttccgtgtagagggccaagtgatgcccaaggttcacctggcagccccctctctggacctacccctccttatgattgggtgaagggttgggtgaaaagggtagaggccgggaatgagaacagcttcagaaagctcagacaaagggcgcagcatgattcgtggctggaaggagacagcaagcgatagactgatccttgaatttgttagtgtgccaagaagaaaaagtattaatagattgtggacgacacattatccatattgctttagttggtctaaccaaaataagcgaatagcttttttgtttctaagagaaacctgacaaaggaagacagggtatttttgcggtgaaggaaatagaaatatttggagttgtatctaagccacttgttacttttgtgttttaagctaagatcatggataggtccagggaaagttaaaaatttcccgcacttcttagattttatgcccctcaaaaacatccccaccttgttggcttttgcagttcaaccttcagataccagctccctcgtttctaatattgcattaggtgtacatatggcagcagagcaaatagcttactgatacttttagcttttttcttctcatttgcaaaagactctatgaaaatggctggcttgggcatgtaattgaagggaggtggggaaaagtggtaattcagaggcagtgggtgggaatgagcaaagcatgtcagtgtggttcaccctcttgactcccacctcaccacagcccttctgctacaattgcagattgactctaaatatgtttctttcctaaagagcttgaattttatcactccaggtatgaagttgaggcagctgccagtatattttggcagtcaggttctgtgatatcagagaggatggtgaattgtgaattccagagttgcagaattgttctttagattctgattttttaaatgacagcactttggtttggagggttaatgacttaccccaggtcatatgccacaccatgggtaacaccaagagtagagctcagatctccagttgtcctggtcctcaggctactgatctttattccctgccctgctatcttggaatgactgcattttgccctggatgtcgctagcctgtatccttcaggttggcatgtccagtcatggaaggagagagatttaacataacaacaatggctgacattcagtgctttctgtgtgctggccatggtgcttagtgtttacagtctaatctgcaagagaatttacagatgggcaagttgaggctgagagaggccaagtaacttgtccaaggtcacactgctagtgaacatagcacatgttttccagagggccagaccactggatgttttttcattcatttcctcctgtaggatcgttggacctatttctcgttcttgactttgggaatcaatattctacgtacatcaattcactgggtatgcagttttgcctctgaaaattttgagggaacagccagactcatctactgtatttgtatacaactcaattaaagcaggaattgtaaaaataaaatttgtaagatctttaacattttaatatacaacattagctaatcactaagattactagagatactcaaagtgaaaattgtagcaacaggttataacatgttaggagcatatttctttagggcagtcagaatctgctgcttcttaaagacaagtgggccatttacacatgaaggtaacaagcacattcagccaccatcattatagttaaacagatctatgatttaaattcctatcgctaccttatctgactttgaaaaagtcatggggaaaacttggctaccttgtgccaactgctagcttgttttcaagatattataatcttgaatagatggaggatgaactttttatacttagatagctttgtaattgaaagtttgtataaaaacatcttgcctgaagttcatcttatccccattctatctaaaggcctttgaaattttcagccacttttcttaattatgacggtaagtacatttcaagagaagtgtttccctgacttttgaatgcaaagctctctgcctgtgtcaggatggtgccgaggttaaagccctggagccagactggatgggttcgaatcccaggcccacctgcgagaccctcgatgtgttacttaaattttatttcctcctctctaaagtggaggcagtaagctgttttatggggtagttgtgagggctaaatgtcttaactcatctaagcactttagccacttttttccatctgacacaaaaaagttaagctatgattattgtgctataaagcattggatttcagaagaagtaggggcactaaacaccatctgcttgacacctttcttcacttacagatgggactgaagctctagagggaagtcacttaccagagggtgtaggttcttcatccagagctgaagtcttcttgggggtatgtgtcatattctaagagtagggacctacaaggccttggagcgaatcccaaggctcgggctgccagccctgccttctcatttccatatgccatggtgtggcatatgacctggggtaatatcctctgaaccaaagtgctgtcatttaaaaaatcagaatctaaagaacaattctgcaactctggaattcacaattcaccatcctctctgatatcacttccttccctaccttctactaggtctccctcaagctttagagaaaattctgcctctgaattattgcatctgacaatttttctgccctgtcacttattcccttgctcccagataatcttcgaaaaaccaagatgagtttaattaacactcagaggacttgacaaagacactcactcccaaaccagcttgcgtttaggtctggaggcaggtggagggacagattttagacttgggcccttaggttcacagatgaatgggatgggagcccatgtcccctcagaagcggcgctgtgctgctggcggctacagacagctggtgaggagagctttctgcttagcaagggccaggcccgtctgggccctcgcccagcccatccacttcccaccagtctctcaatcgccttgtcaggacacagcccacctctctgtggagctcactttctgttcacattccctctctccatcaaagagacatctttctaaggtggtctgccctaggaactccaaattgacctgcttctttcttcctgcccagatcagaccttccagctgcctctcatgtacttgtctgttgggggcttgtgttgatcaggagtgaattcacagtctaccatgaattggaaggtgagtatcgttttaaatatttatggcttggggttttttcttcctcctgattgtgaaaattcagaataacagttctacaccagtagcttgattaaaaagaaaaagtaggtgaaagcataatatttatgtttcattttaagttaaaacataaatgtacatttattcgctggacttctggaagaaggccaggccttttcttcgagtgtgcattcactaacttcaaatcttcctcacttttcttacaaaaactatacctttaaagctttacctgcaattttgcattgtgctttctttttttacacattttttttgtagagatagggctccactatgttgcccaggctggtcttgaactcctgggctcaagcagtcctcctgcctgagcctcccaaagtgtcgggattacaagaatgaaccactgtgctcaggccgttttggttcctttaaagtagatgcagtggactgaatgtttgtgtttccccaagttcatatgttgcaaccgtagtgcccagtgtgatgatatttggagttggagcttgtaagaggtaattaggtgatgaggctggagccctaatgtttggaatagtgagcttattaaaagggctccagggagctctcttaccctctttctgccatgttgggggtacaacaagaagccagccgtcagcagcctggaagaggactccgctagaacccccctgtactgcgccctgatcctcagctttcagcctttcgaactgtgacaagtacctctttaataagtcacccagtctgtggtcctttgttctaggagctgaattgactaagacagtggattaagatcttatgagcagtgcatacacaaaatctttccagtgtttcatactctttcctaatcttttacagttgacttgccaacagcattttttttccaacgcaaacttgagtctttcaaagtattcaacttagttttcataaaaacttttgctttacacagtcatatttcacaagcgtaatgtttaaataagttatggaacatagtatcaagtacaacttaaataaactgcttggcgagtaaacacacctgacccctgtgaaacattagattcagctggtgggagcagaagttcaagggcagccagagagtaggtcagcaatcaggttccaccgagggaaaggagaatgtcatcttaagtcccggaagtcaataaggtgaggtggaggttgtttaagagagcagccactaaaatatattatagtcactttgcaaagtctaatatcaagcaaaaatcatacattgtctcaccatctagaaatggctactattaacaatctcggtatattcatctttttctgtatatatgtgtggcgtgttttcatgcataggatcttattttacgtgttttttcaattattataagcattttcttcaaaacatccagtggttttctattgcaaggagaaactggaaaggtctggaagcaggatcagggagccaggaaggtagctttcccatcttccccagctgtgtggggtgaggggctcggcaggccctgcaggagggctgagggcccaggaacttgtgtaagttaaagatggcagagtgagtgagctgtgaagggtgggaagatatagaacagtttgtttagcatgccttgaggatcagagctcacagtggaaaggttgggaaggaaagaagaggcagtgagaggatggagaggggaaggagcggaaagcagtgtggggtgaggtttagggaggtcattcgcccactgcagtggctaagtcagtagaggagagaggcagtaactggtactaagggccagggttcaaagcattaaacctcatgcctcaaggtggtgtttctcactcctgagcactagttaaggcaaggatttcgagccccactcccagagtttctgattgggtagatctggctggggcctgagaatttgcacttcttataagttccaggcggtgctggtgcacactggtcgaaggcaatgcgtgggaagttttcctctttaattgtagagtgacaccaacccatgtgaccactcgggccagtcttgcttgtgacagttttttctgccatcaggaacaaagtctgcccaaaccttcccagcttctgcaccagggaagtggctaccagggagcagcttcgtgtttaaacacagccccatctcgtgtagtgttagaaaggaatggccgcaggccgggcgtggtggctcatgcctgtaatcccagcactttgggaggccgaggcaggcagatcactttgagctcaggagtttgagaccagcctggacaatgtggcgaaaccccgtctctacaaaaaaatacaaagattagctgggcatggagatgcgtacgtgtagtcccagctactcgggaagctgaggctggagaattgcttgagcctgggaagtggaggttgcagtgagccgagatcatgcccctgcactccagcctgggcgacagagtgagaccctgtctcaaaagaaaaaaaaaagaaagacagtcatggccctgattgcagagagctgcagaaggtggaaggttcagtagcccccagtgcgtctggtggccttccccctctggctcagtgggccatggccggcagcgacagtcaacagtgctacctgtgcgttagcaacaagtatggcctcattatttaaaaacttagttattcccatttcacagatattggggttttgtttttaaaaattgatgtagatctaggccaggcatggtggctcacccctgtaatcctagcactttgggaggctgaggtgggcagatcacatgaacccaggagttcagcaccagcctgggcaacatagtgggaccccagctctacaaaaaatcagaaaaaattagctgggcgtggtgtcatgtgtctgtagtcccgtctactcgggaggctgaggtgggaggattgcttgagcctgggaggtcagggctgtgggaagccgtgatcatgccactgtactccagcctagttggagtctcaaaaaaatattcatatagatccagtccaccctggcagcattcattttcctccctgaaggtctgtatgtttcaagagatgtaaggggtttgttaaaaggaaattggaggaaggggttcataccactgaaggttagtgcctaagagaggggcaggaagggggccctggagctcttcgctttaccctgtgaatgttcttgacctctgctgcccttgtgctgcgtccttctcagtccacacttctgcctcttgccgtgcgtctccactgcctgtaaaacaaagtgaacactgaagcctcccactagggtccattggctgatgcgtttccatttccatgggttttctaacttctggatgagagagtacattcctgcaattgctaaagctaagtttcctatctggattgtagacagctatgggcagtaacatgggctttgttatattagtaatagggccccggccaggtgcagtggctcacacctgtaatcctagcactttgggaggccgaggtgggcggatcacgaggtcgggagttggagaccagccggccaacatggtgaaaccctgtctctactaaaaatacaaaaaattagctgggcatgatgccgcatgcctgtaatcccagctacttgggaggctgaggcaggagaattgcttgaacccaggaggtggaggttgcagtgagctgagatggtgccattgcactccagcctgggtgacagagcaagactctgtctcgagaaaaataataataataatagggccccataggtttattcagagagactgagaaagctggaagagattagcttttcccagtgtgagtcattgcctcaggtagcctggaaaatcctagcaaacaaaaagaagtttatacaacaacattcttttcatagctggtttgtatgcatggcgtcaaaccttcacctctaaaatgtgaaccttcaagaaaacaggatttcagggtttactggagggaggggattagcctaggtctgagggaagaagaacctggaaatgaagtcagtgtttaaagctccttatatttaccagagtaaaaagttgaaaagtttcacttttggaactttttagtcttttgtactgatgccagagtgatctttctgaagtgtatgtgttgtgcttattctttactgttaaaacgatatcatggttgaaaactattagctaattactgagtgttcttgtgttcttactgttttagtaaaattaaaacgatttaagtatttgcgtccctgcctcctcccatgattttcattgtatttctatcatatcatgctatatccttctgcaaatatccatacataaccagttaaatgatttcagaggtagcgagtctagttgcctctggaaaattcagtagccaagccatagtgtatttgcatattgtaaatgtgaagtggatgggtgtgaggaatgaatcatatatagtacaggacagcgtgatgctacagagttgggctttggagcatttggagctgggtcagccctgcctcgctgactgctggcctccccgcctctgcattttctcggctccaccgcagtcagggcgagccatctgctcatggaggtggctaagggcagaagggaaagccgcataaggcactttgcatgccgtgagttcccagtctacagcagctgatgctacagcttctaagcgtgaaatccacatctagttctgagtcataaagagtttcgatacaatcataggaacattcatctacatacactgtgatttcatgaatttcagtttgttgaaaatcaggcatcagtggaagggagactggccccggggttagaatgtccttccaactggctcctcatgagggagctgtgggaccttcaacctctcaacctccaggagctcttctttccttgctcatataaccagggggttgagtaggtccccttgaaagttatttccagccccccggttctgtgagcatattgtacacactaactaggttcagatcaacttcggttagactattagagggaggtgcacatgtatcccccacagtggaatctcattggtatttcatataataagtgattgacagaaataaggatttcattgggataaaatcctacctggtcctctaaaataatgattgctcaaccagagcataccttttcactatttgggagggaatttttaatcacacaaaaagcacatacatatcattcaggtcatgctaaccatgtgtatggaactaatattgctttgaagtactatttgcaatatatagaatttcacacaaaaaacctactagtgcaaagagtgagtaattcaaatgcatagtgtttccctagactttattttagtgaatggggttgcaagagcagttagtaagtagccatgttttaatgttttgagttctgtcgtgttttattttaccagcaagtgccagtgctagtgagtctctagaaacaagagaaaatcccagagtactaaagctgcagtttccagaagcaaggtctgattcacccttactttgtagatgaaggggcaggagctcagaaagaaaggagctcattgcctgacccaggtcacacggtcagtcggtggtaaagtagagctctgacccaggcctccgggctccagctcctttcactggatctggctgctgcctcagaagcaagggcctgggtgatcagcaggttgcacggttgagctgtgagagaccagagtccccacgcctgtggatgaccggtggtcccctccatgaagccagccgcaagcaagcagcaaagagcagagctgtaacttgactgttggccccatggggatagagaccttttctgcttggtctccagtgtagctccagccccctatcctcgtgcctgttgcagaataggtgctaagtaaatatttgttgactgaaggatcataaaagaaacctcccatatcggtgatggaacatttagttagcatggcttctttcttcttgaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtgagtccacagtacccaaccttgcaaatgggagctggccagtgggttggggtgaccaatcaatgaacaagagaggtctgagacctccctgtccgtcgggtctgaagggctgcgtgggggcatgtggcctcacctgttctctaaggtagaactgctccataaagggccaggtgtgcagatcctggtcctgggatgtgagtgctgctgagccaaggtgcacggagcattagttcatccttcttgaaacctgcggtggcaatggttcttgacaggtattgggttaagaattgaggactcagtgacagctgtggaccttcttcccagagaagcacacatactgaaaccatctgcatttgtgtgtggggagaagtttgcagatgtggggagtcacaggtcatttgaaattccaagattaagaaaccctgttacctttaagataaagtctgactccatggtatgacaaataaatcccttcccagtctggtcttaacccagacctcatttgccacatgtgcccactccccatccccctgcaggccattcctcagccaccatggcctttggccttgcttattaggttcttcccaaggacctcctcaccaggcctgagggtacactcatcgttgtcacccagtgcctatcacagtgcacactggtgggcttagaacacacttggggagttacaatacatcaaggcaccagaaagttcctgttaagcccctgttacagatttaacacatgacaattcacagttaccttgattccagtgtgttgatgcagtttcttcactttgcaggttgagttctgtactttaaaaatcaggggattcagccaggtgtggtgactcatgcctgtaatcccagtgctttgggaggcaaaggtgggaggatcacttgagccaatgagttcaagaccagcctgggcaacatagtgaaaccctgtctctacaaaaattaaaaaaaaaaaacaaaaaaaaccaaaaaaaaaaaccaaaaaaaaacttagctgcacacttactgggtgtgtagtcccaactactcaggagactgaggtggaggattgcttgaggcccagaagttcaaggctgcagtgaggcatgatcacaccactgcactccagcctgagtgacagagcgagaccctgtctaaaaaaaaaaaaggattcaaatatggtggcggtggggttctagatctgtggttcccaaacctagctaatgatcagaattgcccaggtgtttgtttaaatgaagattcccagcttcagcccagagagattccataatggctctggttaggtttgggtgttggtttttgttgttgtttttaagataggggatcctactctgtcatctaggctagagcggtgcagtggcacaatctcggctcactgcagcctcagcctcctgggctcaagcagtcctcccaactcagcctcccgagtaggtaggactacaggagcacgccaccacacccggctaggtttttaaaacaatttttagtagagaaggggtcttgctgtgttgcccaggctggtcttgtactcctgggctcaagcgatactttcgcctcagcctcctgaagtgctgaggttacaggtgtgagccactgtgcccagcctctgttcttttgaaaacccattagataatccttaggttgtcttctcagcaacaggtcattgtaggaaccactgggctaggtggcctcccaaacccagcccactctgagattccatgctgaattcccttgcagtgccgtcaggcttgttgaggctaaagacctactgatgaggaatagtagcaacacctactaagtggttattctgtgctggggactttgctaagcattcatgcacaactgtgttattcagccctgatgactctgtgaggcatgttcagattgaaagaatggctctctctacatggtgaagaacagagtcagaaattgatcccaggtcaaatgcattcgatcagcatggccaagcccaagctgtgctaccttcctgaatacaggcaagtgagctcgtagggatgcttcactctgttactcaccacttccggcagctgcccactcgctggtccccagtgaactgtaggcttttgctagatagaagaagttactttctttctttctttctttctttctttttttttttttttttaaggtgtttgattgactgaaatttaggagtaggcattacgatggggaggagagaaattaaaaagggtgagggaaggcagtttaaattaaaatgttgctgattgaatttatattcctgacaatcccattttgtgtgctaaactgatcaaaggaagaaaagatgagatggaagatcataaaggctttgttcctcccacaaacatcagcagagacctgcatttaagtcaggcctggatggcttagaagcaactcagggagttggtcttcctctctaggctggcagcttcttaaagactagagacttgcttcaaacaaaaagcgttttcaggccgggcgcggtggctcacgcctgtaatcccagcactttgggaggccgaggcgggtggatcacttgaggtcaggagttcaaggccagcctggccaacatggcgaaaccccatctctactaaaaatacaaaacttagctgggcgtggtggcacgtgccagtaatcccagttacttgggaggccgaggcacgagaatcacttgaacctgggaaacagaggttgcagtgagctgagattgtgccactgcactccaggctgggtgacagagtgagactgtttcaaaaaataaataaataaataaaaggggggtggggtgtttcagatggaagggaaactgatgctaaaaatacattggttaataaatagacttgagtgatagacttgagtggtgtccgcttgttaagtttaaatggctgagcatacgtctttatgctgagcagtaaacatcgggtatactcttatcaaacatttcctactcatccctttggtattcccttctagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaaggagtcgtggcctttggaataagtcaaattgtgtatctctttctctttctcttacacagcaccctctaccccgtgttgtaaagcggggggttttgtaaacttacacctcccccaccatctcaagctggggggtcccaggtgagaggcttccatagaggacaaggtggtgcagaaacatctgctgtgggagtggggtccccagcactgggtgcttcggccagctacccccgaccccaggccccctcataggctgccctcccataccctcctttctcgtcttttcctcctacaggtgctacacccctgtgagagtgttttggagtgttttcattgttagggtggagggaggctgtgtgtgtccaggaaaggtgactcctgtgttaaccatgagggtcctcgcagggaggaatcgttgggagccctagggtgtgttttgtcctctcctcacctgtttgctccttgggatttgctgatgagaaatgaagggtagggcaccctagtagccactggaaccaagggcagggaggatgggaagatgttttactcagcacctaacacacgcagatccctgtgacaagagctcatgctctcccacttcttcgcaagaccccagagtggatggggagtgaggtggcagcagctggcactggaagcagtgcggagtgtttggtctggttgctgatggctgcatgggaaacttgcaggagtgtgtgttagtaaacgtctccccgtcctggcccagtttgtgtcgaacatgcgttttccatgtggggagtcaggggagttccatcttaaattgcactgtgcttgctggatgctcttcaggacaatttaggaagcaggaaagaatttacaaagttctgaggacagacagaccctgctcctacaagctgcagtgctcaccatagtcaaagtggactttcacgtaagcccagacctcattctctctgaaggaggccgctccagcctttgccaggagccctggtgactttattctgcctaatcctgctgcggcctggggtcctgttagaacgtgaatggaagaccacagcagaggtgggatgcccttggatttctgccatccccacgctttcgtgacatgctcagatggggcctagaactgaccctgggccgtggcctaccatcctccctttgtcagggcctccttgcaccctggcaggttaccccacccaccctggcccatgttcctgccccaggggcctggcctctctgctgcccaccctgcaggtgtagggtatcacctgctcctgccttgcctggcatcagacctgctaccttggcaccacttcctccctcatgcccacccgcctgtgtgcctcataagtccaaggcgggggatctgctgaccagtagacactcatgtgctaaacacaagcgcttttctaggctttgggatttaaagctacactttggaatttgtggaagatctggccatcttggaaaattaggtagaaggtgacataaggactggactaaaccactgatcatcccaacagtgcccgtggcttttctgttttttgtttttgcttttgtttttttagagatgaggacgtgctgtgtccctcaggttggagtgcaatggtacaatcatagcttattgcagccttgaactcctgggctcaagcgatcttcccacctcagcctcccgagtagctgggactaggccctgctaatttatttatcttttgtttagagacaagggtcacgctgtactgcccaggctgggtgtaggttttttctgaagagcatttgggagttttgtttttgcttggttacttttcctatgcacccttctaccactagggggagatgattaatcactaattgaagggattttgttcgttttttatgttttgggtttttttgtttgtttgtttgtttgtttcaataaagaaagagtttaattgcagtaaggcaggccgcgcaggagatggcgttcttattcaaatcggtctctctgaaggctcagaggttaggggttttcaaggcggagttcttgctatcattccactccttaggtacatgaagttggtagatgtgtagtttgatgttaaattattgggtggatgcatgcaccgctggttgtagagactggtaaagcccactagcaggaccccacctggaccaaagcaatccctcaacccgctggaccatgaccgagaacaaacacaaaggacctgaaatgcgttgtgaaggccagaagccgacatccacattctccacccacggagagccccagagtccctcatgcacatcctgcttgatctattacacacattcacacattcgcaacacatttgtttggttttcaagcttacaacatattagaaacagaaaggaagaaaggctgtcagcagcagaaatacctttgagcaagagggacggtctttgagaagcagacttgagaactcaccgtgtgctcttcatgcgccagacactgcggcagccacagcgtcccacatgggatgccacacgtgatgatgttatgttcatggtgatgacctcaggcgtgaagaagaggttcagccgtttcacacagtctgtttaacaagcacatacataacacagacatacgtgaggaatctcagaaaccaaataattcaaacaaagagtctgggattctttcaaaagcgttgcctctgcccaagctttcttcaaattctgtctatagggaaacgtagctgtcaatgtctcattcccgaagacttccagatgcctggatctttagagttctccacctcaccccgagttgattacacaaatgttcctggggctttgcttagtgccctgctctgtgccaggccccacaggcagagatggcagggacccaggcctgacgttggagagctcctgacccactgccggaaacacacgcaccatcacaccatgagggagctcccccatgcagatctcatctgtgtcagagtgaagccagaggatggacggtggagagtctagaaggagaagagaaaggaggatgagttctcatacatgagcaagcaggagaggccatttaaaatgcacactctggcctggtgcagtggctcatgcctgtaatcctagtggaggccgagacaggaggatcacctgaggtcaggagtttgagaccagcctggccaacatggtgaaaccctgtctctactaaaagaaaaccaaaaattagctgggcgtggtggtgcatgcctgtaatcccagctcctccggaggctgaggcaggagaattgcttgaacccgggaggtggaggttgcagtgagcagacatcgcaccactgcactccagcctgggtaaaagagtgagactctgtgtcaaaaaaaaaaaaaaaaccaacctaaaaaataaaaataaaaataaaatgcagactcctgggctggattccaggtccactgcatcagaacctgcaggagaaggaccaggaatttgtgatacgaacatccccaggcaattcttgaccctccttttgagacctacactgtagaagatgggcagagggagaggcagcaggagcccaacctgggaaggagccatcgggaaaggtgggaggaggggcaggagacagcgcacgcgaggcagcaaatccttcagcccttactccccaagagctcacagctgcctccacagagggtaacggtatcattatccccttttcgcagataaggaaactgaggcagagaggccctgcctaaggtcccccagctggtgggaggcagagacaggaaccagccctcatggtctcactgtgagactggacttttcacagctgtgcggtcgagtctgagccaagtaaagtaaagcgagtttttgtacttcgaagtctgggacataaaatcttcaagacgtcagcatcagtgacacgatggtgacagaggccagcattgcttgttgtatctttttccatcctgttcctatctacacttccattcttctgttcattctgcttgcatttcccacccagatggctttcacggacacacacacacacacacacaccgcacacacacacatcactcacagacgcaccctgtgcccaatgtcaaaagacaaaactgcaacacgtttagtcatagacctcattgtcttttattcttgattcatgaatggggcagcctcccttctataaaacagagcaagagctcccaccggacaattgcagaacagtgggctttgtaaggtggggacaaggaaacagaacaatagaaaagaagctgatgggttaacatcaggttacttcaggacctcctaatcacgctgactcaggtagaccagaagctcctgttttcaggaaaaactaatctgtttggggacatacctgcttccttattaaagttttgggttgattatatggctcttagcatgactgactccattttggtttggtttgatctggtctgttggggcctagtgcaggatctcagtccaaaacaatagcctcccataatttttgtttaatgctgggtcagcggtaggcttggtccacttgcgcttctgcctgggtgggccttcctcttttcctccttttctctctgtggtgaaatccccattcttctttctgtcctccacttcagtttcacctcttcctgcaaccctgcccacagctcttcagcgccaggccctggactcagctctcactacgcaaacctccaacatctcactgagtgggaggtggcccccacctccacaccagacctggaccttgagggtccaggcttgttttccttggtactcctggccctgacgcacccagccaggcacacagaaggtgctccagtatttgatgagtgaatgactggtagcaccagaggaaagggagcagggagtatggccaagaccattagctgccttcctcagtgttccttctccccttctccctagtaatagaaccctgacttttacctggccgtatggtcactcaaaataaaggactacatttcccaccttctctcgcaaccaagcctggccaatcaggtttaagtggaagtgtagtgtgggacttcctggaaggatctttaaaagggacaggatgggcccctcttcctccctttctcctttttggctgcctggaatactaatgcaatcgcttgttccgcagccactttggactaagaggtgagtttgagacctgaaccaaatctaggacaatggagtaaaaagataggatcttgggctctcagtgaccatggatccatcatttcacccctgaactgacaccttgacacttcttatttttggtggtggtggtggggtagcttctattttgttggcatctctgtggtctattcatagttcacctgttttagctgacacatggagccagttagagatgggcgcaagggcttcctgatatgaagacttggattctggtcctgaccctcctgttactactgttacgtacgtggctaggtgagtcggtcaccaccctagcctggcctttgtaaaatgagctcaatgatcactgccctccctactgtacagtgtttgtctgaactgaatgaggtcaagcatgtaaagatggtttgcatgtggcaggacaatcacaaatggaaggagtgtatactacctcggtgggcaactcagccaccagttggccaggcaggggctccatccaacccaattggattgagccaatggccaacgaaccccatttgctaatttacctcttaggtccttgtaggggcagcaccatttcctaatgcacccccaccttgaaagccaccttgatccgtgggagggagaggggctgtgggtattagtgatggggaaggccagagaggctgggatgttccatcagccaaccactcagaaggagaatagtgccaccaacatcaggagctcacttctagtggacatgtctagagatatgtggctcagccctgcgttgctgcgtgtggtcacccgctcttaactaaatacagtgctctaaatatggctgctcccaaagagactgtgggctgtcctcaccagccatcctgtcccacccccaccagaagaaacctcttcttattattaattccctaaccgattgcagatattgcagatggtcttaaaggaaatgccagagaacaaagtttcctctgatcaaagtatcttaagatgtgtccaccctcattagatgccagcgataaaaaggaacaaaaatttttctcaaagagtgaaaaggaaatgagatcagtgatggcaggtctaattgtggacatgtttgcttcgaccttaccatggaccactcactcagtgggtgccagacacaatgcagtggcttggcgcaggttatgtgattttttttttttttttgagatggagtcttgccctgtcacccagtctggagtgcagtggcatgatctcggctcactgcaacctccgcctcccaggttcaagcgattcttctgcctcagcctcctgagtagctgggattacaggcatgtgccaccatgccaggctaatttttgtatttttagtagagatgggtttttgccatgttggccaggctggtctcgaactcccaacctcaaatgatccgcccaccttggcctcctaaagtgttgggattacaggcatgagccactgctcctggccaggttatgtgattttaaagtcccactgtattttattaaggagttgattgagcctcaaggaagtaaagcaacttatccagaacatatagctacgaagctagaaactcaagattccaactaggtccatccaattccaaaagcccggtgaactttctgttactttctatgggaagttttcaggtttagtataaagcaacatttcttaattatgaatacaatcttatgtaaccaaattgcacattaaagggtattccttttgatccttctttcctcttttctaataatttttacaaggcctcaaaggaatagaactctaaatctgttttattaaattgctttagttttcaaacaaaaatagctcctgttggtttatctttagctgataacctaaaaacattccttttttatcgctgtaaaataatgtgtctttaaaggatattctgtctcctctttaattttatgttgaaataaaattttttggtgtccaggggagttggccattttagcggctggtgtctcatctgaggtcagaggtgagtcttgcgacatagaaatgatgggggtgaaaaaggaaaagctcagcttcaataactaagctaagcacggtggtgaggagcatgggcttcagaatctcttggccccagtgccttgccagtgcctcagtttcctcatctgtaaaacaactgacaggattaagagaattaaattataatagctatgcgttagtggcatcatgaagaatggctctaagcatgaattctgggttgaatctctctgggcctcagttttccacatttatttatttatttatttatttatttatttattttgagagggagtcttgctctgtcacccaggctggagtgcagtggcacaatctcggctcactgcaacctccacctccaggattccagtgattctgctgcctcagccccctgagtagctgagattacaagtgcccgccatcacacctgtctaattttcgtattttagtagagatggggtttcaccatgttggttgggctggtctcgaaccccttacctcaaatgatccgcccacctcggccccccaaagttctgggattacaggagtgagccacggtgcccagcacgtgtagctgttggtgcctattattccagaaccgcagaggcatggaataaacgggatgtagggcaaaacccactcatctcccaaaactcaggccacccacacgtgggcctgcacaatgacagcacactgaagtgaccaaggaagtttgagtaccatggtttgctctcaaggaacttaaatcctaaaacgtacatgaaatcctgagggaaaaagacctcacaaatatactacacaataggagttatttcaccaggttaattgccaatgagaaatgcaatgtttctattggcagagcaagacttcctttagcacctgtggctggctgaatagtggccaccaaagatatcaaggtcctattccctggaacctatgaatgtcgctttagatggaaaaagttctgcctatgtgaccaagttaaggattttgagatgtgaagatggttttagattactcaggtgggccctgaatgcaatctcaggtgtccttgtaagagggaggcagagggagatttgacacaggatgagaaagtggtgtggccacaagcccaggaatgccggtggccaccagaagctggaagaggcaagaaacaggtcctccctggagcctctggagagagtgctgccctgccaacagcttgcctttggctgtcttctctgtcctgtcctgtcctatcctttttcttttctttctctctctttttttttgtttttttggagatggagtcttgctctgttgcccgggcaggaatgtgatggtgtgatctcggttcactacaacctctgcctcccaggttcaagtgattctccttcctcagccacccaagaggtggaattacaggcgcccaccaccatgcccagcaaatttttgtatttttagtagagatggagtttcaccatgttggccaggctggtctccaactcctgacctcaagtgctcctccgacctcaggctcccaaagtgctgggattacaggcatgagccactgagccaccgtgcctggcctctttcccttcccgtcccccttcctctttcccttccctttccctcccctgcccccttccccccgccccctccctctcccctgccccctccccctccctctcccctctcctccctcccctctttccttcctccctcccttccctccctcccttccttccttctctctttctttcttctttctttctctctctctctcccctccctctcctccttagcccccctcctttctcccttctctctctttctttttgagacagggtctcactctatcacccaggctggcatgcagtggtgcgatcagagctcactgtagcctcaagctcctaggctcaagcggtcctcctgcctcagcctcccgagtagctgcaaccacagccactacatctggcttaatttctgttgttttaagccaccaagcctgtggtaatttgtttcaacagccacaacaaattaatatagcactgttgactgtcaagtgaggcctgcaacagtggaaactttatagttctgagtggtcagctgtttgaggtgtgattaatctccaggaaaaatgttaccaggattccctttgtaaccatgacaaaatgctgagaagtggtggacacttagttgctgaaaagcactgaacgttcgctttcatctgacaaagtctttctgaataatacagggaggttcgggagggaaagaaggcaagcaaacgatgggatgctttctgcacgtggctgtcaggaaattctgggtagaaattctttctttctccttttcttttctttttgagacagagtctgactctgttacccaggttggagcgcagtgatacaatctctgctcaatacaacctccgcctcccagggctcaagtgattctcccacctcagcctccctagcagctgggaacataggtgtgcgccaccatgcccagcgaattttggtattttttgtagagacgaggtttcaccatgttgctggcctcgaacttctgagctcaagcaatcctttcaccttggccttccaaattgctcgtacaggcataagccactgtgcccagtccagaaatgttcataaattgttttttttcatagaccttattttttagagccattttttagattcatgcagaattgagtgaattgagtgggtgccccaccacccaccaccgctaccaacatcccatgtaagtgtacaaaattttttttttcttttacaggcagggtttcactttgtcacccaggctggagtgtagtggacaaccatagctcactgtagtctcaaacttctggctcaagtgatcctcctccctcagcctcccaagtagctaggactatagatgtatgccactcagcccagctatttttaaatatttttgtagagatgaggtcttgctgtgtttcccaggctggtcttgaactcgtgacctcaagcagtcctcctgcctcggcctcccaaagtgctgggattacaggtgtgagccattgtgcccagccataaattattctttttgcactcctcggaatgattacctctgaaatgactgtctgaatgtacataaccaacagtgaattttatgatatgtttaataggggtagtctttttctataaaaatgaaaaagacaaccacagattcttacaacagacatcggcagcagccccaaacctaaatagggaggtgttgtcccagctgcaagtggctcagctacagggtctcgagatgaaactccacggcacagtctaatgacctgctggaattcctggagttggcggggagattggctggataagtggtctctgcagacccccatgcgtgccacccctttgcccaccatagcccacttgaacccaccactgtcataactttccaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttggtgggtggaaacttggcacactatttaatttgggctttttgggggatgactgcacactggttctctttttttctcagacctaaatttcgaccactcaactttcagcctgctcacccctgcttattgccatccacctttgggctgggttagacctaatcctccccttgacaaagccctcaaagtagccttcacaagataagagtcgagacccctaacttaccaacaaattttaatgaaacttctagtaaactcaaagcgctttgccaacatccttaggagcaacccagttctcgcagcaccccatgtgaggtcgctgttgaagtatctttggctgcagtggtgtggaattcatctcaacagagttgacggtaaagaccagacatgtagcagcctcactgcttgttggaggaaccacccttaagaaaatttcccaagatagtagttttcccatctccgtactttgctagttaatgttctccacttgcttgcgtttatcctttcaattcctttgctaattaaattgctgaaaagtatacattggtaagaatagccactgtcaatggactgcaaacaaaactcgtttctgttattgatgataaaccatttcagagaagaccaggctgagtctaaagggttcagataattacaaggggaaggcagagagagtagttcatggccacaggacttggccacctctgggcaacacataatgcttgctaagctaatgactgtagggatatagaactggccctcagcctctctgtcttcctttggcctctgctcttcctgctgccttctctctttgaccacgatgacacactttccataggccttcctcaccacatcacagaactcagagaagaggctgtcttcttgtttgatacacagctcgtctcttaggaacacccgatatttccaaggcacccatccttgactacccgcagcatgcacaatacaccaagttggggtttgtatgaaatatccatcactaatatcttccccagttacgagactttctgggatattggtttccccaaaatatacggtcttaaatccatcatattgcagtgttctcagggttttcagatattggaggcattgcttcctcttgatgccatcaaattgacttctgataatgacatttcttaaaagagggcttgcaaagcgaggcatggtggcttctcaagtgtttttaaaagcttgcacatctgcatctggggagagatggcaagtgggggatgatgacctcataaagggctttcttacagtggtgccagtcccacacatacacttcagatttcaagcatcatggaataaatactcagaacaactccctgctgacccataaaatatgggaattgcagatgctacccataaaaatgctactttgacatcacttctgcaataggtctgagacagaggttggcaatcttttaatagtaatgagcctacccatttggcttaagatggggagaaatgtttacattcattcatccatttcaaaaatatgtactgatcacctgctgtacaccaggcattgtgccaggcaccaggggtatagtcatgacacacccagggagtcctggacttacgtgttgtgtgtctgtgtatgcatagaatttgtgccagttgccttcccatttgcacaactaagagtgattttttccaggtggcagaaggaaggtatggcaaattgcaaaagaaagtcagtctgcacacctagcttccactggcgcttgcaggtctttttttttttttttttttttttttttttctgagagggagtctctctctgttgcccaggctggagtgcagtggcacgatctcggctcactgcaacttccgcctcccgggttcaagtgattctcctgcctcagcctcccgagtagctgggactacaggcaccttccaccatggccggctaattatttgtatttttagtagagatggggtttcaccgtgttagtcaggatggtctcgatctcctgaccttgtgatccgcccgcctcggcctcccaaagtgctgggattacagatgtgagccactgcgcccacccggagcttgcagttattgaactaattcaatacctcatcttgaaagcacttttaattttatatactcaggcaaaatgacagtttgcttcaaactctaaccatctcttcctttgtattttcttgcctctttaatcagagctaaagacatttcataaaatgggcatgaaggattccttcaaatgaagacgtggacaaaatgattggtcaggtcctttgctctactgttgaatggaggaggattttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgtatcttgttttacagttttcattttggaaaatgtcaacatttttacattaaaaaatattactcagccataaaaaagaatgaaatcacgtctcttgcagcaacatggacagaactggaggccattattctaagtgaaataattcagaaacagaaagtcagatgccacatgttctcacctttaagtgggagctaaataatgtgtacacatgggtacagaatgtaaaataatggacttcgaaagggaggctgagatgggaggaccatttgaggccaggagtttgagacaagcctggccaacatggtgaaactgcttctctactaaaatgcaaacaaattagccagacatggtggctgacacctgtaatctcagcactttgggaggccaaagtgggtggatcacttgaggtcaggagttcaagaccagcctggccaacatagtgaaaccccatctcaactgaaaatacaaaaaaattaactgggcatagtggtgcgtgcctgtaatcccagctacttgggaggctgaggcacgagaatcatgagccgagattgcaccactgcactccagcctggacaacagagcaagactccgtctaaaaaaagaaaaaaaaagaggataggattagggtgagggatgagaaattatttaatgagtacgatgtacactactacactcaaagcccagacatcaccactgagcaatcaatccatttgacaaaactgcacacctgcacttgtaccccttaaatttatatacaaacaaaaacaaaggcaaatcaaaaataaaaataaaacaaaatgatctctaaacaatacaaacagtaactgatgaacctagctgcttatcatgtcagttccaaaatcacacagagttgaatttctttcaaatgaccctacaacacagtattttgatcatatattctccagtagagtataagctaaggacaaagaaaaacacatgaaatcttaaatggtactcggtagttttattgttaataatgatgctggtattattattttgaaactcatgtccatttctcagctgccatttgatattaattttttttttttttgaggtggaatttcactatcactcaggctggagtgcagtggtgtgttctcagctcactgcaacctccacctcctgggttcaagcgattcttctgctttagactcccaagtagctgggactacaggcacgtgccaccacacctggctaatttttgtatttttagaagagacagggtttcgccatgttggccaggctggtctcgagctcctgacttcaggtgatctgcctgcctcagccttccaaagtgctgggattacaggcgcgagccactgcgcccagccagtgatttttaacctttatcaatctgatagacaaaaagatcatttcattgttttaacttctttaattatgagtaaatctggcaatatattatgaaaacaatgacaagaagaacttgatataaaatgcacaattcagacgtccttgaagatcattttagaggcagcatgaagtggggggtggcactggtgatgggggctgggtgtggagaaaaccagccaaaggaggactcatgggatcctggagcttttgactggggttcacttggagcccatactcaggctggttctgacagcagcacctgccaggcctcagcttaggggcacaatgtgggacacatggactgggggtgtggtcccagagcctaagaggcaccaacagagaggtctccgcagagactcatctgtgccccccacccaccaccccgggacaggccaagccagcgtctggccaggaactgcttttgcacaaggagccagaagtagtttgccccgataaatgggggcctggactcacgcaaaccattgcaccatggatggccagagaaactcagagaaccttcctgtgcttgttaacatactctctcacgtcctctgcagcctctgccaagccaagcagccagctcctaggactcccctccctccacctgaggctccttgtcctcccttcctcaggagtctccagcctcccgggacttcccctccccgctgcccactccagcagaggctgccaactgcctgggagagagaagtgggcttcctggggccacctccccaactttggagtgtttggaaggtgatggagcgaccactaggaggcagtgtggacaggtctctgtaggactgctcaggcagacacctttgcagggacctcccaggtcgggagccctccacacttttcccatgggagcttctccctccaccccgagtcactactatctgctttcctagaaggcacttctttacttctaattcttctccactgcccaggtaactgatattctcaagtgggacattgtaatttgtttaattcatttaaattgatttcatataattgggagataaagattgttcagttgcaagacaaagtcttaacttgaactctcaggacacgggtgggtccctaaactcaatacgtgagtgttgctgccgggctgttgggccatcttccacccgccatagatcactttcttcatcaaagaagaaggaatatttagaaactggtagtacaaaaaaacaaacaaacaacaacaacaacaacaaaaaaccaaaacaacaaaaaacaccaaatcaccaaaaacaaacaaacaaaaaacaaataaaaacccaaagcagttgctcctataaatagatgtgtgtatacatgtggctggtatgaatcttatccacaaattcagttttgtgggaaacatcacatttatttatttaaatcaagtcatatgggacttgggcatggttggaggttcttaccccaccccacttcccaaggccagtgcacaggcagggccttgaggtcacccttagccgatgcttgggtctaggtgctcagacccaagcccctgtggtcccatcatgtgggcactggcatctttgctgaggctgagaatttcaaagccaggatccagcccatttaggtaaacccaaagtcactctcccaggtggcccagtcatcttcttgagaacaagagccatgagcctcagttccctgcctcaagagcctctgttcaaccctaggcttgtagacaactctgccccttcttctctcccttcagtgtcacggtcccctgtcccatccctctctgggacaggtaccacaacctccccaccatacacagggaaagggtcagccctcaggtttttggcctggcatcttgaatctcctcccaggcaacaaaccacagagggcctggcattctcctgtgaaaagcagggcggaaaggaaacacagagaacaaacccacagacaacaaacccacagaaaacaaacccacagaaaacaaacccgcagagaacaaacccacagacaacaaacccacatcaacaaacccacaacaacaaatctacaacaacaaacccacagagagcaagcccacagggaaccagccaaattatgtctgctgtgcatctcggcagacgatgctgccaccgtctgtgtatgagcatgtgtgtgtcagactttcccatcgtctccaaacttgttttcagaataatgcttccagtgaaatgagtcggccacatgaggtcacaaagcccctactctgttcagcacctggggtaagtaataatattttggagcacttagtgtggggagtagccctgacccctttacatgtcatgtcttagttcattcttgttgccatccttggaattgaggccaacatcatctgcccatttgccagacaagctgctcaggaggagagggccacagccccttatctcctcgccaaacaagagaagatccccagttgctttttttttctgtggaagagattcttttaaaaacatttttttcatggagaagaaaatctgaaaaaaaagaatgaaaccgaaccaatagtcccatagacagttagttgttgttgttgttgttttgtttgtttgtttgtttttgatgaatacagaaattgacccttctggtcttaaagcttgaaaattaaatttgttttatctgagttgcttcctcaggaaaggagcccaagtcctctccaaaagtatcagagaactgaaactcaccagatcatcttgtctagacaatgagacgtcaggccctccattcatcatgactgcttccttacccctcccgagttcctgttacatttcttccctgctatataaacccctaattttagtgggtccagaagatggatttgagactgagctccatctcctgggcagcagcacccaattaaagccttcttccctggcaatactgattgtctcaatgattgccttccttccttcctttctttttgagatagagtctcactctgtcacccaagctggagcacagtcgctctatcttggctcactgcaacctctgcctcccaggttcaagcacttctcctgcctcagcctcctgagtagctgggattataggtacccgctactacagctggctaatttttgtatttttttttttttatagagatggggtttcactatgttggccaggctggtctcaaactcctgacctcaggtgatccacctgcctcggcctcccaaagttctgggatgagaggtgtgagccatcacgcccagctgagtatgtgtgtgtgtgtgtatgcttatggggatgtgcaaatgtgtgtgtgaatgtgtgcacgtgtccttgtgaattgtgaatacccaggacttgagcacactcagttcctgatgcacttcctgttttctcagcagctgagctcaggcctggaactgagtgacagcacacccgggcacctgtctccctgggcacccctcccacgcctgcttcccacggcattcccagctcccaccactgggaaggagctggaatcatgagtcgggataatcaccgaattctcttcgaccttcctcagctcctggtttgttaaggcaaacccccatctctggcttctcctggaacctcacctgggaaagaaagaggcagccccggagctggaagctgcttcagggctcacccggaacagcagactcaacctggacccatccaggcatctcctgggagtttcacccaattgcttctgcctggcaccagctcagaggttctgacagaattggcctggggtgagacctggcatccatgggatttttacaagcttccaggtgattctacagggaagccaaggtgagaacccctgtcctagaaccaggtctgatcaggggccggtggggaactgtgggtggagaacattagtgcttccagagcctcagggttggttttgaaaggaacgtaacacatttttttttctcacaaagacatatagagagagactttttaaaatagacatatatatagagagatgttttaataaagagaggtttgggtttatataagtaaaaaagatgatagaaaatagagaatgagattaggcttccccttgctctcaaaaaatggtttgagagtcttggaactggttccactctatgatagccatgagtactgttcgcccaacttttggttctcagccttccaggccccggtgggatgagacttccctgcccccacggttgagaggagccatgggcttattctagccaatgaatggtggatggacgtgactcgtgtctcttccaggctggagcatttaattgtccaggtgagatactcagggactcgtccctccagagctgagaatggccatgtttccagagggtctgcaggagcaacctgagtctcagagcacagccaccagcagacctgctgcacgcatgtggcgggggaaagaaagaaagccagctgtctgcagccactgagagtttggggtggttgtttctcatgacaaaaccagctcaccctgacttatacaaagtctttgagttatatagatggagaatgaggctcttgggtccctctattctcacaaagcaatagcctagctaaatccatctaactagggagcagaaaaggggatgtgctggcttgcacaccctagacagttgttcaagaagtcaggacaccaggcctggagtgatacttcagccatccttctaggtgagggtcttgaggccacacagacagaagtggcagagatgggacacacattcgtcttctcactcacagtctggcactgagctgtgggctgctgggacaccatgcccccatacgagtagccttcccactccttaccttgaaggaaaagtgttttttggacaaatacctgatggaaacattacatgggccttggaatctgttagatctagcttcctgaaactcttgctagctgtgtgacaatatacaagtttcttaacctctctgagcctcagtgctctaattacactcccctcatagagtttctaagagcatcctggggctggcacgtgtcaacgcacccagtatttgatagagtttgttaaacgttggttatcctctctccctatcgcacctcaaatggtaagggctgcctgccagcttccatatccccagcagtgccctgagttgttcagatgttcatccatctcccacagaactcaggttcctttggaggaagccacatcaagtcctgctccaagcttaagccagtcagcacattccatgctctgccccattgccagggttcaggagtatgctcgtgatctaagcacccccactcccagatacagctcaagattcttgcttggacttctgggcactcaggctcctccgagagggaatcaaacttacttctctccatgtcctttcctctaggagatgcgtctttcataaaactctcatcaacactgttcagacatgtcccaccccagcaggggacagcctgggctcaagctgggatccctactttatttattttctgctaattaaacttcctaatatactccacactaagtgtgcttgcaaggcagggggtgtgggataagcggccctgcctggctgggagagggggcagctccctgctgtactatgtattaataaagagacacatgcatggcagggcttgtctgggccttggtggcagcttaggacagaaggcacgtgacagtcaggggttcaaacaacccagggagaacactgcttcagggaagacagctcagcatcttcctggcaaagataatgacattgataatactctccaaagaatttcaggattttgagcaatcagaaaagcaacacagaaattcatgtcatcaaaacgatatggctctattggacacttaagacatttattggaggctcaacaacataatcctgctggttggttttacttcattgattttccgttgtgtctgattacattgctaatgctgatggtggatgagctacggctcttttcctgcctgtcctgaggtttatccaccaatgtttcagttctgttttaagatattgtcctaagcccccagcatcgcatgcatgctgtttttttgttttgttttgttttgttttttacaaagagttcatagcccgtggaagactctcctccatcacacacttaggttccctccacaccaggcctggaaggagtctagcttctggggactgtacatatgctgtggaccatgcagaacctggagaggcggtgaccccttctagaagtgatctgcctgaatccttccctctggaggaggcatttattaaatgccaggttcctgaaaggctctgagatgggcactccctctcctgagtcgtcccttccattactgctttcctatttctggccagggttccctggcccctcctccctgctcccatgggaccccagttcatccccatctttgctcaattgccctgcactgtagtaatccattggcactcttgtcttctccaggagaaatagttggaggagaagtttatagggtttcctgggccagggctggtctacagtcactggacagcaggaaacgacccttcggggcctaggagggccaaggctggtgggcaggtacagggggagccagcactgctgtccaccactgtgcagcctggaggctgtttcccatgaccctgctgatgggacccaaggcaccccaggccacccactcccctgcccccagcagggtgtcagctccccggcttccctgcatgcctgcctgacatggacagtgcaccttcgggccacacttgccctgctagcgagcctccagtgaactgggaattccacagagtgtagaggactcgccccagcactgtgctgagaggcttcaccaaactgtagcctggcttccacctgcactaagctgcatccccagaggcgaccccagccctggctgagtcttggctcaagactttgcaatgcagccaaatcacaaaatgcacctcgtccagcccaccccgctaaaccattttcagtagttctcccctcaccgttctggaactttccatttccacgtggcccccacgttctgttttcatttctccttcagtccctttttgttccctttctgttctctctttgaagacctcagtcaccgttttctgagttggggttgagcttggtcggtactggaatctctttccgctgctgcaggagtctgaaggaatcagtcttgccgcctgtaacacatgtccagcgctgctttttctctgatgagtgtcttagtcagtttgggctgttaaaacaaatggcttaggcaacacacgtttctgtctcacagttctggaagctggaagtctgagatcaaggtgttggcagattcggtacccggtgaggacctgcttcctggttcgcgggtagaacacttcttgctgtgtcctcacaaggtgcagagagagaggggggtctggtgtctcttcctgtaagggcactgatcccatcatgggggccttacaatcgcgacctcatctaaacctcccgaaacctcatctaaatctcacctccatactatcacattggggattaaggctttaacatgtggatttcaggggacaaaggacaaaagcattcagtccatggcacatgctcagtgcctcgactcttgcaagtgccacaccacagcctctctggggctgtgtcctggaggcgtgtgccatgggccctgtgtgccatgggcaaggcgcacagcatcctcccggccaccccaccagcgagtgagctcctggcaccctggctctctctggtcacccatctaccagtcttggtgctcctgtgcactagaggaccagctgcctggggactgtgggccaactgtggccccggccacccacgaacttcccctccggccagtggctgcaatcacatcttctctaaagacgtctgaagcccagccttggggagccgagttggtccttccctgggtactgagccctagggaacccttgagagttctctttgtatctttgtagtttcttcctcaccacttaatcatttccttacaggaaacttcctgtgttcaagtgactgtatggtttctgcctccagcttcatttgtgggtgccataagagaggcaagcatggagcactaggcgcaggggatgggcaactggcaagcggggagatgcatgcagcgcacttagtgcctggtacataccaagtccttttagtctggatttcattatttttaaatgggtattgctatttttaaaagaatagttacaaatatttattgtgtgttttgaaataagtgggtcaagatcaataagatattgttgatcaattgatcaataagatatcttttattcttaaaaatcatattcttctggttcagtggggaagagactgccgacctgtatttacagcattatgtgataagtgttctccttttcaggtatgtattagtctgttctcatgctgtcaataaagacatacctgagactgggtaatttataaaggaaagatgcttaattgactcacaattcctcatggctgaggaggcctcaggaaacttacaatcatggcagaaaaggaagcaagcatatccttcttcgcatgatggcaggaaggagaaatacagagcaaagtggggaaagccccttataaaaccatcagatcttgtgagaacgcaatcactatcaagagaacagcatggaggtaattacccaccggctccctcccatgacgcatggggattatgggaactatagttcaagatgagatttgagtggggacacaggcaaaccatatcaaggtgactcctgcaagcacctacctccacccctccttcatccttgccctcattctacaatgatttggtgaaatctggtccctgcctcagttttacagcctccccatgactctggttacttcctgattagcttaaacgaaacctaactaggttgccctaggaaagcatttctgttcctgacaccccccatctgcctgctgcttccgttccacctgtatgtgtctgggcacatccctgcatccctttgctggcttctagcctactcacttcaagcatttatcccatgagtttcataaaatcgtagaagaaaagggcttgaggcagtggtggggaaatgataggaaagtcatttctggatgcattctgccatcctgcagatccctaaaccacctctccctctccattccctccctccagagaacagcttctccttgtctcctgtggaatagttccgcccacattcatgggcccttcctgtaccaaaactgtacaggtctctcttgcttaccaaacacttggcaaacaaatgtgccgtccttggaaaaattctgttgaataaaattttctctctttgatccatccaaatgttttacaaagtgctacagaagccatggaggaacaagcaattctgccttagggatcaaggtttcacacagggggtgatatctgagcaacagtgcttttttggtttgtttgttttgttttgagatggagtctcgatctgttgcccaggctggagtgtggtggcacaatctcggctcactgcaacctccgcctcccaggtttaagtgattctcctgcttcagcctcctgagtagttgggattacaggtgcccgccaccatacccagctaatttttgtatttttagtagagacggggtttcaccatgttggccaggctggtctcgaactcctgacctcaagtgatctgcccacctcggcctcccaaagtgctaggattataggcatgagccacagtgcccagccaacagtgcttttaattggcattttcttcaaagactttgatgtcctataggagggggcctatgactcagcctcagccaatcagagcgctccattccctgggtcacctgcacacctgctcttccctgatccactgcagtgccctcaccctgagatctgaaacttgagcagaggcactaaaaggcagacatgggagctgagctgtcttttgggagaatcctagtgagaaggttctccaactggggccgccaagtaagggcctcatggcagactaacccctctccttcctaaggctgggaggagctgctgtccttttgattctgtgagctacctcagttaccttcctcaaaatcacacacacgcgcacacacacacacacacacacacacacacacacacacatttgcatgcgctaggtagagctgttttccataattgccaacagaagactaactgtatttgaagaatgagctggcattcttctgctccggtagaagtcaaggcaatcagttatgagaatcagagcccacctgtgactccagaaagaggtgcataaataccaagaatttagtctctaaagtctttctttaagtccttttttaaaaaatgtgatgagtacatcacccaggaaaatcaaattgtaatgcaaccgagtcgatgcaagttttatttaggagatgggttacaatcacctggggaggctctagttaccttgatttggtctggtacaaaccctagcaccatcatccacagatccccagaggaagtcattcctggatgacttcctcatcgattttaaataatttccatttcagaggaaggcctttatctgacctgatcccctaaatattgggggaaacctacatagggacaaagacagcaggtgtctgcaatgttgagaatcagtgtgttctgtcactgtctctatcagggctggtggcacatgcaaatctctttcccactctccagttgaacactaacgccatggtgcccacaccttccttattagtccatgtacatggggtttgtcaagacagtggttcatggctctgaccctgagcatgtcagatttcaggggctttatgcaaaatatccataccagttggggtcatttcccatcagtattgctcacaatggagcctacaaacccctagttcccatccaacacatctccaaggcagactctcagaccagctcccagaaatgaggtgagtttagatcaggcagcagagaggtggcctaggaaggagtccttggagctcatgcacctgtgtctgggcaccaacaggaagatggtggcttttgctctttgggagatatctttggagccagtctctgaccacatgtccaacaggacaggcatccttggggtttccatggcagtctactgacagtcaggggtgaggattaaatggtacagagtctcactgagtgctctttgagaggtcaagcaatgagaagtcctgcaaatgattattgagctgaagtaagaagtgtaccgaatctgtttttcccctataaatataaaagcctataaatataaaaatcttggtgaaaaaaaatgatcccagcctcccacacagcacatcacacatcttctcttttcaaatttgactccaaggcccacttccttcgggaaatcatttatccagtggtatcatttaggatatttttggttgtgaggaacaaaagcctagctccaaaagacttaataaaaggatctcattggttcacaaactgaaaaactccagtggtaaatgaaggctctgggtacagttggtacaggctctggtctctgtaatttcctagttcttctcccttctagatgctgggtttttgccttcaagttggctttcttcatggtggcaaaatggatccagcaattctgtcagaggttttcgaagcagagtgactccatcttgattaaaggctgtgtaaaatgaggatgagacttgctggactgcattccaggagggtaggcattcttagtcacagggtgagacaggaggccagcaggattgatatcacaagacacaggtcacaaagaccctgctgataaaacaagatgcaataaagaagccagccaaaacccaccaaaaccaagatggtgattaatgtgacctctggtcttcctcactgctcattatatggtaattgtaatgcattagtgtggtaaaagacacttctactaactccatgacagcttacaaatgccatggcaatgtccagaagttaccctatatggtctaaaaggagaacctatatagtctaaaagaactgagggttctgagaaatccctgaccctttcctggaaaatttatgaataatccactccttgtttagcatacaatcaagaaataaccatagtgtactcagtcaagcagtccctgctgctgctctgcctatggagtagccattcttttgttctttactttcttaataaacttgctttcattttactttatggacttgccctcaattctttcttgtgcaagattcaagaaccctcccttggggtctggatcaggatcccattcccgtaacaatttcaggctcagatcggcttttaacaccatccagagcaagagaaagcttttttgttccagaattccccattaaagttctcctggtcactcttattgggttgtttcgcttagggtcaggtgtccatcctggtcccaagcaatgaggccaggagatgggatgcaacgactggatcaatctaggcctcttattcccactttttaaaacacttattattattattttttaaaaattatttttcattcagctttttcatttgaaacttattccaattcttgaactgggggtagtttcaactttcctagagctgtatgggtcctcaaatgaaaattcggggcagctggattagagaagggggaaatgcatgctgcaggggcaaccaacaaggggagattgtgccaattcactcttcctatcctcagattcacctaagttctgaccattcagccccatttgaatgcattctgtattcctatgactgtggattacatttttgtctacctttgtgtcttctgttttgtcctgccctataagcatctcaaacatatgcataaagcctatataaactttataaataaactaacacttctgttttcaacctgtaggatgatgacaatgatgatgacgacaatgatgatggtaatgatgtggaaaatgtgaaaagagaaagaaatacttggaaatatatctcaccctccataaacaaagctcggggtttaattctgacctgtatgagttcatggggtgaactgcagaccgctgtctgtggacaggaaaacgatatttcatctctagccccagggacatctccaaaagctgagctagatgaactttatataaattggtacaaaatataattttctctttgcctgctgaaagccatttctagaaattctgttaatcagaatctccctaagttaatcagtcatctagacagatcttatttcttttttagacaaagaaaagtatataagtaacaggtattggtaaaccacttgagtgaagcatatgatatctaatgtaaggaaatctaaaagtgtccacaggcaaaatctcatggattcaattgatagcacaggtcatcaactgacatgcagacggaattctcttgtggaacaagacaatacagccattgcttagagactaattgtcaaggaattagtcatttcctgtttcagaatagcatcatcaccaccaccattaatgccaacatcaaccaccaccacctacgccaccaccgttagcatcataaccaccaccaataacatcaccaacagcaacactgccatcaacataaaccatcaccaccaccaaaaccattagcatcacctagaaccaccagtcaccaccatcaccacttaccacaacaaggcttatatttacatacttattttacttttcgaaatacattcacatgcatggtttcattagatcttatctacttggtaaggttggcagatctgacatcattagcctcattttatctgtatggaaactaagttctagagaagcgaagtgatgtgtgaaaggacaccagagtgattgataatcaaatccagactagagtttggttcttctgactccaaaattaatacatttttcttaaaagaaaaaaattttttttgagacagggtctcactctgtcacccaagcttgagtgcagtggcatgatcacagcttactgcagcctcgacttcccaagctcaagcaatcctcccacctcagcctctcaagtacctgggaccataggcacatgcctggctaatgtgttttaaacattttttggctgggcacggtggctcatgcttgtaatcccagcactttggtaggccaaggcaggcggaccacaaggtcaggatatcgagaccagactggccaaaatggtgaaacctcatctctactaaaaatacaaaaaaattagccaggcgtggtggcacatgcctgtagtcccagctactcaggaggctgaggtaggagaattgcttgaacccaggaggcagaggttgcagtgagctgagattgtgacattgcactccagcctgggcgacaagagcaaactccgtctcaaaacaaaacaaaacaaaacaaaacaaaacaaaacaaaacaaaacaaaacttttttttttttttttttgtagaaacggggtctccctaggttgcccaggctggactcaatcttctgggctcaagtgatcctactgcctcagggtctctaaatgctgggattcaggcatgagccaccacacccagctccaatgctttttttgtcgtacctaattctttcaatgaaaatgaagaatttccaacttctgatattaacaactttggtcctatattcaagctagagtctttcaaataaaatagacttttaaaaccatctgtctccaaaccctaaatgtctcaggtgagcaactaagctgctcagtttatgtgactccccagaagttgaattttaacccagaactgactccaagttcattcttctttccacgacaaggagtcacctccttgtatgcccccaggagtctcccggattcctccgagaacagtggaatagtgctcctccccagagcacaggttttgccagtgaagattgaatttggctagaaaccgctgccctgctctctcttctcgaagcacctggaagtctgagaaggaactgggtggctggctctggtcacaaactagcagccagaagcaccccttgtcagtgatgcacccccagtccccctcaagggctccaagtaaacccaaagctgctcccctccaagaagtctggggccaccctagggaaggcctcctggccttgactctcagggggtctctggggttgcggtttggggcccgctgcttccgccctttgcccccaggtgggcctggcagggctgcagcacagctctgttgctgatagacagggtggagcacttggcgaccttgccctgcagccctgtcattttgagttcagaggtcagatttgagtaataaacatcttctaaggacttgtcattctttctgaggatgttgctggccagccggaagacgaaaatcaccgcgtagatgccgatgatggtgagtatataccaggcagcgctggttccgtctggcaccttcagagccctggtggagttggtgtcattcctcccctctgtgtggtcacccagcaggagccccaggagggtgctggcctgggtctggttggaggcttcatggggagtccacttggcccctgagaaacagagaggtccggatgagatccagcgtcctgggctgagggctgcctggccacaccaaggagaatggagccctcatatccgtgaaaacgtgtcgctgctcaaagaggccttctctgaggcatgagcaggagtgtaacaacaggtatgtcaatatatttttaaaaatcaaaagagtccaaaacactattttgttgttgttttgttttgttttttgttttgtttgttttagagagacagagtctctgtcacccaggctggagtgcagtggcatgatcataacttactacagcctcaacctcctgggctcaattgatcctcctgcctcagcctcacaaatagacatgcagcaccatgccgggctaatttttttcttttttctctctctttttttttttgtagagatagggtcttgccatgttgaccaggctggttttgaattcctggtctcaagagctcctctcaccttagcctcccaagccctgggattacaggcaggagccactgtgcccagaaaaacactaagttcttgaataggagacacaacatcataaagatgtcagttatccctcaaataatttatacaacaaacataattgcaataaaaacagcaataggatttctttgtgaaatcaataaactattcatttagaaaaatcaactgttggccgggcatggtgtctcatgcctgtaatcccagcactttgggaggctaaggtgggaagattgcttgagcccaggaggttgagaccagcctggccaacatgacaagaccctgtctctacaagaaataaaaaaactagccaggtgtggtgtgcaagcctatggtcctaactactcaggaggctgaggccggaggatcacttgagcccaggaggttgaggctgcagtgagctgtgttcacaccactgcattccagcatgggaccctatttaaaaaaaacaaaaaaagaaagaaagaaaaagaaaaagaaaaatcaactgtcaagactaattagaaaaaaaaatctgaataaaaagaatgactaatgaattagcctagccacaaattttaaatcagccagctataaaaactaatttacatttttttcaatgaatgaaagctttatatgcacaaagcccagctgggacttgctgggctttgcagagtgtgtgggctgggggttcttcagaaccaggtacaactctccctataaaactacaacagtgctgggcatggtggctcacacctgtaatcccagcactttgggaggctgaggcaggtggatcacctgaggtcaggagttcgagaccagccctgccaaaatggagaaaccccgtctttactaaaaatacaaaaattaaccaggcgtggtggcacacacctgtagttccagctactagggaggctgaggcaggagaatcgcttgagtccaggaggtggaggttgcagtgagccaagtgatgcctgtagttccagcaagacagagcaagactctatcttaaaaagtaaaaaaataaaaaataaaactacaacagctaaaatagtgtgatgcctgtagttccagctactagggaggccgaggcaggagaatcgcttgagtccaggaggtggaggttgcagtgagccaagatcgggccactgcactccagcctgggtgacagagcaagactctgtcttaaaaaataaaaaaaataaaaaataaaactacaacagctaaaatagtgtggtgctgaaaacacaggcaagcagaccaatgaaacagagtaaaaacagcatcaatagttagcaattagaatttgatagctagctaataaaggagcatttctgatcggtgggaaaagatgaattattcaatatgtagcattgggggaaatagcattagatccacatctctccaccatatgaccagataaatcggtccagattaaaaaaaaaacagcccagataaatcaaatattttaacataaaaagtgaaataatttatagtactagagtacagcatggcagattttttctttatcatctcagagtggaatattcttttaagcataacaaaaattcagaagaaacaagaaatagaaatcaaattcaactacataaaaaaaattaagctatttcataccataaaaccaacaggcagatgacaaagtgcaatttatatcactgattttctaaatagccttcggttctgtaagaaaaagtttaaaactgcagtagaaaaatgtgcaaaagatatggacaaatagttcacagggaaaaaatgaacattcaacataagaagagcttctcaatatcactcatataagaaaaatgcaaattaagataataactagataccattttgttacctattggacttgcaaattcatgatgtttcagaataaactaacaaaaaaatggcttttttttgttcttttgtccagcttagaagaaaggtgtctaaattgggagcaaaggtggcaatgacgtggacttgacaccaaaaaaaaatttttttaaagaaaagaaacaagtgcctctgcatttcaggggtttaggattggcatttttaaaatgtcaacaaataaatgttcatatccacacttgacattttttccaaggagaattttaattgtataattgctggtaaattcatgcagccaacatggagggcacacggacaagatctatgagcattacaagtgcacttacctttgacccagcaattctatctctaggaatctatcctaaagatgctccagaacatctagagacaacatatgctgaaggttagtcattgcagtcctccttgtgatgacgaatgcctgggaacagcctgaatagcaccaactgagggatggtgaaatacattttggaacctccatgcagtggagtactacacagtcataaaaagcaatgagttttttatggtactgaatgttaataagtgaaaaaataagctaatggtgacatgctctgcaatgccacttgtaaagaagggggaagttatatgttatttgcttgtactttttttatgtatagaacatctctggaagaatgaataagaaattagtatctgcaattgcctctggggaagaaacctgggggaagaagatatattttttactgtttgcccttttgtacacttagtaccgtgtatacttatttttgaaaagcaagagtgtaccagttggtacttttctggtctccctggtgaggtgcccctgggtaaagccgttgtatgcccttgtaagaccagaagattaagatctcaattgctgttcaattcaaaactgttttctctgcttggagagctggtggagaaaatgaaacaatgaaaaccagagctgtagagtgcaatcctgtgagacatttcccagtggggccttactggctcaaacccccatttcttgctctaatgtgaacacagatgtatttaaaaacacatcataggatcaatcttgcagcctgctgtgcagaacaaaggtgctccaaaatgcttcccatttgatcgttgtttgttgctaattcattttgcgaacgcaagactcagagaggccagtattttttattatagttagttgccagaatgtgtgaatgagcttattacttttagatgaaggaagaaactatttaaaaattacttttcaaactacatgtgacaaagcccaggacaaatgaacagatttaattacataaaattagtcactcgcaagaaacaacaccacaagcataaatttacaccattgtttggtagaatggtttgagacattaaagtaaggaaggtgaaaaattcccgtaattattgcaacaaacaaacagacagcaaatcaacccaacaagaacacaatatccttatattagggcaagagaacttattgaaactcagaacacatgtataaactcatagaactttctagaaattgtcatagaatgatgcaacacattcaaatacaaataaaatatccccaactaagagctacacacagaacattaaattatttaaaaaccagtccattttctacacgaaagaaactcactatattaattactgcaatacattacattttacctttcttacaaaggtaaaagtaagttaggttgtatcttaatggacaaacatatcctgtagaagagagaaactttttcctctgtgctattttgtacttgtaatttaatgacgtgaaatatgtaaaatctcaacctgcccatccttgcattgtagctgagtactcacattccatggggtggtcttgtccttgactcttggaggggcaagttcaagcggctaccatgcacagaaggggaagatgatgaaaggagaactccgtctcctagggaagaatcagtcctactgcagttgagctgcactgagtttccagagtggggagtaatatgatcttccaacaatcttagggcagcaccaaacagaaacttagtaagtggatgactttgctttcatgcaattaatcagaggatccgatttgctgtgtcttctgttgcatcagaacagaaagcacttcccagctttgacttgttaagaagttctcaatcaaaacaaatttttaaaacgtgctggtattaaggaatctccatctctcaggtcccatcatgaactgaggtggccagaagctccccctgaggctggctctccgcttagagcttggatggctattgaattcccctgtgttctgcacctgttgcaggtgtggcagatggccaggtgtggcagagatctgtcatcatagggccaggaaactccatggtcaagagtcaccagcttcctctggacagtctcccagatgaggaaacccagacaggaagggagtgacaccccaagggtgacacacctgaggggacttgggctttccctgaggggtcagtgggcagtggactcctgtgccaggtggtgagaaatggctcttctctttcccagagtcacagaccccattggagttgaggtaggcttaattggaaagtgttagagtaagtgtctgcgggtaaagtttccccaggagcagggagggaaaagttggaagactggcaagttaaatcatccagccattgtttccagttccatttcttcctaatcctcactctaggactctaacttgccacgtttgtgatggttgctggtttttaagatacaatttgatgaaatttccatcaatggggtactgggtaagtaagttataaaataagccatatgatccagcaattctactcctgggtatcttcccaggagaaataaaaatgtaagtttacacaaaaacttgaacacacatgttcaaagcagcattatctgtaatagcaaaaaatggaaacaacccaaatatccaacaactgactaatgaataaataaaatgtggtttatccatacaatggaatgttattcagcaataaacaggaatgaagtactgatatatgccataacacggatgaaacttgcaaacattgtgctaaataaaagaagtcagtcacaaaggactacatattgtaggatttcatttatatgaaatgccaagaataggcaaatctacaaagatagaaaatagattagtggttcactagcgggagggattgggggtgataactaagggtatatagcatttttggaggggtaataaaacttctaaaattgtggtgctcactgtacacaatctgtgaatatacaaaaaaattgaatgcatactttaaatggatgaattttatggtatatgaattatatttcaataaaactgttaaaaattataatatacaagctgggtgcagtggctcacacctgtaatcccagcactttgggaggccgaggtgggtggatcccctgaggttgggagttcgagaccagcctgaccaacatggagaaaccctgtctctactaaaagtacaaaaaattagccgggcatagtggagcatgcctgtaatcccagttacttgggaggctgaggcaggagaattgcttgaacccaggaggcggaggttgcagtgagcagaggttgtgccattgcactccagcctgggcaataagagtgaaactccatctcaaaaaaaaaattataatatacatatacaatggagtattacacagctgtgaaaaagaacgaggaagctatttatgtactgatgtataaagctctctaaggtgtgctgttatgaaaaaggtaaagaagagagcatgttaacatgtatccaaaaattgagaggaagcatatatatatatatctgattttgccactgtaagcatttaaaacaccagtggaatatccaagaaattaagaagaggggttacctattggaggagagaaccaggtagatatatggcaggtgtgggagggagagctctcactaaatatttttatgctttaaatatttttaaccgtatgtgtattacctattcaataataaatgcacccatttgttagatatctttgttgaagattcatttggctcctgctgtctcttgctatgggatggaccatggcatcccccctctgccacacagacaagggatttggacactgccagtgggacgtgggaggggagagcacctgacccgtgataataaggggctcgtggcagtgataagggctgggagtcagggctctggccccagccacatccttgctgcatgaccctgggccagccccctcatctttgtgagcctcagtttcctcatctgtgaggtgaaggtggtgaaggaggtgaaggatgagcaggatcttatgtccttggtcctgagaaggcaggagagaagcctggggctctgtgtgggaagagccgctctctggggaggtatctgaatagatgagggagagcacaccgggcagccaatgtgccagaggtggaggctttggagagtgtttcatttgtgaagtcaacagatttaacattcagatcaggaggacgttggcatgagatgtggggaatcataagctccaaaacaatcgtgagacagaaggaaagatggccttttgttgagcagccattctcctccacggagagtcctgtctagtctgcctgttgaaggggcactgatgttagggaatagatctgtgtcaaatgcttcccacctcccagaatcctgtgaggcaggagtattatccccatttaaagagaggacactcaggctcagggaagtgactggcccaatgtcccatagctcataggtgccagaggtgggtcatccacaccaaagtcattctccttccataccctgaatgtcaccttcacgctggacccaggatcctgtgtggtgaactgtctcgatcacttccctaaaggttaaatcataaactcttactgccaaggcatatccacgaccttaaactctccctgttgggcaaaaacaatctctgatgttaaaaggcaggatagtggatacttttcagggaagggtaaatgacaagggcatgaggggaactctgggtgccggtcatattctgttttacaggtttgttcaatttgagacacttcatagagctgtagccttgtgcacaggcacttttttgcatgcatcgtctgcttcaatataaacctcttcctgttgtcttgtttttgtttttgtttttgttttctcttgttttcttgtcctgctctgtcacccaggctggagctcagtggtgtgatctcagctcactgcagcccctgcctcccaggttcaagcgattcttctgctcggcctcctgagtagctgggattacagaggtgtgctaccacacctggcttccctgttgtttctttaatgtagaaagccctgatagatggtgggaaaacaaagtttaaggtattcatagaaaaatacaaatactatttttaaggattctatatctggccacatggtgccatctcacgaagagtgtccccgtcccttgagggggagtggtcgggatcatggtcagtgtggggccctgcagctgcctgcttccctatgctgtgtggatgacgcccgcctccggtcattcccctgtgcttacataacagtgaaatggaacaacctgtatcagcacgagggccaagaattttcttctgacttgtggatacctccttccttaggcctctgatcagtctggacaaatattgccctgaacgcaaccaagcaaagccactcacctggtaaatatttgtatgagctacagttctggaagaacaaattccaatatcctgcagtccccttgacatcaaagacccaactctcccagagggcaatggcttttttgtccactgagaagccagtcagcttcgaagaaaggtgtctaaattgggagcaaaggtggcaatgatgtggacttgactccaaaagaaattttaaaaagaaaagaagtgcctttgcatttcagggggtcagtattggcatttttaaaatgtcaacaaataaatgttcatatccacacttgacattctttccaaggagaattttctagaggagacagacctcatcggtcagctctgatgccctgcagtgcaaaaagacattaaaaatgacggtaaaggacccctgcagagaacaactgagtctcttccttgccctgcgtctccagataaaggatgccctgcatccatcccctcctggctaagagcacagactccagaggctttttcctctcctggaggttaaagaggcatcacatatgtttaaaatctttaatttatatgtcacctttgtccttccttttaacttcatttttctcttatccagcatttagggactcatctttagggaggttcaaaggaaagctcatggcctttagaactggaagaaccatgttccagttgggacttgatcatttactaattgtgggattacagccaagtcacttcatccctctgctgtaaaaaaaaaaaaaaaaacaaaaaaaaacatatgatgacatttgtggaatggctccccaagccaaagagggcaaatattgtcacagctcatttcttctctcagttaattacttgcgtcctcggctgcctggctggcaggacaacctatattcgcctccctcttaaagcctcctgggttggccaggactccaagcggctttgtccagaatgagtagggtggttggcctggcctcctcagccaatcagagaggactagcatctgaacactcctctgtgctattgcttctagctgccacatggggacgctgttgaaacaccggcctggtgcagttggccatatgatgcttcagggtcttctgagacttcaagaatgtgctcacagggaaggtattagctctaaacacttgcctctgctagtttacatcacagaacagacagacaagactgttttgctccctcagctctctccttttcctagcttcagtcctggggagctcagaagctacagtttgttttttgttttttgtttttgtttttttcttgagggagtcttgctctgttgcccaatctggagttcagtggtgtgatcttggttcactgcaacctccgtctcccaggttcaagcaattctcctgcctcagcctcccgagtagctgggactacaggtgcctgccaccatgccaatctaatttctgcatttttagtagagtcaggatttcaccatgttggccaggctggtcttgaattcctgacctctggtgatcacccacctcagcctcccaaagttctgagattataggcgtaagccaccgcacccggccagaagccacagtttacaaatctgggggatttggggcatgggaacagaaacagaagagtcccaatgaaaggaagataccagctgagctgcccactctcccagctgcagttctcctgcccacagcaggccctagctgggacagggaggagccccagccttaaatcaaattcagaattttgtttatgacataagactgcacatcttaattactgaattaagactatattttccaacctatcatgactataggtgcagggcaagatcaaactccagtgtatgtggggcccgcagaagagatttaaagaaacagtgggggcagaaataaagctgtgtggttatcagatcccatgagtcttgtctgtaaggatgatggttacagtcgggatgctccagagtgcaaagccacatctcaaccagagttagtaacaagggagagtttactggttcatgtgaggaagagagaggaaggggagggctagccaaggggctggatgcaggaaggagggtccccagggttctctgtccccctcctgtcttccatctctgcctctctcagcaggttggcctaatttcctccgactgcagagaagcacacaagctgtggcacctggtgctcagactcacactgcaacacttccaccagtagatggcagagaggtactttcctgcctgttcagccacgaaaatcccaggggatggctctgactagcctaagtcaggaacctgctgtgggcaatcactgtagcattaagatgggggccagtgatggagccggtctgcagcacatgctcagcaaaagacaaaacccgcctgttttagatcactccggctgcatcacagagtgtggattgaacaggcacagaactggaggcagagaaacaagttaggcagctgcaggcataatccaggcaggagatgacagtatttgaaagaaggagtgggagcaagtctggagagaagtcgatggatccaagagatttttagaaggtagaatgtgcagaacttaattagttggtgcagtgggttgaatggtgtctccctaaaagatatgttcacctggaacctcagcatgtgaccttatttggaataagggctcttgcagaagtaagtaaggtgagaatcttgaggtgagatcgtcctggattacagtggaccttgtatccaatggcaaatgtccttataagagacagaaaaggaaaagaaagagacacagggaagaagatgtgaagatggaggcagggattggagtgatgcagcctcaagccgcagaatgcctggagccaccagaggttgggagaggcaagaaaaggtcctcccctagagccttcacagggagtagcgtcctgccaacgctttgattttgagctggtctccagaactaagagagaatagatatctgtttttctaatccaccaagtttgtggttattttgatgcagggcaggcaagcccccaaattgggttgtagcctgagagggttcttgggttcattcaggaaggaattcaagggcaagctggtggtattagacagcaacttctgttgaagcagcagtggacagcagcagcagaggtcctgctctttgcagagcagggctaccccataggcagtgtgcccagagtagcagctcgaaggcagttctgtagtcctatttacacccacttttaattatatgcaaattaaggggcagattatgcagaaaattttagaaaaagagtgctaatttccaggttgtcgggttgttgccatggaaaggggccgcaacttccggtgaactccatagtatgtggcacacactggtgggcgtgtcccatggaaaggtgcttccgccctgtacctgttttagctagtccttaatatggtccagtatccgcgccctgcctttggagtcaagttcaacttcctacctcaattgatgatagcagtttctgaaaactaacacatgtagatataaatataagtccttaagtctatcattattatgcatatcctataggggagtcatcgcgaatgaaactgaacttattgtggttcattcattcagatatttatttaaaaatatttattaaagcttactgtctgccagtccgatactgcactaggtaagtgctggggttacaaacagaacaagatagacagattagttgcccgcatggaacttatatctagtgggaagagaagcaaaaaaaaagtaagcaagcaataaacagtaaaaaaaaaaatactgggatttgagccataaaaaaagaaataagatgcagaaatcagcaataaggaggttggggagaagatccttctttagaaagaattgccagagaaggtggttgggataggcagaaaaaatagtaatattcctcttttatcttcacctatattagatgatcaatagatatttcctgagaaatgaaggactgagtatattataagaaggtatgattaaaaacaatcaccagaatgaatggctaacaagcacatgaaaagatgctcagaatcattagtaatgaaagaaacacaaattaaaccacaatgagataccacttcacacataaaaaggaattaacacttgctggtgaggatgtggggaaatgtcatatttccccacagcagccatagtacactgctggtgggaatataatatgatgcatctgctatggaagagaatatagtggctcttcaaaacgttaatcctagaaagcctgggcatggtggctcccgcctataattccagcacttcgagaggccaaggtgagaggactgtttgagcccaggagtttgagagcagccttggtaacatagcaagaccctgtctctataaaaatcaaataaaaaataaatagaggaaaagcacattaatcatagaactgccatatccaccacttccactccttggtatataccccaaagaactgaaaacagctattcaaagaaatacttgcacatgagtgttcagattattaacggaaaccaaaaggtggaaataacccacatgtctaccaatggatgaatcaataaacaacacatggtctatccatacagtagaatattgttgagccataaaaaggagtgaagtgctggtacattgccagaacatcaaagacccttgaaaacattatgctaagtgaaataagccagatgcgaaaggacatgaattatatgatttcattgatataaaatgtccagaaaaggtaaaaaatatccattgagaccaaaagcagattgtggttgccccggactaaagaaagagtaattacttaattttcctgggggtttcctcttggcatgatgttctgtatacaggacatacaaaaagcctttattttttattcttagcaaatacttaattagtactcaccatgagctgggcatgttctaagtcactttccaattactaacaaatcacttaattatattgacacaaaaagaatgggcataatgcataaagcaaatacgaacataaaaaagaaatctccctattaatatcatttatgttgaattcaatgcagggagcatttaaataagataaagggagatacttcataatccacactggtcagctaacatcatgactatctatgcagaagataaaccagcatcaaaactcataaagaaaaatttatagagagtaagaaaaaaatgaagaaacagtttagaggtaggtaatttgaatttactgttcggtgcataaaagaacaaataggccagacgtggtggctcaggcctgtggtcccagcacttcgggaggccgaggcaggcagatctcgaggtcaggagttcgcgatcagcctgaccaacatggtgaaacctgtctctactaaaaatacaaaaaattagctgagtgtggtggcgtgcactgtaatcccagctactcaggaggctgaggcaggagaatcgcttgaacctgggaggcaggctgggcgcagtgactcacgtccgtaatcccagcactttgggaggccgaggcgggtggatcatgaggtcaggagatcgagaccatcctggctaacacggtgaaacctcgtttctactaaaaaaatacaaaaaaattaaccaggcatggtggtgggcacctgtagtcccagctactcgggaggctgaggcaggagaatggcgtgaacccgggaggaagagcttgcagtgagccgagattgcgccactgaactccagcctgggtgacagagcaagactctgtctcaaaaaaaaaaaaaaaaaaaaagaaagaaaatacaggccacacagatggggagatgataattgcaagttatatatttgataaaggactttcattcagaatatatgaaatagtcttacaatttaataaaagaggacaaacaacccagtaaaatgtaggaaaaatatttgaacagatgtttcaccaaggaaaaaatacaaatggctaatcagcacatgaaaagatgctcaacatcatttagtcattaaggaaatacgaactaaaaccaccataatatatcactacacacctgccagaatggctataattttaaaaaaatggacaatactgagtgctggtaaggatgtggaaaaacagaaactctcataccttgccagtggcaatgttaaatgatacagctattctggaaaacagtttggcattttcttaaaaatttaaacttattatatgacccaacaattccactcctaggtatctacccaagaaaaataaaaatacatgtccacacaaggggacttgtgcataatgttcatatcagccctatttgtaataacaccaaattggaaggaatccaaatgtccattaactatgaatggaaaaccaacattcttacaaataattcaacaataaaccttcatgaaccttagaaacattattctgagtgaaagaaaccagacacagaagaccacaaggtgtaggactgtatttatttgacatttctagagaaagcaaaactgtagagacagcagatcagtgactgccaggggctagagacggaggcaagggttgatacaagcaggcaggaggttgctttctgggctgatggaaatgttcttatgctggattgtggtaatggttcacaactgtataaattaacaaaaaattatcagactatacccttacaatggtatgtacatttcatccaagtaacgctgctttaaaatttgaaattaagcacctaatgatattaagaaatgaataacaaaataaacccaaagaaagcaggggggaaaaaaagcaattggaaaagatgagagcaaaaataatgaaaaaaaaaacatctataatacatctagcggttggttccttgaagaaaaagaaagaaagaaatgaaaaaatcattaactatcctaataaagaaacaaaggagaaagaacaaatatacaaaataagaattgtgaatgaaataattgtagacacagaggatatcaaatgagtgactcctcaatccctctgcaaatagattcaaaatcttgaccaaatggatgattttctaggaaaatataaattaccaaaactgaccaccaaagagattttaaaaatcagaaaatatcgtttatcacagagatggtaaaaaccttgataaaaagtcatttacccagagaagcatctggttccaacagctttgcaagtgcatcctattaaaactttattgattggcaaacgctaattttttttaatttttatttttaattatactttaagttctagggtacatgtgtacaacgtgcagttttgttacatatgtatacgtgtgccatgttggtgtactgcacccattaactcgtcatttacattaggtatatctcctaatgctatcccttccccctcccctctccccacgacaggccccagtgtgtgatgttccccactctgtgttcaagtgttctcattgttcaattcccacctatgagtgagaacatgcggtgtttggtcttctgtcctttcaatagtttgctcagaatgatggtttccagctgcatccatatccctacaaaggacatgaactcatccttttttatggctgcttagtattccacggtgtatatgtgccacattttcttaatccagtctatcattgctggacatttgggttggttccaagtctttgctattgttaatagtgccgcaataaacatacatgtgcatgtgtctttgtaacagcatgatttataatcctttgggtatataccctgtaatgggacggctgggtcaaatggtatttctagttctagatccttgaggaattgccacactgtcttccacaatggttgaactactttacagtcccaccaacagtgtaaaagtgttcctatttctccacatcctctccaacatctgttgtttcctgacttttaatgatcgcccttctaactggtgtgaaatggtatctcattgtggttttgatttgcatttctctgatggccattgatgatgagcgttttttcatgtgtctgttggctgcaaaaatgtcttcttttgaaaagtgtctgttcatatcctttgcccactttttgatggggttgtttgatttttttcttgtaaatttgtttaagttctttgtagattctggatattagccctttgtcaggtgggtagattgcaaaaattttcacccattctgtaggttgcctgttcactctgatggtagtttcttttgctgtgcagaagctctttagtttaattagatcccatttgtcaattttggcttttgctgccattgcttttggtgttttagacgtgaagtccttgcccatgcctatgtcctgaatggtattgcctaggttttcttctaggttttaggtcggacatttaagtctttaatccgtcttgaattaatttttgtataaggtgtaaagaagggatccaatttcagctttttacatatggctagccagttttcccaacaccatttattaaatagggaatcctttccccatttcttgtttttgtcaggtttgtcaaagatcaggtggttgtagatgtgtggtattacttccaagggctctgttctgttccattggttctgttctgtctctgttttcgtaccagtaccatgctgttttggttactgtagccttgtagtatagtttgaagtcaggtagcatgatgcctccagctttgttcttttggcttagaattgtcttggcaatgcgggctcttttttggttccatatggacgttaaagtagttttttccaattctgtgaagaaagtcattggtagcttgatggggatgccactgaatctataaattaccttgggcagtatggccattggcaaacactaatgtttttaaactgttctagagagcatggagaaaggagaaaaccttccaaattattcctgtgaagcttgcatgtcaatgattccataacaataactatagaatcaaataaccacaataaaagaaaaacacagaccaactccacttatggatatagatgtaaatattctaaatacaatattagctgatagatctaacactgcattaaaagatttgtggaaggagttgttcaatattaggaaatccactctgtgattatctcaagttagcaattagatgtatattcaatgctgaaataacagaagcaccccagtttagtcagaaataagacccaattacccattatcaccaccaccatttagtattgcactggggaattaccaattcagttagacaagagtggggaagaggtacaaaaactagaaagaaggtggcaaaaacaatcattgactgtatgattggaaaaaataagagaatcaattgcaaaaccattagaaagagcaggataattcaggaagctcagggggcacaaaataaatgtttttacaaaacaatatccaagaatctatattaacaacaatatctttgagatataattgaatagaagattccatttacaataggaaaccccaaagatagaacacccaagagttgcacaaaatttacacaaagaaaatctaaacaacagagggacaaaacggaagatttgactacatgcaagtatatttcctagtcttgggtagaaagactcatctgcataaagatgacaatccttcctgaattaatctataaatttagtataattccaatggaaatttcccttgttttgttgttgttgtgctgtttttgttttgttttccagactacactgaatgccaaatattccatttagtgattttcttcttcccttttcctttctaatgacatattttgtgcttttcagacctgcctttctttctctcggcaccaatgaataaagttccagctttaaggcttgaaaaatcacagcaaagttgcagcaaaattaaaaggaaaaaaatgttctttttttttcctgcagctgcagagagtggcagatagcatcctgcgtgataaacgcctattcttggctaggcgcagtggctcacgtctgtaatctcagcaacttgggaggccaaggcaggcaggtcacctgaggtcaggagttcgaggccagcctggccaacaaggtgaaaccccgtctctactaaaaatacaaaaattagttgggtggtggcgcacacctgtaatcccacctacttgggaggctgaggcaggagaattgcttgaacctgggacgtggaggttgcagtgagctgagatagtgccactgcactccagcctgggtgaaaagagtgagactctatctcaaaacaaacaaacaaacaaacacctatccttgcctatgtcattttaacaaaggaggaagtaaatcccctggatttcagaggctgatgctctgcccaagaaaagcaaccctaacttccccaaaggctaaaattcagactgattggctctggcagagatatttaaattgatacctctgtttcctcaaaggtataagcctttgcgaactttctttggtttctctcttctctcacaggaggcaggggataaacaaatatgttagatttcttatttaaacaaagagcttgagggttttgcctcatcgaaattaacagagacaagttgatgctaatatttttatggaaaatcgaatatgcaaaaatagccaaggaaattccagggaaaaagtaatgaaagaaaatatcaccaaaagatgttaaaacattttggaaagccacagaaattaaaagtgtttgatcctagcatataaacaagcagacaaggggctgggcatggtgactcatgcctgtaatcccagcactttgtgaggccgaggctggtggatcacccgaggtcaggagttcgagaccagcctggccaacatggtgaaacctcgtctgtactaaaaatacaaaaattagccaggcatggtggcacgcacctgtagtcccagctacttggcaggccgaggcaggagaattgctggaccctgggaagcagaggttgcagtaagccgagattgcaccactgcactccatcctgggcgacagagcaagactctatctcaaaattaaaataaacaaacaaacaaataaataaataaacaggcagatagatcagtggaacagaataaaatccagaaatagactgaaaacattcaggaaaacagtataaaataaaggggacatttcaaatcaatggagaaaagattagttatctcagaaatgaatgggacgattgagtagactgggaaagagtaaaactggagctctacacacaccaaaatacattccagatggggctaagattttatatatctatatatgtttaaataaagccatgaaagaactagagcaaacatgagagatttatttttataatcccagacggtggcaatctttccaagtgtggcacaaaagtcagaaatcattaaaaaaagactgataaatccaactacacaaagttagacatttctttatggcaaaaaatgctatcaaaaagtcaagagatcaatgataatgggggaaacatttgtaacacatacaataagctgtccaattttttaatagtcaaagactttaacattaagaaacagaccagctggctgggcatggtggctcgaggctgggggatcacttgaggtcaggagttcaagatcagtctggccaacatggcaaaaccccgtctctaccaaaaatacaaaaattagctgggcatggtggggcatggtggtgcatgccagtaatcccagctactcaggaggttcttctggcttctcagcttgcagacagcctattgtgggaccttatgattgtgtgagttaatacttaataaactcctgtttatattatgtgtgtgtgtgtgtatatatatgtgtgtgtgtgtgtgtgtgtatacacacatatactggaatatatgtatatacatatatacatatatacacatacatatatatacacatatacatatatacacatatatatacacatatacatatatacatatatacacgtatacatatatacatatatacacatatacataaatacatatatacacatatatatacatatactatatatatacatatacatatattcattccattagttctgtccctctagagaaccctgatgaatacagtgggctacacacctattggaatggccaaaacccagaacactgacaacaccaaatgctggtaaggatgtggcgttttttatccgcattcattgctgatggtaatgcaaaatagtgcagccagtttggaacacagtttggcagctctttacaaaacggcgtgtactcttaccatacgatccagaaactgtattcctaggtatctacccaaaggagttgaaaacttgtaaccacacaaaaacttgcacacagatgctcatagcaagctttatttattattgcccaaacttggaagcaaacaagatgtccatcagtaggtgaatggataaataaactgtggtgtatccacacagtagaatattattcagtgctaaaaagaaatgagctatcaagacatgaaaagacatggaggaaactgaaatgcatatgactgagtgaaagaagcccttatgaaaagctacatactgtatgactctaactatgtgacattctgaaaaaggcaaaactatggtgaaaacatcagtggttgccagcagttgagacgggtggggggaagataaccaggtagagcatagaggactttaagggcagcgaaaatgctctgtatattactacgatggtggatacatgtcattatacagcaggtccttggatgacactatctcattcaacatcattttgctataaagttgatgagaaaaaaaagtcaattcctagccaggccactgtctctgtggagggtgtgcgttctccccatgtctgtgtgggtttcctctgggtcctccagtttcctcccacatcccaaagctatgcacggtaggtgaactggcatgtctacatggtcccagtgtgagcgagtgtggaagtgggtgagtgtgccctatgatggaagaggaccctgtccagggttggtgtctgccttgaccctgtgcctctgggatgggctctgccatccacagctctgaagtggaataagccagtcaataatattctcgcttgttttttgttgttgttgttgtttgtttgtttttgtgacagagtctcactctgttgcccaggctaaagtgcagtggcactaactcggctcactgcaacctccacctccagggttcaagtgattcctgtgtctcagcctactgagtagctgggactacaggcatgcgccaccatgcccagctaatttttgtatttttagtagaatcaggattttgccacgttggccaggctggtcttgaactcttgacctcaggtgatctgcctgcctcagcctcccaaagtgctgggattacaggcgtgagccaccgtgctcagctttcacttgtttgtattaatctttcctaaatgtatgtatggctcacatttatttcaatgtttagtattagaagtgtttgaggtctttgtaagtttggtgatgttttgtgaccagaaacaggccataggaacttaactcttgtttatattaattagcttatggtaaaattggataaatgttttataagagacatgaaagggcatacagacacacaggagagaaggccacgtgaagatggaggtggaggagacagtgatgcagccacaagccaagggatgcaagcggccacctgcagttgagagaggcaggaaggatcctcagaaggcatggagcctacgaggaagcctggccctgctggtaccttaattttggacttccagcctccagaaccatgagagattacatttctgttgtttgaagccactgatttttgtggtcattggttatggcagccacaggaaataagataatcacccacttaattttcctagaaaagctgtgttttgaaagtcctcttgaagcctgggttcctctctctgcatctcccagttttccctcaaagcttgtggattctccattcctcacattaactcaggcctttcattgccaagtgaccccgagtcctgccttcgcgggtgctgggggagccttcctgacccactggaagtggacctgcccatctccttgctgtgaaactgcatgagggggcttgtgtctgaggattgtctggcgtgaggggagagacaccacgtggggacagaggagtggatgagcaggccggggcatgacggggccgtgacagggacctggccttccattctgtggaagcctgagacaagcagcaacttctctcattcctcctctctatgacaagacaggaactgggacactcaccttactaccctaattcgctgagcctcggaagaaaagcagcttagatttttaatcccatccaagatggaggccctcctgctcctgctgccttgttctcaccccctttcgtgatgtgcgaggccatcggaaggtgtggaatttctccactgattcctctcattgtccctttctccctactcctggggaggctgcaatggtgacctcatccaccttcagaggcaggtgctggaggaggaaaggatgtgggagttcaagccggctgcagaggcccaagagcccagatggtgtccttccagcaaactggagaggcactcctcctaccaggcagccactgccccactccagggcccctggctcagctagggaagtggggctgggtttcaccccctgctcatcccctaaggcccagtgctggactcagtgcagcacctgcccagccatctctagcagcggcataaagcataaaatcaaggccaatgttacgtgctgccttgacatgtggtaaaatgtgaagggcctcaagtggcctaaatgcaagctcctgtcccacctctgctcccataaatagggtctcccagctgggcaacccttctcatcccagggaccaggtaccacccctgtttgttgccaagtagcaggcttcagttccctgccagtctgcggaattatttaacaacctcatgaagaaaccaggggccactccaccctctgtattagcctgttctcaggcagctaataaagatacccaagactgggtaatttataaagaaaagaagtttaattgactcacagttccacatggcttgggaggcctcagaaaacctacaatcatggtagaaggggaggcaaacatgtcctccttcacgtggcagcaggaaggagaagtgctgagcaaaagggggaaaagtcccttataaatccatcagatctcatgagaattcactcactgtcatgagaacagcatggaggtaacccccacatgattcaatcacctcccactgggtccctcccacgacatgtggggattatgggaattacaattcaagatgagatgtggaaggggtcacggccaaaccatatcactcttgttactaccaaacctgctgtccaacaaccctgctgttcactctgctcttgagcaccacctcatgtggccctgcatagcctgcagtggcccttcccctgggctacgagtatatgtgactagaaaattgccgtgggtctcacctatccagtgttgggtgttgtgtgtccagccctagagtgggactccttccctcacgaatggggtgaatagaaggtgataaaaagatctgagtctagggatacctaggaggtggaatctcttctccatgcatagcatgagtgatcacaggcctgaaaccaaaagggacttaggtctgggggagagattattttccaggtgctgaatattcctgggataggggagggagctaaacaggttcctgcccaaaggaagtgagaagggggtcctagcaacttctcagggatttagagctgtgactccagggcctttgttcagaggagctaccttgcaaggaacttctagaagaatgcttctctttctcagcatccatcctcccatttcatagtcgtgcccacgatgggccccgtctccctgaacttgatggctgaatagaagtgtagcctcccaggggcatctaaaggcactcagagccccttacccagccccagcaggcacctgcctggctgcccggtcctcagggttccctgtgcattgagcaatatcctcaaagtgaccaccagggggcagcagcacccagactgccttccactgcacctgcagatcaacaaattccagtattttgggggaatatctgtgataacttggctactgctttactgacctcaggtaaatagacagaccaatgtgcttgaggagccaattgctttaaatctcctgactcattttttgtattaagatttgttttatttatgcaattattctgtttactcaaagactttaccagaagctgggtgcagtggctcatgcctgtaaccccagcactttgggatgccaaggtgagaggatcgttggagcccagacattggagaccagcctgggcaacatagtgagaccccatctctacaaaaaatttaaaaattagctgggcgccactcatggtggctcaggcctgtcatcccagaactttgggaggccaaggcaggtggatcacctgaggacaggagttcgagaccagcctggtcagcatggtgaaaccccgtttctactaaaaatacaaaaattagctgggtgtggcggtgggcacctgtaatcccagctactcgggaggctgagacagcagaattggttgaatctgggaggcagaggttgcagcgagccgagattacaccactgcactccagcctgggcaacagagtgaaactcagccctccatcccgaccccagaaaaaattacctgggcatggtggtttgagtctatagtcccagctactcaggaggccaaggtgggaggatagcttgagtctgggagggtgggagtctggcttgagtctgggagggcgaggctgcagtgagctatgattgcaccactgtactccagcctgggtgagagagccagaccctatctcaaaaaaaaaaaaaaaaagtaccagcccctatctacccattcatagctttatgtccatttcttttgtcttcaagcactggtatcctttacttatctctcctcacctgatctagtgtttacatctcatttgcgcccatagagaagtcatacactgatgtggattttagatagggcacgctctcaagacagccacatgtattattctgtgctcacacagcctggcctggagatgcaaagattatggaatccagaatctaaatgagaggatcagattaatgggatgttctcacagtgtcaggtgaggacagcctgatgcagcctttcatcatgaggctgggacctctgggtcccttggccccaggaccacactcgaggacatgcctgttcctgccaacatggctgggcagagttcctcttttctttccttttcttttcttttctcttctcttctcttcttttcttttttctttcttttcctcttttccttccttccttccttcctttcttctttcttctttctttcttttctttctttttctttttccttctttctatttttttttgaaatggagtcttgctctgttgcccaggctggagtgcagtggcacactcttggctcactgcaacctccacctcccgggttcaagcgattctcccacttcaggctcccaagtggctgggattacaggcacccaccaccacacccagctaatttttgtacttttagtagaaatggggtttcgccatgttggccaggctggtctcaaactcctgacctcaggtgatccacccgcctaggcctcccaaagtgttgggattacaggcgtgagccaccacaccctagccctgagtctgtttatgcttctgtcaggtgtggcatgggcctgcctgggagctattctttttctgtaaagcacaggcagttaatcagtggtctctgggaagaatccagctcagggttatatttcgtttgacccactcaagttttaaaaagtaaattagttgccaatgtgcaaacattagaagagttcacagcttctccaacaatacctagaagttcatccgatggtgcccgcattccctgctctgtctagatggtgcccacattccctgctctgtctagatggtgccgacataccctgatctgtccagacagtgcctacattccctgctccatctggatggtgcccacattccctgctctgtccagacggtgcccacattccctgctctgtctggacggtgcccacattccctgatctgtccggacagtgcccacattccctcctccgtccggaaggtgcccacattccctgctgtgtctggacggtgcccacatttcctgctccgtccagacagtgcccacattccctgctgtgtctagatggtgcccacattccctgctccgtccagacagtgcccacattccctgctctgtctagatggtgcccacattccctgctccgtccggacggtgcccacattccctgctccatccggacggtgcccacattccctgctccgtccggacggtgcccacattccctgctccgtccggacggtgcccacattccctgctctgtccagatggtgcccacattccctgctccatctggacggtgcccacattccctcctctgtctagacagtgcccacattccctgctccgtccggacggtgcccacattccctgctctgtctggacggtgctcacattccctgctctgtctagacagtgcccacattccctgctccatccagacggtgcccatactccctgctctgtctagatggtgtccacattccctgctccgtctagactgtgcccatattcgctgctggctgcaaatgcgaggagttgacagcagcctcccctttacaaggcaggaggtgccactgttcgccattgtctccacctagggcttcacttgctttctatctgcagacatcagagggacccacatctctctgttctgacacgctgtgtgttgatggcagagtttaattatccacatgcaatcttactttccttattcccaagtccgtggggctgcctcatcaaagcattgtaagaactgataaccatcttctagaagtatcatagtgatattaagaacacacatcacagatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagagggcagtgggtggcgcctcgctgctctgggcacacaccacctcttctgacttctcccacgtgctccggctgtgtcgcctatcagcactgataacagcctggaagctttcagaacagaagctttcccagcatgggaaactctcattctttcttttttttaattttccaaagcctttatttctaagaccaactgtggcctacccgtgcataaactgggcaggctgtagacagcaggcttgccaagtaaatactacagccttcctcccaatattgagccctgtcccattgatcctgcaggggagatgtgtagggcatttgttcacggggaggccacaagtttgggcctctcatcactgtgacctcacacccctgttgagtgtgtcgtaaacagaggagccgttcttcaagccccctgccctgagtgcacccctctcattcttttgttattattagcaaattcccccagttcctgatcattctttcttaagcctttagtgactgggtaaggttcttgtggctgactccaagctttcttctaaaaggaatagattctaggggtgagtagaggagacaggaatgtcggagtcagagctcaggaatctgggttccagccccaggtcaatcctagataaactagagggctccttaacttacttccctaggttgactctgggtttttttatcacgctcgacaggactccttatgcatttcttcgaaagagcatccagtcttaacatcatcatttggcctcatttggtttaagaagcagaattagggtaaaagcaatgatggataagcctcattttggtgaatatgatcttattgagacaagaattctgagtcaattgtccttggaaccaactgtctattgttttcatctttatcacaacactatgtccaaattttggaaacatgtttccctcctagcagaaaagaagccacccagggccaccagatgcttcccgacacttggctggctttgtctggtcttctatccttcccctatccccagagtcagtgggtactaaggtggccagggtcgctcaaggaatcagaatgcaaccgtccagaggcccagaatcagactgtcctctctgattaggaaagtgtttcctgccacctcccagggggatgtggggtgtggcttgagtctggtgcttttaccaggagcttcccagacctctctatgggtgatggagagagagtctggggtgtgaaggatggaaatataaacactgaatactcagagagtcaggccagcgagctggtgaggagactccatcaaactcaatatgaaaacatgggtgggcgtttggggatggataatgaatgacagctgaagtcacacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccccgccccggggcggcaccttctaagggcctgagcgctgcacagggatgggggcgggcggggcctcccagagccgccaggcgtcccgccccactccgcccacacgcacggcccagcccagggttccccgggaccaccccagaccagccccggcccccccgggtcctccacactctgcaccccagaccaacaccaacgcgcgtagggaagcgttttagatcctgtcggagaggctcaaggccggcagaaggtttgcattaggatcgagaaagccgaccaacggacagatctacctaccttcctgcgggagtttgaggttgccaggggggaagccactgcagccaggagaaaggccgtctgggaaccaccccaccctcggacgtgcgggccttcaaatatctctgaacataatcctccaaagaccgctcaacctccgctcccgacgactctttctagcctcgtcccgcaccccagctgtggccacacacctattaggcaaacatttatgaagcacccacttactgggtgtgcagccctgagctgggggtgcagctgtggaccagacaggagggggcccggagcggcagacagtcgctggaggcacccgagccttggcgagcacaccctaacgtccttggggcctttcagcccgagccgtccttgtccagagagcaaaccatgcaatgatgcaggtgacttcccagcaaatttcatagcgttgctcaccagcttggcaggcaagaggagaaggggcagtccccaaaagacaatcccatgaaccttctagggaatgacgtccaggctccaggctcctgctctgcaggcgggtcgcagaggcaggttcctgacctaggactagaagacattctctagggtcactgcctccatggtcttccttggcaggtcacttcttcctgggcttcgacctcggtgttctcatggggacgagggtgattggaggccctccaaggggtgcaccgatgtgtcctgtgcaccaggcagaaccagcattgccctacagtgtgggtgcaaaatgaacccacatggccacgttggaaagtcctgaaatgttcatagcctatgacatgaaattgcactgtgtgaaatctatttattctttttttttttttcttttttttctgagacggagtctcaccctgtcgccccggctggagtgcaatggcacgatctcggctcactgcaacctccacctccctggttcaagcgattctcctgcctcagcctcccgagttgctgggattacaggcaccggccaccataccctgctgattttttgttatttttagtagagacggagtttcgccatgttggccaggctggtctcgaactcctgacttcaggtgatccacccgcctcggcctcccaaagtgctgggattacaggtgtgagtcagcgtgcccagactgaaatctatttattctatggaaaggatcagagctgtagaaaaatccttatgcatgtaaaagttctttgtgtttttacttgcaataactagaatctaaacatccaaaaatagaaaatataggtaattaaattgtagtacatatgatattattctacatagtagaatattatgtggagtccttaaaatgtttacaaataatttataacaacatggggccgggcacagtggcttacacctgtaattccagcactttgggaggccaaggtgggtgggtcacctgaggttaggagttcaagaccagcctggccaacatggtgaaacctgtctctactaaaaacacaaaaatttagctgggcgtggtggtgggcacctgtaatcccagctacttgggagtctgaggcaagagattcacttgaacccaggaggcggaggttgcagtgagccaaggtcacgccactgcactccagcctgggcgacaagagtgaagctctgactcaaaacaaacaaacaaacaaaaacccaacaggggagatctttatattatcatgttacgtgaaaaatacaaaaacagaaaacaaaacaaaaaccccacaaaactcaaggccttaaattgtaaatatgagatgccaggcattattcccaaaatctataaggaagcacaccaaccaccatgttaacattgtctattagtggtaggcctattggagatttattatcttatttatgctacttcatgttttccttccttttttgttttgcaacaactctgtattagtctgttctcacactgttataaagaactgcctgaaactgggtaatttataaaggaaaaagtcttaattgattcacagttcagcatggctgaggcctcaggaacttacaatcatggccgaaggggaagcaaacatgtccttctttacatggcagcaggagagagaagtgcagagcaaagtggaaggaaaagccccgtataaaaccatcagatctcgtgagaactcactcattatcatgaaaacagcatggaagaaccgcctccatgatccaatcacttcccacaaagtccctcctgcaacatgtggggattacaatttggattacaattcaagatgagatttgggtggggacacagccaaaccatatcaaactctatgtactttaatatttaaggaaaattacataaactttatctgaaaattccctggattcttctcctcaaggtcatgctgtacatatgcaggatcctcctgcctacatctccaaatggataatggattgaagcaaaatgtttgtcccaccaaacattgatgtgtaacccttttagtaacaattcatagaccaggtaaacatgtgtggagcagcccagatcagctggagggagcattattctcatcagagtgtggaacaatgcctacccatctgtcagctggttatggtgaagacagtataaatggaagcactgtcagaaactaaaggcttatgtaagtgatgctgttcttatgtctcctcttcctctctatcccacatatgatgaattattttattatgatgatgctgtagttgttattttctatttgaaatgaaaagacatgattacagatgagaaagagtgtattttgttatccttgatgcacttgaaatggtttcctcttttttttttcctgttttcttcttcttccttctctcttcactctttcattcttgcctctctccattttataggtatgattgatcttgaaataatgatgataacagaatgatagcccatatagtccttgggtcacttctgtctctatttctctttcttccctcctctttttttcttggtccttttgctagatgggttgcgagcatggctccctgcccctctcagtgggtttatcttcattttccatgagctcccacctcactgcatgtgacatcaaagccaaagctccagccacttctcatcctttcttaggaaaatctcaagtcttaacttgaaagttgaatgtcctgcttttgttcctaactctgctcacaggatagtggaagaagaaaggctcagcctgttaccagaaagaacagatctgcagtgtaacccatctaggatgaagggtcatgtggacagttcttcactcttccctctggctgcccttcagttggtgtccagatgcccctgtgttagcctgggggcattccttgccctttggcccctcttttgttgcctttttttttcttagacaaggtctaactccgctgcccaggctggagtgcagtggtgcgaccattgctcattgcaacctcgaactcctggctcaagacattctccccgctcagcctcgtgagtagctggaactacagttgtacaccaccatgccttggctaatttaaaaagtctttttgtagggatgggagtctcaggctggtcttgaacttctggcctccagtgatcctcctgccttggcctcccaaagttttgggattacaggcgtgagccattgtgccctgccctttgttgctttttcactcctttaccctgtggtttctactatcctcagggacaactctcattgccctggggcttctggatcttcagcaagacacacccctaaaggcaaacaatctttctttagcagcagcagagcacaaacggagtgttgctgtatgctaaaagcatactatttcccccccatgagaaagtctaaggggtccaggggtcctgaagtccctatcctgcccccgccagtgacaggtgatggggaacagaatgctgaaagagaccccacccaaccatctggtgtgtcaacacccgcccctgccggtgctgtccacaggttgatccccatcccacatgggtggcttaacacattcatgtcttctgagagccatttgttgctccccagtctcttctgtcctccttctttgaccaacatttccctgtctgatttgcttggtcacaggtagcctgtgtcagtttcctcccaggactctctttgcctgggaataagtgctatacatgagaagcatccctcccaagcgctgtgtgtggcctcctggcattctcctaagacttcctagaggattgctctggttccaaaaagaaaccagccacaacctgtttggagccctgcaggatgttccagctcaccgacttcattccccactacttgcccctctaacagagcttctagaccagcagccaaggtgcctccattcactgtacatgactcacctttcccccttctagacacttcttcacgggtctagcctctgtttccagctttacacagcacaggctgatgcctgccactgaacgggatccaggactttttcaaatctcagatccccagcaaaggtatgacaatgggcaccctgaccagctctgagcctctaagcatagggtctatttgtttaattttgaattcacttttaagatttaaaaattgagagctctcatcttcaacaaaattcaggggatctagaaacatcatgcccacttgtggcagagtagccaactggcagaaactgatgctgatgctgtctgtttcctacacaaaatgcaaaccagagtttaccacaggccccgctactccacattctcctccacaaggacactcagcaggctcctgtgctgaacggcttgcctggttctgtaggtgtagggtttgttactctgttccaggacctattttccgcaaagccccttacctggctgtttcttcccttggcatacgtgagaactcctttcctcactgaattgctttgaccttgctaattagttgtgttgcaagtgctttttggctgtgtcagacatgtatgttctgtttatcattttagagcaatggttattaatttttttcagattcttcttgggaattagagaaaaacttatggctctcctccaccatcctgcccccacctaccccaatgcacacatgtgcaacatttgttctacaattcaagagctctctagacccctgatatgctaggcaattcgtggctgccacattaggaacccctgatttaggggaaggactgttttctccattagacaaactcaactgtgtagcatcaatttcatgggtctactgtgtactgtgcccaaaaaatgccactgaatgctgcctgactggtggatagcaagactgtccattaatgtggtcatttaggttgcctctgcccaggtcttgaggtcattggcactaattcacaacaccctcaagtcacccagggaagatgagacacagttggctgtagacccacagtttgggcattacagctgcccttgaagttgacaaataaccacaaccttcaaattgttatgaaaagagcacaaatccaattaagaaagcttttccaaaagaaataacagtgttcctaccccctctgtcactctccaccccctttttgtcccagaataatgttgtgctgataggaacatggataaattaattacagtctggaatgttattcatgggtaggaaagaacactaaatctactcgcacaatgtttgatatttaaagataaacattgcctttatgttttttttttaaacctcagtcagcctagtttacgaagacataggtataatccttttaaatgctgtggattttttaatcgcaaaggtaacaatatgctgggtgttttacccagccagagaaccaggagatgcaggaatgagattagcatctctttagttccttgcatatttgatattattttggtgtacctccaattcctgataacatagaagaactcttgtggttgaagtccctgaaatggaaggatattggtaaccctgaatttaaaacaagcacaggcagcctttgtgggaatgtgtgtgaaggtcaccttctagaaacaggactgtccatagccattgccatggtttctgtgtcatttcaaccagaaccttaggcctggaagtctggatggatgtgggttggcatggtcctctatgggcattaaatgaataaatggatatagcagagggagtatccagcatgactcaaagaaggatgagaggaaacatattcaaataaaatctttagaaaagcaaatttcaaaaaaaaatgcttaagtataaaatattttgatgacaaccatgattttcaaattgaattcttattctaagtaatggtctaatctgaacttagacctctttccttaatttttttctcaataagcctttggtgtctagtcagttcaattcagtatttactgagtctctatacagacagggtataaggcattaatcaaatgtatgtccaaaattgcccaccatgcagggcagagctaaaatgcctaacacccctcctctcaccaacacatcccccacccacatctccaaagacttcctggcagaggtgatctctgcctgctgggacagatgtataggctccaacagcagcagggtggcccctctgaccaccaccttgggacccacattgctcttagaactattcctcttttttcatccttgaagcccccagcaaagctcagcctgaatcaactttttctaggaatctgacaagtttccaggctgatttcctgacccagtcagatcctcttccatctttctttgggtgttcaattttctacgtcattttccacctcacatattggccgttgatgaccacatcagctcttctatgctgtaagctcccaaggaacaaattctatcaaatgattggcctttcagctctctactgtgaccagaaagttgcccagtacataaaaaggggttcacaggtatttctcacgtggataactggtgactcatctatccatgattttggggatcccccacttcctggactaattgtaaaccaccttctaccacctgggggtgcctgagcacaacagagctaagtgaacatttcatcagtctaattgaattcagtggaatgttgggggcctggaaatttggactaggaaggtaagcaggaggaataagtgtgaatgacagtatctaaattaaaatctgttgccacgaaagaagatcagaccttttctcctctgatttgtccttctagaagtcacaagatgcccaaagaatcataagcaatgggtaactaggcaagggaattatctctgacaaatgccatgattgctcagtgtcccatttctcttggcagcaagagtggcccaaagactaaactgagatgggggtctgcacccctgcatgggactcaggctctgcagctagccttccaaccactaaacctgagctgaggtacttttagctctttatttcttgtttttctcatttgtcactcagatgagaagaatgcccgctctgtttgactcagtgtcagcgtgatgaagtaaaacagcttctttaaatccctctgcaacaaggcagtgaattgaaaataagaaagatagggaagaacattctgggcaagacagctcaatgagttcatgctttgatcgatctctcagctctgaacacaaagccatgacaggtaggtataaaaatagaaagctaaaaagagatgtctggctcaacagaagcagaagagacactgccagaagcctctgacctactgggctctttgtctaaaatcagcagggagtttggcctctgctgggcaaatccaagacgccccacccaagatggcagacaggaaccaagtacttgcttaaagtcaggaactagggtggggccccgaaagaaagacagtgcctcactgctgcctagggaccaaggttttagaaaaataaggttgaggggccaagatggccgattagctgctgctgcagtccgcggctctcatggagaggaatgaaaacagccagtgaattcagcaccttcaactaaaatatccagattctcggccccactcggactagtcagacaactagacctatggagaatgaagaaaagcaggctgggaaaatggtccacccgagagcggcacggagccaaaggaagccccaccccagcaaagggaagaggtgagtgagtgtgcgacaccacccggaaaaccatgcttctcccatggatcttcgcaacccgcagatcgggagatcccttcatgagcccatgccaccggggccttgggtccgacacacagagctgtgcagagtcgtggcagagcggccactcaggcacacacaaagacccaggaattttacatactccagcccaaggaatcccagcaaggcaggagatccattcatctattcccccaggaagggggctgaacccagggagccaaccagcattgctttgcaggccccgtttacacagcacctcacaggttaaggcccactgtaatttttgccagccagtggtgacagcctggagtcagcctgagatggactgagctctcgtgggtagaggcagccaccatctctgcggttcagttgactcagccattctagcctgccagctccggggagtccagacagtctggacaaggaggagtctcccacaacgtgtagcacaggtgctgtgccagatcgtggccagactgcttctttaagtgggaccccgatccaatcctcctcactgggtggggcctccctgtgggaatttcagcagctccagccagggttatatggaaaatactctgctctctcctgggacggagacccccatgagaaggggtggccgacgtcgctgcagttcagtggactcagtctttccagcctgctggctctggagagttcaggcggtctggaggaagggtcccctcaatgcagcacacccgctacacctgctctaacaaaaagcagccagactgcttctttaagtgggcccctgatcccgttcctcctgactgggtgagacctcccaacaggggtctccagagacctcccacaggagcgatcaggcaggcaacatgtcagtacattcctgggatggagaaaaatgagcaggctgccatcttgctgttttgcagacttcactggtgatacctccgggtatgggaaaaaccaaggcaactagggtctggagcagaccctgagcaaaccacagcagccctgcggaagagtgacctgactgataaaagaaaaacaaacaaacaaacagaaagcaccaccgacaacatcaaccaggaaaaccccattcaaaggtgagcaacctcgaaaatcaaaggttgataagcccacacagatcagaatcaatacaaaaacgctgaaaactcaaaaagccagagtgcctcttctcctccaaatgactgcaacacctttccagcaagggcatggaactaggctgaggctgagatggctgaaatgacagaagtaggcttcagaaggtggctaataatgaacgtcactgagctaaaggagcattttgtaacattaaaaagtggggaaacgacatgaacagacacttctcaaaagaagacattcatgcagccaacaaacaaatgaaaaaaagctcaacatcaccgatcattagagaaatgcaaatgaaaaccaccatcagctaccatctcactcccatcagaatggctattattaaaaagtcaagaaacaacagatgctggtgagattgcagataaaaatgaatgcttttaccctattggtgggaatataaattagttcaaccattatggaggacagtgtggcgatttctcaaagatctagaggcagaaataccatttggcccagcaatccctttactgggtatatatatcattctattatatatacataaaataggaatacaaaacatgctattcctattatatgtgtaataggaatacaaatcattgtattctaaagacatgcatatgttcattgcagcatgattcataatagtaaagacatggaatcaacctaaatgctagactggataaagaaaatgtggtacatatacaccatggaatactatgcagccataaaaaggaaagagattatgtcctttgcagggacaccgatggagctggaagccgttatcctcagcaaactaatgcaggaacagaaaaccaaacactgcatgatctcatttataagtgggagctgaatgacaagaacacatggccacgtgaggggaataacacacactggggcctgtcagggaagggggagagagagcatcaggaagaatagctaatggatgctgggcttaatacctacgtgatgggttgatctgtgcattttgtaaccaaatgtacctgtaatttatgatccaattcaagttgaattttttataaaagataaaggaaagattaggattatgtttttacatagaaatgcacaattgtttcagtacaaactaaagagattttcagaatttcatagatgaaaacaattcacatttgctaaaatgtatcctattaatactaacggttgtacttcagccataagaaaagaggacagaagggaatgtgtgaaagtcagtattaaatggtagtcaattaaaaataaaataaaaattttgaaaggtaaaataataattactgaaactgataaacaatattaataattttaatagccattaaattaacaaaataataataattagatttggaattttttaaagaataagatgagttaaatgggtgaaagtccacagaaagaaagttttctgggtccttgatgtgatcgggaagaaaacagaaatatttaacaacagaaattttgtaggaaattcatagtttactaagtatgctaaaattttatagataattacaaaaaggatataagtaatctataagttgcaaagcaacaaaatatattcttttgtgtaaataaaagggaaaatagaatggtttctcacaccaatgagaaataggagggaaaaatactttaagagaaaaagttgtgaaataaaaatcaaaatgtaacatggtaaaaatatatgcaggtacatcaataatcataatatctttaaatagaataagcacacaaaagactacaatgattacattgaataacaaaataaaatctaattatatgctgcttacaagatatacatttgaagtaaaaccaaattgaaaagttgaaaattaagtaataaaaaaatactaagcaaaggctaacacacagaaatctaaggtagcaatattaacacaagacaaagtaaaaattcaggtgattaatagtatacaaagatcacccaatttaataaaaggaaacagtctgctaggaaaatattacaattatgggtatgtagttaactatacagactcagcaaatataaagcaatcctggcagatttataagacattgatatatctatctatcttatcaattcccttaaggggaactgagttgtagggagccatttaacacacttctctcagcaactggtagatctgccctccccaacatagtaagcatatagaatatttgagtgatgaaattaacaaagttcattaaatatatatatagagagagcactacacccaaccaataaacaatatgcatttttttaacaagtgttcacggaactttttttaccatttggccatgtactagatcatgaaagaagtctcaagaacattttaaatattagttttacatacgtgcttggctctatgatcaaaatgcagttaggttataaatcagcagtaaatttatggtcaataaatcttcacatatctgaaaaccaaaaaccaagtacatgtctacttaacccattggttagagaagaaaacattttagaaacaataaaatactaaatgccatagaaaatactatatatgaaagtttctgggatgcagctaatgtggttcttagaggtaaattgacagcattaaatgaatttttgaaaagaaaaatgatagaaaataagtttaactaaaaaaaggagacatatgaaataaactaaagaaagtagattaaacaaaattttaaaaacaaaaattagcaaaaatgaaaatgaaaaaggagagaagagctactagatgaaaagctactcaaggaacacaatttgaagatttaaataagatatatatttttctagaaaaaaaacatgaacttccaaagtcaatttatgaatagagcttcatcataaaactggaatctataaaaagtatcagttcaatagatggatttactaacatattagacacagctgaagaaattatttatgaattagaatgtaagtcagttaaaaatattcagggtgaaacacaagagaaaaataatgaaaaatacaaaaaaagagtataagagatgtaaggaaaaggattaagagaagtgcagttagaggctgagaagtacagaagaaagtgaacagagcagaagtgatatttgaagagatagggactgagaattttccaaaaactgattttaaaaatgaagccatgggtgaaagaagtatttaaaacttcaagaaaaattactttaaggaaaatcagaatttcttagtgcatcatattaaaatgctgaaaacaaaaaataaagagaaaatcttacaatcagacagaggggaaaaagatatacaggaatcaccaataagatagatactgtatctcatttctcaaaaggaagattgaatactatagaaaattaaatggcatctttaaagtgctgaaagaaaataactacccacctagaattctatacctaatgaaaatgtcctttaaaaatgaaggcaaaataaaggctctaataattcaaggagcgttctgtaatctctaatgttttaactaaaataatgaaagaatgtataaataataatggggaaatatgaaacaaagaaaaatacttcattaatctaaaaagcataagaaataataagtccatagacaagtgtaacaaacagaaacattacagagttggtaaaacttgaggagaaatagatgaatccactattcaacactactttaacagaaacagacagatacagcatgctaaaaatcagtgcgaacatagttgaattcagcagcaccatcaatcaactggatctgattcatctaaaacgtcatccaacaacagcagaatacacattcttctcaagctcatatggaacactcaccaagatagaccacattctgcgtcataaaatacacttggcaaatttagaagaatcaaaatcatcctatgtctgccctcagaccacaatggaatgaaaactagaaatcaatgacagaaagataacaggaaaaatccccaactacttggaggttgaacaatatacctaataacacatgagtcaaagaagaaatctcaaggtaaactttaaaatattttgaactaaatgaaaataaaaatacgtgttgtcaaaatttgtgagatgcagcaaaagcagtgtttagaggaaaagttgtagcattaaatgcatatgttagaaatgaggaaagatctaaaattaacaatcagctttcagcatggaaaactgaagaagaacaacttaagcctaaagcaaatagaaaaaaaaagaaataagaaaaattaattaaaaataggaaataagtgaagaaaatcgacaaagacaaaagctggttctttgaaaacatcaataaaattgacaaacttctagtcaggctaagaacaaaaaacgggagacacaaattaccaacattagatatgaaagagagtcatcactactgatcacatgaacaacaaaatgatcatttaaaaatactgaaaacaacattatgctcacaattttgaagaactttgatgaaatggaccaattctttgaaagacccaaactaccaaaactcacacaaggaaaaatagatctgaataggcccatatttattagataaattgaatcaataattaatagacttccaaaaagaaagcaccaagctaacctggtttccctggtaaattctatctaacacttttaaaataagtgatattaattctctgtagtctctttcagaaaatagaagcagaggaaacacttcctaattcattatatgaggctaacattatcctaataccaagagcagacattacaataaagggaaactacagactaatatctctcatgaatgtggatgcaaaaattcacaacaaaatattaacaaatcaaatacaataatgtacaaaaagaattatacatcacaaatgagtgagatttatttcaggtatggaaggctggtttaacatttgagagtcagttaatggaacccaccacaccaacaggctgaagaaaaaaatcatatgattatatcaattgatgaagaaaaagcatgacaaaatccaaacccattcatgatgaaaactctcagcaaactaggaattcaacttcataaagcacatctacaaaaacctacagctaacatcatccttgatggtgagaaactgaatgttttctccttaagatcaggaattagaccaagatgtccctctcacaactcctattcaacattatactggaagttctagcttgtgttaaaaaacaagaaaaggaaataaaagacatacaagttgggaaggaaaaaataaaactgtctttttcacaaatgacatgattgtctatttagaaaatcccaagaattaactaaaatttcttggaactaataagtgattttattagtttactaagactgccaataacaaaatacaacagactgggtgagttaaatgacttaaatttattttctcatagttttggaggctagaagttcaaggtcagggtgtcagcaggtttgatttctcctgaggcctctctcctcctcttgcagatggccacatttttgctgtgtcctcacatggccttttctctgtgtatgaaaatccctggtgtctctttctgtttgtctcatcttcttagagggacaccagtcagattgaattagggtccaccctagaggccttattttaacttaatcactttttaaagtccacatctccaaatgcagtcacattctagggtactggggattagggtttcaacatatgaaatttgtggagggacaaattcagtccataatagtgattatattatagcaaggttgcagaatacaaggttgatacaggaaagccaatggctttcttatatactatcaatgaacaattaaaaatacaaatttaaaagcacaatatcatttacaatagtaccaaagaaagaaggaaagacattaattctcaggtagaaatctacaaaaacatatacaggatctatatgcagaaaactataaaactctgatgaaagaaatcaaatcaaatgaaaacaaatggagagatatttcatgtccttggattggaagactcaatgttatttaaaagacaattcactgtaacttgatctatagattcaacataatctccccaaattccagcaagctactttgtgcatatcaacaaactgattctgaagtttatataaaaaagcaaaagacataaaatagccaatacagtattgaagaacagagttgaaggctgacactactgacttcaagacttaatataaagctccagcaaggaagacaccacagtactggtgaaagaatagacacttaggtcagtggaacagaatagacaggccagaagaggactctcacaaatatactatagtcaattctctttgataaagaaccaaagacaattcaatggagtaagggcagtgttttcaacaaatggtgcataacaattggacagccacgtataagaaaacaaatctagactcagatcttacacctttcacaaaaactaactgaaatagatcatggatctcaatgtaaaatacaatattttcagatttccagaaaaaaaaaagcagaaaatcaatgtaaccttgaatttagtgatgagttttaaaatacaagccaaaaagcatgattcatgaaaaaaatttataaattatacttgattaaaattaaaatactatgttctgtgaaaaatactgttaagggaatcaaaagacaaggcacagattgggagaaaatatttgcaaaccacctatgtgatacgggaacttgtatccaaaatacacaagaaactcttaaaaaaacaagaaagcaagtaatgcaattttaaagtgggctaaagatctgaagagacagatcaccaaggaagattcatagaatggcagatagaaagatgcccatcataatttacggctgggcacagcagcaccagctcctcagaaggctgaggcaggagggccccttgaaaccaggagtttgaagctattgtaggctatgatgtgcctgtgaacggccactgcactccagactgggcaacatagtgagagctcatctttaaaataaataaacaaatgaataaataattaatttgtcattagagagttccaagttaaaacaatagcaagatgccactacacacctatgagaatggttaaaatccaaaagcctgacaataccaaatgatgacagagaggcagagcaacaggaactcttgctcatcgctggtgggaatgcagaatggtgcagccactttgaaagacagtttggctgcctcttacagaactaaatatagtcttagtacagaatccatctgctgtgctcctagatacttatccaattgatttgaaaacttatgttcgcataaaaaaatctgcatgtaaatgtttaaagcagatttattcataattgccaaaaactggaagcaactaagattctgttcaacagctgaatgaataaacaagttgtggtacatctatatagtggaatacggaatataattctgcaataaaaagaaatgagtattgagctatgaaaagttgtggaggaatcttaaatgcatactgctaagtgaaagaagccagtatgtttatagcagcatgatttatattcctttgggtatatacccagtaaactatgcaaccataaaaatgatgagttcatgtcctttgtagggtcatggatgaagctggaaaccatcattctcggcaaactatcgcaaggacagaaaaacaaacactgcatgttctcactcataggtgggaattgaacaatgagaacacttggacacaggaaggggaacatcacacaccggggcctgttgtggggtggagggggggagggatagcattaggagatatacctaatgtaaatgacgagttaatgggtgcagcacaccaacatggcacatgtatacatatgtaacaaacctgcacgttgtgcacatgtaccctagaacttaaagtgtaataaaatacatatatatatataaagaagccagtatgcaaaggctacatattatatgattccaattacataatagtctggaaaatgcaaaactgtagagactcgaaagtgatcagtgagttccagggttaaggtggagggtagagggtgaataggtgaactgcaggtaatttttagggcagtaagattattgtaatgtaaaattttagggcagtagaattatttaaatggtggatataagatattgcgttgcattgcctatgcaaccaaaggtgaaccttaatgaatgcaaattttgaaaaattatttaagaggttgggggatcccaagagagaatgcagaccatgagaagagaatctaactgtattacaaatataggaaacactctcactgaagggatgggtcggggaggggaagagaagaatactgaagtattttggaaataagtgaggcttataagattaaaggcaaagggaactgcatgtgagcactgtactctagttgaaaaaattgtttcccatagaggtactggttaacaattctgttattgctatgtatttatactggaatggaacaattacatgaatggatggcagatggtagaagccaggtttctcaccactggagtggctgtttatcaaaaagcaggaggagaaagaatcattcatgcagtgatggatttgagttggagagagcagtgtggactcatatttagctcaatagagaggctgatggttatctatagaagtatttatagatatgcatatatacatgatatagtataaacatgtgtgtttcttgctctgtccctgaaacagcctgaaagaaatgacatcccagtaacagcaaacgtgcacagcaccgtatcttggtttctaatactattctccatttaaacgaaccaggattctttggagaagtggctgtttctaagactgggacaggaaatatccaagatgagcctaaagcatctggtagtgccagaaagtaaggaggtgctcaagaacaaaacaggaccaaacaaaacattgatcagggtctgtcaaaggagcacagatgccagctaaaagagttcccaatggccaaagctggaacactttgcggtaataaagtagtattggattataacctacagtataaagtaaatatgcatggtataaatacatggttaaatatattaataaatgaggaagcagagacaaatctctcttacaaaagaattccatatattttacacaggtactctgtcttcaagaagaaggaatcaaactccccattccttcagtgtgagctgtacataatgacttcctcccaaagtgtacaatatagaaaaggggagaaaaagagtaaatttacagtggaggaccctgacaagcgccactcaggcaggcgaccaaggctaccttccgcactcataaatcatgctgacagtaggtacgcttgatatcacgggatgaaaatagcacttcacctctgtgattttctttccaataacttacaaccccagttttctaatgagaaaaatatcaggcaaattccaaaagtgggacattctacaaaatacctaagcagtcctcagaaccctcaatgcatctaaagaaggaaagtcggagaaactgccacagacagcaggtgcctaaagagacatgacaactaaatctaatgtgggattctggaacagaaggaaaagacattaagtaaagactgaaagaacaaaattatgaacttttgttaataacaggtcattatttgtttcattgtaacaaatgtaagatatcgataataggggaaactggatgtgaagtatattgaaagaattgaacaatgaaaacacttggacacaggaaggggaacatcacataaccagggcctgttgttggcgggggggatggggggagggatagcattaggggatacacctaatgtaaatgaagagttaatggatgcagcacaccaacatggcacatgtatacatatataacaaacctgcacattgtgcacatgtaccctagaacttaaagtataataataataaaaaagaaactctctgtgccatcttctcaacgtttctaaaaatctgaaactgctgtagaaaataaaatctattttaaaaaatttaaataagcaaactgctcactactacacaaaaaaagcaaagattagtctcttgagtataaaattgagcagaagaagccagacacagcctgcaagctccaactccattcataaagagtttgcaaactggcagcgatggcgcgagagcttaggaaattgtttcactgggggaagtggaacagacgttgactggatgatgtcacatgaggggcttctggggtactattaacattcgatctcaaatccaattggtggttatatttttgtttccttaaattaataagtattaatttatgaaaattaattgaaatgacactcataatctgtgcacttttctgtacaattcaataaacttaatgataaaaacaagaatgaatcagaactgtgtatatcaacatggatcaatctaaaaagcaatgttgattaaaaaaatttaaaaatatgtccgggtgcagtggctcatgcctgtcatcccatcactttgggaggccgaggtgggcggatcacctgaggtcaagagtttgagaccagcctgaccaacacggtgaaaccccatctctactaaaaattacaaaaattatcatgcctgtaatcccagcactttgggaggccgaggtgggcggatcacctgaggtcaggagtttgagaccagcctgaccaacatggtgaaaccccgtctctattaaaaaatacaaaaattatcatgcctgtaatcctggcactttgggaggccgaggcgggcagagcacgaggtcaggagtttgagaccagcctggccaacatggtgaaaccctgtccctactaaaaatacaaaaattagccaggcgtggtggcatgggcctgtaatcccagctactcaggaggctgaggcaggtgaattgcttgaacccaagaggcagaggttgcagtgagccaagatctcaccattgcacttcagctctgggcaacagagtaagactctgtctcaaaaaaaaaatacaaaaattagccaggcatggtggcgggcgcctgtaatcccagctactcaggaggctgaggcaggagaatcgcttgaacccgggaggcacagattgcagtgagccaagatcgtgccattgcacttcagcctgggtgacagagcaagactccatctcaaaataaataaatgaacaaataaataaacaaagcaatgttgaatgttaaaaaagtaatttgtcaaataataactaaaatagactactttttttatacgtaccttctgtaaaacaaactatgttcttatttatgggcttacaaaatttagcctaagtatcaaaacacacttgagattataaataccaaattcatgatagcagttatctctgcaaagagaggaaagaaaatgaaattgaggagggggactcacttttttttttttttttgagacagagtctcactctattgcccaggctggagtgcggtcgcatgattgcgactcactgcaagctctgcctcccagattcaagtgattctcctgcctcagcctcccgagtagctgagactacaggcgcacaccaccacacctgtattttttgtagagatggagttttgccttgttagccaagctggtctcgaactcctgacctcaggtgatccacctgctttggtctcccaaagtgctgggattataggcatgagccaccatgcctgaccaacttctacctatactgttgcatgtatatatatttaaaaatccaaaaaacatattgcaaaatgttaagttgtgatacagttgggttcagctacaagggtaaccatgacatttctctataactgcttctagttttgaaatacatatatatgtatacacacacacgagtgtgtgctctataagaacatgtaactaatattgtatagtgcaataacagcctaggagaattaacaagcattttgccatcaatacttatcctttgtgttgctgaggatgaatgaacccatagatcattagtctttgaagccgttggcttcttttaaaagtggttctaactcgaagactaatgacctttgcatttcaccagccccaccttgttaatctcatatctttcaagacatgtacactttgggaggccgaggcgggtggatcatgaggtcaggagatcgagaccatcctggctaacaaggtgaaaccccgtctctactaaaaatacaaaaaattagctgggcgcggtggcgggtgcctgtagtcccagctacttgggaggctgaggcaggagaatggcgtgaacccgggaagcggagcttgcagtgagccgagattacgccactgcagtccgcagtccggcctgggtgacagagagagactccgtctcaaaaaaaaaaaaaaaaaaaaaaaagacatgtaatcccaaagtttccttgaagataaattacatttgctgacaggactctttagaaccactgagaacagtcagatattggaggtcaatgaggaaacaaccccactgctgattcactccatagcatgcactgagcacccacatggtccacatgagatgtgatggggcttgaaccagtctggctgtagaggggaaagaaggagagaaacagatctgagaagcattttgaggcagagctgtcagaagtcaccaaatggctctgaataacatggcggagtccaagaggccagaagaagaatcaagaacagccagggccggtttgagcagctgtgtgaaggctggcaccattaactagggtagaaagcatggtggagaaatggggctggctaagcaaagttgcgggttcaatcaagaagtttgcctttggaatgtgtcatggttgagatgcctttcacaatccaagtctaggcctggtgaggtggctcatgcctgtaattccagcacttcgggaggctgagatgagaggatcgcatcagtccaagaatttgagaccagcctgggcatcatagtgggacctcatctctacaaaaaaacatttaaaaattagctggctgtaatggtaaatgcctgtagtcccagctacttgggaggttgaggtgggaggatggcttgagcctgggaggttgaggctgtagcaagctatgattatgccactgcactccagccatggtgacagagcaagacctcatttcaaaaaaaaaaaaaaaaatccaagtctagatgtgaccaggtatgtggaatctggagctcaaagaggagtcagactggaaagatatacacttggatgtcaccagcatattgatgttgcttcatgccatgggacccaatggggcccccccaccctggaggagggtagttagagaagagaggtctgaggatcaagtcctgggatggttagagtttcatagaggagcaggaacataaataataaaggccaaccacataaggaaaacaaaagctatatattcagggtatactgtaacaagggagtcgtcaccatcacttacattttggtagagactccaaggcaagagtgggaaagtttgacagtgatgttaaccaaaaactgacagaggcaggtgtctcaattgatagcggtttatttcgccaaggctgagaatgtgcctgggaaaaactcgagtcacaggaacatctatgacctgtgctttccaaagagggttttgggaattcagtgtcgaaaaggcaaagaacagacaggagggaaaaaagcgagggagggtgggcagtgaggcaaatggtaacattattgtgaggttctgattaacgctcagtaaattggcattttacataaaataaagcaaacacgtgaaaagaggaagtatggggaaaagtcaatgatgcatttatctcagggtggatgaagggatgatttctggtcttgtccttgtcctcttacctgtgaagataaacttgtaattgacattgttagggtgagattgaacagaactcagtttcggggctagcttataggggggatatgtatcctataagatttagggctcacacagaatttccttgtgagcaatttgtgaagaaggccatctggggagatatgtggcctcctatctttgtgggaacctggcttatgtatgacgttatgacacagggttttgaaattacagctatttgagaacaaaagaaaggcagtattgcatgactcagttcccaagcttaactttccctttggcatagtgagtttagggtcctgcgattttgttttctttcacagtggaaaggaagggaaggctgcaggtgcaccctgatgggagtctgttggcatggcgaagccctaggtgagctaattaggggcagggtgtcccatggaattggctagggatgcatatttggttttctctggttggtcctaaaattaaagtgaagacaaaaattaggggagctgtcagttattaatcaagtcctggtcattgtgggccaactgttatggatattattatttaacttcctgaattgttactagagatagcagtccggctttctatgagtctgacttatagcaggctggcttccggttgtttattgtagataaaggggttgggttcctggcaggtagctgcaagctgtgagtcatagttctatttatatatcatgtggccattgtccatttgtatatttagtctcttgggagaaaaaagccgaaaaggagattgaaaggagcagctagagagaggagggaaactaagacaatatcatcatcccagaacttaggaagataaagtcccaacaagaaaggggtggttcactgaagcaaatgctgctaaaatgtctgataagatgaggatgtcaaagtaggtgaagcttttccaggtgaaaaagagacgtagccatcattgttgctgaattctcagacacaggaaacattttcctgtggcttcaggcaatggtgaaataggaactaacagggtcagctaggaagagaaacttttaatgcctctagggggcacagcatatcatacctaacaactgagcagcaaataccgtcccctactctccagacgcattttccagcccaacatgggattcttagattggttagatggcagcatctgagaccacaattaacctgaaatccaagctcaggcacttgcagctccaaagcctcacactcgatgctccgagtttagggacttctatcaagtaaattgggaaatgggtcgttctcctttgaagactgttaggaaagagggacaaaaacggaaaaaaaaaaaaatcaatccctgagtttaatctccagtattccttcccagaaactttaagttagctacaagaatgttaatcatgagcagaaattgtttaataatcaaattatcataaatttgcttttcttttaccttagtaaggtaactatgtgacaaacatttgtgaagttgagaatagataaaagtacccatcatatgatctagccatcccactgttggacatatacccaaaagaaaggaaatcaatatcttgaggagatatctgcacttccatgttttttgcagcactgtttacgatagttaagatttggaagcaacctaagtgtccatcaacagatgaatggataaagaaaatgtgatacatccacacaatgcagtactattcaccccttaaaaagactgagatcctgtcatttacaacaacatggatggacatggaagacatcatgttaagtgaaataagccaggcacagaaagacaaacattgcatgttctcacttatttgtgagatctaaaaatcaaaataattgaacacatggatatagagagtagaaggatagttatcagaggctgggaaagctattcgggggctggtgggtgggtggggagagatggggatggttaatgcatgcaaaaaataactagaaagaatgaagaagacctactgtttgagaacacaacagggtgcctatagtcaataagaagttaattgtacacttaaaataactaaaagagtatacttggattgtttgcgacacaaaggataaatgcttgagggggtgaatacccctttcttatgatgtgcttatttcacattgcatgcttgcatcaaaacatctcaggttctccataaatatatacacctattatgtacaaaaattaaaattatttttaaaaagtgccaagaaactctgtaccctaacatagccctgttagaattacttagcactaatagttgcctttgctgagtgatgcaagcagatgtctctggccctcaaagatgaggagacactgctgctctgcttggtgtgaacataaactccagttcttctgggaactgccttaaagacagcagaaactggagagcagagaaaagtggaaagtggccaggcacggtggctcacacctgtaatcccagtactttggtaggccgaggcaggcagatcatgaggtcaggagttcgagaccagcctgaccaacatggtgaaaccccgtctctactaaaaatacaaacattagccagatgtggtggtaggtgcctctaatcccagctacttgagaggctgaggcaggagaattgcttgaacctggaaggctgaggtcagtgagccgagatcttgccactgcactccagcttgggcaacaagagcaaaactccttttcaaaaaaaaaaaaaagtggaaagcataaccttgcttgatggtgaggttgaatccccaccttcgcctttctcagatttattcccatcttcctactcctccaacccctatgttggctcaagcccagatggctctcacctgcattaacctaaccatctcgtaacccatctcctctctttgttcctttcctatgcaccctccacatggccagctgccagaggatctttcaaaatgactaatcttactattcttctcctctacaaagcttcagaggcttccagtctggactccttaacaacacataaaaaattcctcttctgttcttcctctggctggtggctctcaaccttggctgcacttgaggatcctggggagctttaaaaactgccctgctctggtttagtcagtctgggctgggtcccaggtgtctagagttttagttttgtttcccaggacctggtgactccttgaactatttgcagattcctgaacccctgtcggagagtaagctgtgttctaatctcatcagatctaaggagagatgtaggaacttgccttgaggcttgaattctttctcctactctccacttgtggtagtcagtcttttgcatttaagggtcaaaaataagaaggcctattgtgtttccaaggctggggtccatagtgcatacgataggtttcagagggagagatggcagtggagatggggaaagaaaatgtggaaacctgagtctaggatgttgcttgctaagtgtactagaatatgccaccccaaatatgcctctttggcatataattattttgagctgaaggctattgagaaccagcagatgcacgaaaggtctaaaaacagagtctaagttttccttttgtaaaggattgtagaggtgtctccttctcccaggaagaagactcttaactactcatcagaggagaaagggcagacttaattctgcacaacaaatcttactaaacacctcttgtttaccatccttttcctggttaacttctcataagttgcctcccctacacagaagccccaaccccttcttttttgttttagcctaagatggtatttaacccccagtctaaccacccctttgggttactcacctcttagtgttcctgtgtgtacacagacaacgaacttgtaagtagacttgtttttctcttgttaatcagtctttggccagtctaacttataaggtttcagttggaaaacctaagatgggtagaggaaaagattcccctgcaacacacttatattatgaaaccaaactggataccaagcaaggaggatcgggcatctaacacttaactcctgacctccacaatagcttgcaggtaagggtttttttttttttaatatatatatgtatttttatttaagttctagggtacatgtgcacaatgggcaggtttgttacatatgtatacatgtgccatgttggtgtgctgcacccattaactcgtcattttttttgttttgctttttgttttgttctgttttttttgagacggagtctcgctctgtcgccaaggctggagggcagtggcacaatcttggctcactttaagctccacctcctgggttcaagtgattcttctgcctcagcctcctgaatagctgggacttcaggtgcctgccaccacacccggctaatttttgtatttttagtagagacggggtttaaccatgttggccaggatggtctcaaactcctgacctcaggcaatccacccgcctcggcctcccaaagtgctgtgattataggcataagccactgtgcccggccacaggtaagggttttaaaggcaggaggcagaggttacaggcaaaataagaaatcatggaggttatacattggtttaacctagaaaggtggaacatcttgaagtgggcccacaggtcataggtgaggcaaagctttgtctaaaactgtgggatcagtagaaaagaatgtcagctctggctcatgggtgtgacttcctccaggctccccagggagaaatttagaacaaagaatggcagtcagaattcagtcctcaattcctctttatctgaagtctatgtgtcagtggatccatttggtggatccattggtgggggtccaggtttctgaaacaactctgggacatatgttaatggcacaggacttttttggggtgccacttcaccagccagagacctctgcagctggctgcacccctgcctgggcctcactcagctctgagctggcctctggccttgctccatccagttggcccagcaggctgcacccagctcaccctaccagccaccacaggtgagccaggtgtggagtggcaagtttgcagggtccagttactgtgcacagtcaggtgcatcagctgctgcaatggaatgagcagctccaggtgctggcatccagactaggggaacacagtggcacccaaaaacttggagatgccagcacctgtgaagccccaaagggggtgttacatcatgtcacagcactggctccagaagctctgaggtctagatgtccagaagggttgcagctcttttctccttcccgccactcacagtgcagaaaatgggggtatgttaacagctcattcagtcctgctgccctgctctagcttgtggctcctgggaaggcccggccctgctgccatttcccatcacgtgggacggatgcccagcactggcggagggtgggagggctacagtgttacagcagctacttttgcacccactgtttggtgggtcctgggttcttgtcccatgtccatgaagaatgagattatgctgacaactggagagtgagcaaggcagagaagagctttattgagcaacaaaacagctctcagcagagaggggagctgaaggtaggtagtctcaatgtgtggctgagtctctccagtttttatgggctcagaatgtgggaggtgtcagctatccatagccttggaaaaggcaacacttgattggttaaaaagcattattcagaaagaaccaattgggaaagagcaggcaaatgaaaatagaagttctcattctggtcatggactccatccagaactgacagcctggttttcaggcttcaggctgtctttggcttggaggttgggtttcatgggggacccaccccaatctgcctgggaatttgtctgtctcctgctgctatctttaagatgctatctttggctgggcatggtggcttacgactgtaatctcaatactttgggagactgtggtaggcagattgctcgagcctagtagtttgaccagtgtgggcaacatgacgaaaccctgcctctacaaaaaaaaaaaaaaatacaaaaattaacaagttgtggtggcatgtgcctgtggtcccagctactgacagagctgagatgggaggattgcttgagccctcagatcaaggatgcagtgagtcatgattgcaccactgcactccagcctgggcaacagagtgagaccctgtctcaaaacaaaacaaaatcaaacaaacaaaaaaagatgttatctttagtttttacagggagccaaacatcccatgattctcacttccatgattattgttttaagctactattactctcttgcttatcaagttgttcatttacttctcaggctagctaggtgcctggaatttccctttaagaaactcaagattttttaattcctctgtttggtgctggggagaccaggcccctaagaggggtccctgctccatctcatttgtaagagcttatgagacagccgctccagggctggccagtagctcaggaggaggaagagtcagtggcagggaaagggaggtccagctcgcctgggagataggagctcttccagcactgggctgggaaaccattctctggcagccctgccactcagtggaccctcaacttctccttaatttcctaggcagtataagggtaagtacaagtaaaaagaaattgaattttccctggtgccaaaaggcaaagagaagtccctccctcccttttcttagagtatttcctttataatcctttctctgtctctttgggaggtatataaacctttctgaaagctaaacaagccctttgccactttggcttcccaggaatgtgcttctcgggggcctcggagccatctctttgaaatgtgaacattaagatggatggtgccctgtctcctgtctctctgggagctttgcctaggagtctggctacaagttgtagcatatgagagttttcttcttcctttggatgagtgcaattaacacatatgtaatagattctatctgcctggctatgtaagagggtgatacattttttctgtctttgcaatttctttagtggattgcttttgatgtgtgttgcaatctggtttaatgcatatgtaataataacactttttttcatttcgtatatttttggacaggttttctagattggcagattttattttaaatttccgcaacagcagcaagtcctagcatacctcaacatcatcccaggaacaccccacccttggggaggaaatatgccagagataggaagggccacttctaaatacaagagagtcatcaggcacctgtcaggagggagagtatccagtctctagagatggaaatgtcaacctaaaaggaagaagcaaaggcagaattaatatagagagtttatttgggccaaggttgagagctgcagccatggatgcacttccaagttgccttggggagtgctctggaggacaaagaagagcctcaagtttttaaagaaaaaaggaagaatcatgagagaagcaattacgaaagctgctcatcaggaattttcattagtttacagaaataacattggttagtgattggctatacattgttgcaacttggcattcatctgcagcccacatagcaagtggcttcaagaggtcattattcagttccagggagagtgagacctgattgtggtcacattttaaatgcctttctgggcctgatgatttaaagggctcacattcctcagataaaggttttttttctttctcagattgaagtattctggtgcactcagcctttggacagaaaggagtggagattctcattacatatgggtgcttgccttagttgttttaaatttatgtgcaaccaggctgtttctcccatataaaagcacccctaaacggctgggcgcggtggctcactcctgtaatcccagcactttgggaggctgaggtgggtggatcacaaggtcaggagttcgagaccagcctggccaacatagtgtaaccccgtctctgctaaaaacacacacacacacacacacataaaaattagctgggagtggtggtgggtgcctgtaatcccagctactacggaggctgaggcaggcgaattgcttgaacctgtgaggtggaggttgcagggagccgagactgtgccactgcactccagccagggcaatagtccgagactccatcttaaaaaaaaaaaaaaaaaaaaaaaaaaggcacccctaacaagagccaacagtctctgttgagaccttcctacccttcaagagaacaccaaattggttgatgaacatagtggagaggaacggggatctccatcattgggaccaagagaggctgtgaaacatgataaacgctggtctagaacagtatggagaggcacatgtagtagcgggttcaactagcaaagagaagacagcgtcctttgcaattttatgtgagtccttccaatcagatgaccttacagaggttttaagtttaggttttgttttttttttgaatttgtgatgactttttggagtttggctcaactgtcttgtagaacatccctcattctagctttgtcagacagcttcgtcagggcctccttgacttgtccttctctcctctgtatttcctgtaactggatgtggatctaaaggctgaactgggctcatgagaagaatccttcacaggtgtgatggttaatactgagtgtcaacccgattggattgaaggatacaaagtattgatcctgggtttgtttgtgaggttgttgccaaaggagattaacgtctgagtcagaagggtgggaaaggcagacccactcttaatctgggtgggcaccattagctgctagtgcagctagaatataagcaggcagaaaatgtgaaaagagactgtcccagcctcccagcctacatctttgtctcgtgctggatgcttcctgccctcaaacatcggactacaagttcttcagtttggatctccctgctctcagagactggctctccttgctcctcagcctgcagatagcttattgtgggaccttgtgattatgtgagttaatacttaataaactcatatatatatattcattccattagttctgcccctctagagaaccctaactaatacaacagatggatcccatcaggacacatgatgacagcccatccctgctggcattgctcactttgataatttagggaaggtgacagtcaccgtatctttcatagtaaacgtgcattttccttctcaaaattagtaaatactgtaatttgttgaattatactttgacatcctgttcctcaacaacctttcacccaataaggtttggcatccactgaaggtgcttccctgaatctatttcttctttgagggttgcaataaatgtatatcttttttctacatttattggaggaagtcttccctaaagaagagttctcttttctctctctgttcctttttctttttttttgagtatcactgtgaattcatggatttctttataactcaatgtcaactgccatcattattatttctgatacttaatctcaatttggccggtgggaccctcttcaagctgcctctgctgttcgtttgacatgatcccattagtccgtgatttccttattttctggtacaataaggtgtcctaggctcaacttgtaatttacctgcttttgacttgtaatcagccggttcaatgaggatccctggttccctttcctggggaatggtacttagataccaagttcaaggcatgaggtgtgcccattgctattacaatgttatgacttctaggctctttgactgaaattaattacagacacacacatacatacgtgtacttatgaattcacactgacatttcttgtttttttttatttcaatagtttttggggaactggtcatgtttggttacttggataagttctttagtggtgatttctgatgttttggtgaacctgtcacccaagcagtgtacactgtacccaatgtgtagcctttttttccctcaaccccctcccacccttccccctgagtccccaaagtccattatatcattcttatgcctttgcgtcctcatagcttagctcccacttataagtgagaacatacaatgtttggttttctattcttgagttacttcactttgaataatggtctccaactccatccaggttactgttgctgtgaatgccattattttgttccttcttaaggctgagtggtattccatggtgtatatatgccacattttctttgtccactcattggttgatgggcatttaggctggttccatatttttgtaattgtgaattttgctgctataaacatgcatgtgtaagtgtcttttttgtataatgacttcttttcctctgagtaggtccccagtagtggaactgttggatcaaatggtagttctacttttagtttttaaaggaatttccgcactgttttccatagtggttgcagtagtttgcattcctaccagcagtgtaagtgttccttttcaccacatctatgccaacatctgttatttttttattttttaattatggccattcttgcaggagtaacgtggttctcattgtggtttcgatttgcatttccctgataattagcgatgtcaagctttttttatatgtttattggccatttgtatttcttcttttgagaattgtgtattcatttcctttgcccacttttttgagggtattattttttgttttgttttgttttgttgctgatttgagttccttgtagattctggatattagttctttgttggatgaatagtttatgaagattttctccccctctgtgggttgtctgtttactctgctgattgtttcttttgttgtgcagaagctatttagtttaattaggtcccatatatttatctttgtctttgttacatttgcttttgggttcttggtcatgaacactttgcctaagccaatgtctagaagagttttgccaatgttatcttctagaattgttatggtttcaggtcttagttttaagtctttgatccatcttgagttgatttttgtataaggagacagatgaggatccagtttcattcttttacatgtggcttgccaattatcccagcaccatttgttgaacagggtgtcctttccccactttatgtttttgtttgctttgtcgaagatccataggctgtaaatatttggctttatttctgggttctctattctgttctactggtctacatgactatttttatacaagtaccatgctgttttggtaactatacccttatagtatagtttgaagtcaggtaatatgatacctccagatttgttctttttgcttagtcttgtttcagctatgtgggctctttttttgttccatatgaattttaggatttttttttctagttctgtgaagaatgatgatggtattttgatgggaattgcattgaatttgtagattgcttttggcagtctggtcatttgcacaatattgattctacccatccatcaacatgagatgtgttttcatttgtttgtgttgtctaagatttctttcagcagtgttttgtagttttccttgtagagatctttcacctccttggttaggtatattcctaagtactttattattattattattgcagcttttgtaaaaggggttgagttcttgatttgattctcagcttggtcattgttggtatatagcagtgttactgatttgtgtacattgattttgtattccgaaactttactgaattcatttatcagatctagaagctttctggatgagtctttagggttttctaggtatacaatcatatcactggtgaacagcagtttgacttcctctttattgatttagatgccctttatttctttttcttgtcttactgctctgtctaggacttccagtactatgttgaatagaagtggtgaaagtaggcatccttgtcttgttccaattctcagggggaatgatttcaacttttccctattcagtataatgttggctgtgggtttgtcatagacggcttttattaccttaaggtgtgtcccttctatgccaattttgctgagggttttaatcataaaaagatgctggattttgtcaaatgcttttcctgcatctattgagatgatcacatgattttagtttttaattctgtttatgtgatgtatcacatttattgactcatgtatgttaaaccatccttgcatcccttgtatgaaacccacttgatcatggtgtttatctttatacatgatgatatatctttatatcttaatacactacttgatcatggtgtattatcttttttgatatgctgttggattcggttagctaatattttgttgaggatttttgcacctatgttcatcagggatattggtctgtagtttttctttttgttatgtcctttcctagttttggcattaggatgatactggtttcacagaatgatttaaggatgagtccctctttctctatcttttggaatagtttcagtaagattggtaccaattctttgaatagctgatagaatttagctgtgaatccatctggtcctggacttttttttttgttgggaatttttgtattattgtttttatcttgctacttgttattggtctgttcaaagtttctgtttattcctgatttaatataggagggttgtatatttccaggaatttatccattcttctacattttctagtttgtgtgtgtaaaggtattcatagtagccttgcatgatcttttgtatttctgtggtgtcagttgtaatagcttctgttttgtttctaattgagcttatttggatcttctctctccttttcttggttaatctcgctaatggtctatcaattttgtttatcttttcaaagaatcatcttttttgtttcacttatctttttgttaatgttgttgtttacatttcatttagttctgctatgatctttgttatttcttttcttctgctgggtttgagtttagtttgttcttgtttctctagttccttgagggtgtgaccttagattgtctatttgtgctctttcagacattttcatgtaggcatttaatgctatgaaatttttcttagcactgctttttctgtatcccagaggttcagctcaaatacttttttttttcttttttagatggagtctcactctgtggcccaggctggagtgcagtggctcatctcggctcagtgcaagctccgcctcccaggttcacaccattctcctgcctcagcttcctgagtagctgagactacaggcgcctgccaccactcccgtctaattttttctatttttagtagagacagggtttcaccgtgttagccaggatggtcttgatctcctgacctcgtgatccacccgccttggcctcccaaagtgctgggattacaggagtgagccaccacacctgacccagttcaaatactgtttaaatttctgtcttgatttcatggttgacccaaaggtcattcaggagcagattacttaatttccatgtatttgtgtagttttgagggttccttttggagttcatttccagttttattccacacggtctgaaagggtagttggtataatttcagttttcttaaatttattgagatgttttttgtggcctatcatatggtctatcttggagaatattccatgtgctgacgaaaagaatgtttattctgcagttgttgagtagaatgttctgtaaatatctgttaagtccatttgttctagggtatagtttaagttcattgtttctttgttgacttcctgtcttgatgatccatctagtgctgtcagtggagtattgaaatcccccactattatcatgttgccatctatctaatttcttaggtctggtaataattgttttagaaatttgagagctccagtgttgggtgcatatatatttaggattgtgatattttcctgttgcagcaatccttttatcattatataatgtccccctttgtctttttaaattgttgttgtgttaaagtctgttttgtctgatataagaatagctactcctgcttgcttttggtgtccatttgcatggagtatctgtttccattcctttaccttaagtttatgtgagtccttatgtgtctggtgagtctcttgaagatggcagatacttggttgatggatttttatctattcttccattctgtatcttttaagtggagcatttaagccatttacattcaactttagtgctgagatgtgaggtactgttctattcattgtgctagttgttgcctgaataacttttctgttgttgttgttgtttgttttttctatttgtattgttttataggccctgtgagatttatgctttaaggaagttctatcttggtgtattttgaggtttcgtttaaagatttagaactccttttagcatttcttgtggtgctggcttgggagtggcaaattatctcagcatttatttgtctgaaaaagactttatctctctttcatttatgaagcttaattttcctggatacaaaattcttggttaacaattattttgtttgaggaggctaaagataagaccccaattccttcttgcttatagggtttctgctgagaaatctgctgttaatctgataggttttcctttataggttacttgatgcttttgcctcacagctcttaagagtctttccttcatcttgactttagataatctgatgactacatgcctagatgatgatctatttgcaatgaatttcccaggtattctttgagcttgtttgatatctaggtctctagcaaggccagggaagttttcctcaattgttccctcaaataagttccacacttttagatttctctttttactcaagaacaccaattattcttaggtttggcagtttaacataatcccaaatttcttgggggctttgttcattttttaaattctttttttttcttttttttggtttttatctgattgggttcattcaaaagtcttgccttcgagctctgaagttctttcgtctgcttgttctaatctattgttgacactttccagtgcattttatctttctctaagtgtgtcttccatttccagaaattatgactgttttttctttatgatatctatttatctggagaattttcatccatatcctgtattgtctttttaatttctttaagttcattttcacctttttctggtatctccttgagtagcttaataaccaaccttctgaattctttatctggcaatttagatttcttctgggtttggatgcattgctgggaagctagtgtgatctttcaggggtgttatagaaccttgttttgtcatattaccagaattaattttcagattccttctcatttggtcagctttgagctcaccaaagagaatatttcaatggaaagatctggaactcaagggctgctgttcacattcttttgtcccacaggtgacccttgatgtggtgctctcccccttcccctagggatggggcttcctgggagccagactgcagtaattgtaattgttcttctgggtctagccacccagtggggttaccaggctctgggctggtgctgcggaatgtctgcaaagagtcctgtgacgtgatccattttcaggtctcctagccatagctaccagcacctgctctcgtggaggtggccagggaatgaagtagactctctgagagcctttggttgtagatatctttagtgtgacggctttctcaaatgcttgttatgttaacagtgaagttgtcacatggacagattcaagacctctggttagccaggatgttgcaggcagtggaattagctgttgttttctctttccttgaagcagggttattccgtcatgagttgttgtaatgtcctgagctgcttggcctccagccaagagatggtgctttcaagagaacaccagctgcagtagtagtagagggatctaagcttgcccgaatttggccaggattagtatttgggtttctcaggtgatgggtggggccataaagctccccaaaatttatgtcttttgtgatcaactaccagggcaggtagagaaatatccatcatgtgggggcagagtttggcatgtctgggctcagactctccttgagcaaggcttgccacagccactgtcgggggtgagaatgtggttctcaggccaatggggctatgttccaaggggtattatggctgcgtctgttgcattatataggtcaccagggaagtaggggaaagcaataggcctcacccagctcccacacagttggtggggccgatcttgctccttctgtatcccactaacagcaccaagtttatctctgggcagcttatgctctggactcagaccttgccccaggctataagcttccctgctgagaaagcaagcacagctttcgggccttgcccttccctgtctgcccatcctgttggccacagctttgcactcctatctgtagcagttcccttttgccctccggattctgttcaagagaatttgcacccagttgaaattattacaaagctcacttggaagcttctttcaccctgtggcccctgctaattctactggctgcctctctcaaggacccctgtgagatagagtcagagatggcttccccgggctaaagctggagcatgggaatgtctacaaggctcttcccactgctgcttctacttttatagaaaatattttgtactaaatccatttcagctgtagatacggttaaatccttctcctgtaatctggattttcaggttccccattggggatatgtgcttggaggcaggttttctccctctcacactttgggaatgcacagttttttgcctgtcttgtggaatttgcagcggtgtgccacttctttaaaaggatcagtgaattattttggttttcctggtacgttcctgtggtcgttcttagaacaaaagttcatgctttgtgtctccacatactcctctgtctgtccattcaagtgggagctgaacagtagccctgtctcctatctgtcatcttcctcttaaaacctggcaatttatttttattttttatagagacaaggtctcacaatgttgcccaggttggtcttgaactcctgggctcaagcttcccaaagacaccgatatttataatttaaatttaacattactgaattattatttaactttattttatttaataattgtatctattttccccttcaaaggaaattatgtttcctaaaaacatgtttgtataacatacatatatatacacatacatatgattaatatatatacacacagtactttcttgttctatccaaaaacattcacatagcagtctcaaaatgataataatagctttgttacaaacaataaatccagtaagggcaaagcttatttgtaacactttctgttcccagagagtatccaactaaggctgtgcagcccaagtgccacgtttgacagtttcttaaaatgattctttttgccatgttatcagtttgatatatagttggcctcatttctttgtgtgtacaattttggactgctttctctgatcttttttatttcatttatgttttgcataatgtaaaacacttacatggttcaaaagtcaaaactatttttgaaagtacagagaattctttcttccagccctatccctctacaccattcctacccacttgtatggttaatcatttttattggtttttggcttatctttccagtgtttctttacaataagcaaatatgtatatgtacacacatatataatcttatttttcaaaaaataacaccatatatgcactgtctgtatttggccttttctactaacaatatatcttggatattattccatagtggttaatggcaggcattttttattcttctttcttatggctgcatagcacttcactatgtgactctaccataattcactcaaattcatttcaaccagtttcccattggtggacacctgaaaaactcctatctctcgatatttggttagttgcctcaactgcatgccaacttctgctttggagtggataaggaaggtaagacctttggggacaagactcaagactcagccacttttgtcccaaagctacaggacttgttctgcctgccaatgctgtctctttcttcagcaaaagtgggattaagcgtgtgtataatgccaggtatgaagctgcactgctatgcaagttggacttctcaatcagcataaaagagctgaccattggaaccatccgaaatctcatgaagagggttgagggactctacttatgtacattttacagcagagagtaggaccgggtaagtcaaggttatccactatagtaagttactgctcaaaggaaaactgatagaaaaagggtctccaccttcttaaacacagaagcagtctgcttcaggcagaagatgacaggcaactcttctagtagaacttgaggtatacattcatggctccattgagaatggagatggggtttcaagcatggaagtggggacagtgacccatcagtctgagaagacacttttatgcccacatctcaagcattgctattattttagaagtagatgctcagttgtctgataaagagtatgatatcatccctattggttttaggacctagaaatagatttgcaggaccctaagggcaggatagaggtggatgagaaggtttatagtttttgggtccaagaggtggtggttggttagcgtatgggagaagaaccagcagaacctgagggtgtaagggttgatagacaaaacaaagctctaagtacatgggccccaggccagcgcccagaaacaagcccagacacaagaacccagccccatactatgatctcacccctagcaggcccccattcactctgcagctgaatgtccaggacttctgcaggttaaagaatgacatctgctaatctccagtcaaggtgcacctcagctacactctggactgtagtaacaatgtgcaccattgtctgtatgccctggggaatcactagactccaaggtgggctttgaacttggtgttgtcaccaaccagtgggtggggacctgggagtcccataccttagtgtaggaatgttgatgtcatgggtattggggacagaggagatggactgcattcatgcatgcttttgctgttgtgccagctctctaaaataccttgccttttttggtctatgtatcagagacctttccatctgtcaacaatcaacattagcatcaccttgctaatagagcttttcttgggccccctttggtagaagggtagtctactccttccttttggttcctaatccagtcctgactggattataaggacttcaattcatctctataactagtatttagcactgtgtcaggcacctagctggtactcagtaactgttcagagaatgagtgaataaatgaatgaatgattccaacagatgaaggaactggcctgaaaatgacttgcctatttgccaaattcacccagctttttagtttctcaccttctgacaccaatcaggaataaaagccaaaacctagattggcttttcatcccaagacatgtcctgtcctttatatgggtgtggacttacgttagagcccttgtcattcctaataattccctcttgtgcctacctggatggagctcaccttgggctatgattaggagagcctatctccagcacctgcactcactcacctgactccacctgatgacttgacctatttgttcctccatcagtcaacatgagtgcattggagacttactgtccgttgttctctgtggacacatgtgaagtgcaaagacatgctaaggcaactggcctgagcctgtaattcagccaaggctggtaatgacacatgatcagaggtcacaacactctttttaagtcacagcagtttcccttaagcatggctttagagtctctgagctcaccatgacttctattagagatagcataagcctacagtgctttccctactctttgttctcattcaccactcagcaccacacttttggcaccagatagatggggatttttcccacacgtatcagtaaagcaattctgcagcacacaccaatgaggtgtcctgcaattcaattcaattctgatgctaactacccaaagatgtcatcaaatcccacagggtgagggcttagtcctataagactctccccaaccttgcacaccaattgcaagccctaggatgtgacctgtgcctttgaccaaccagctacaaattgaggttcctacaaccccctccttgggttcaattaatttgttagagcagctcacagaattcagggaaacactttgcttatgtttatcccttatgataagggacattacaaagggtaaaataaacagccagctgaaagggaggcacaggatgaggtatgtgggaagggctgagaagctcccatgccctcctagggaccaccctccaggaagctccacatgttcagctgtccagagctcccaaaactcagcccttttgggtttttatggaagcttcattatataggcatgactgactacatcatgggccattggtgatcagcttaactttcagcctctctccccaccctggagtttggaagtggggctgtaagtcctaaccctctaatcatgccttggtctatggacgaccagttcccatcctgaagttacctagaggactcatccacccattactcattagcatacaaaagacactcatcactctggagacttcaactgtatatcaggaaacatggatgaagaccaaatatgtatttcacaatattatagctgccatcagccatgggtgagtttctcatcattcaaagtttccttcttttttagaaaccacctgttttactctaaacaaagtagattcttatgaaaggtaggctgtttgggggtccagaatttcaacatatgccaccaaacccttttcttccctctgaatttttggaggcgcacctcaccttgtgaatttgtagcaccccaaaccagtaagcacacacattcaaatacatgtacatgcccacagctacccactagtaagcaccatcccccatgtccggtcacacagatgtgagaagatggagaaatgttcacctaaacagctggtgtgtgaagtcctgcctctgtcagctgagctcacatgggaaagatccccagtccctaggccccacatcaatgggcacagggccttcggaggaaaggacaaccactccgtcgtggagggagaacactttggactcgggtgtgtgtttgagggattccagagggtagaggttgaggaagaggagttgggagagtgagaaggtaggatgttgcacaggatgagacccttcctctcaaaccaaacctaatagccaataagtacaggaaaagatccttgacatctctagtgatcagggaaatgcaaatccaaaccccaataagaaaccacttcatactctccagggtggccagaatacaaaaggctgagaacaagtattgggaggatgtggagagatcagaacactcctacgctgctggtggcaatgtaaaacggtacagctgccttggaaaacaggtccccaaatgttaaacacagagctatcacaggactcagcaattccactcctacatatataccctgagagaaatgaaagtacatgtccacatggacacttggacacaaatgtgcatagcagcattattcatagtagccaaaacccaaatgttcatcaactgatgaatgaactgacacaatgtggtctatccagacaatggaatattagtcatgaaaagggatgaagtacttatacttgatataccatggatgaacctcaagtatgttaggctaagtgaaagaagccagtcacaaaagacctcctgttatgtgattcattcatatgaaagtccagaatagggaaatctatagaaacagaaagaagattagtgggaacttagggctcagcttgcgaggtgggggcaggggcaggaagatgggaggtgacagctaaagggtttggagttttgtttggaggtgatgaaaatgttctaaaactgaccgaagtgatggttgcacatatctgtgaatagaccaaaaaccattgatcatacacattaaatgggcgaattgtatacatgcaagttatatctcagttaaggcattaagaactaaacaaaaactaagaacacagatcttctgtctttcctatttatttatttattttgagacagagtcttgctctgtcacccaggctggagtgcaatggcgtgatctcggctcactgcaacctccgcctcctgggttcaagcaattcttctgcctcagcctcccaagtagctgggattacaggcacccgacaccacacccgactaatcttttgtatttttagtagagatggggtttcaccatgttggccaggctggtctggaactcctgacctcaggtgatccacttgcctcggcctcccaaagaactgagattacaggcgcgagccaccacgcctgaccaccttgatcacctttttttttttggaaagcaatgagggagcaacactttgttacctgggaggcgtggaccaaaagagaggcagaggctggagggagagtgtgaggcagggatcaatgggcatcatgccaggcttagggcatccccaaagctgtgggattggggcttgaagcccaggtcttagagacctgagcaggcccagctgacacaggctgcaaacaaatgtcctctcatcctcaccgcaatccctacaagctgctcacctcctgttgccatgtggatgtgtcctgagtggcccacgcagatttctacacttgatcccctcgcttgaaataaaaggagataaagtgagtacaaacacccttatgcattactgtagctcaaacgaggccagactagatcctaaagaagacctggcgtgggccatcttctagagtcatcccacctcccaggacaagcaaaggtcctgcctccaagtcattgcaacttatatgacacagcaaggcaatatagactctgggggaaaaagttttttaactacagtatttttaaaatagaacattattttgaaattacttcgacatctactgtcaggtgacttgtaaaagcgcttgtatgttaaatgctctacattaggagattattttgttcttgagtccctacagagaattccttgggaatgaagtgctattgtgcattcagaattatgtggctatagccatattgcaggccgggaactcaggaatgtcccctctgtcccagctcttcaagttgggccctacagatcccacggggacaagcttttggaaaattgctgggtttctagaccaatcacgtctttgaaatgtcttcttgtcactccgtggtttcttgcttcagcttaaccccactggccccatagatcaggcagctcacaatttgaacacagccagggggcatggaggatgagaaccaatctatcctgacaatcctggcagcacgtggggaaagccaggcccaagtttccatatgtgaacacattacattgtctccaccaagaaaagagcccctgtgaaatattcatgtgcgtcacccactttgccttaggttccattacctaagggacagacctggtgttgctcaacagtgccaggcttagcactgccaggggagatctgcagctacaaagagttaaagaagaaggaattgaattgagttataagcaatacatctaataaatatttattgagtgactatttcattccaagcattctgctaggtgctgagaaatcagaaacaaatacattgaactcattggcaaactagctggggagatgggcagggaagccaactgttgcagtctggtgagagttgtgctggggaatgcagtggctttgcaggagcccggagcagagacatgtagttctgcttggtgggattgagcagatgtcaggcaaagcttcccaaaggacacgatgctcaagaagggtcctgaagaatgatttgaagctggaaagtcagaggaaagcatcgaaggtgaaggcacagaggtaggggacgcatggcacacccagagaactgcagacgccctgtcatgcctgcagtcttcacgggaggtgagaaagaatttccagggtacatggatgcatgttaggaggctgagactggtcttcgaagatgatcagacataggcttgaagacttgatgctttcaaaagctcgctctgacagtagcgtagagaaggaatgggggaagctttgcttataataaagtgagaaatgatgggggctgaattaagagaatggctctgggggtggagtatgagagtatttcctaaagatagaagagagaatggccaggacttgagagtggctgaagtcgggtacagggagacaggagacaccttttatggccatagcttgagtcactgtgtggacaggcgtgctcatcattgagaccaggaagcttggaggggaaaacgctcatatgcaattctgaagttcctaagagacaactggataacacacaaggatgaatgtgaaacaaacaaggggctaggtcccgtaagctcatcagaacttctttctgaaagaagtaaagcacatctctaatgacaacagaaataaccacaaacctgcgagtcagcctcaaatatctttcctgggggattaaatgatggctgagggacggggtaccccagaatgtcccttgcacaggaaaggacctagagaagagagactgttttttgagcaggtcacattcagcttactgcaatgtctttgctttaaacggtcccctgcattataagaatggagtttatatgagaggtgagagggtcccagtgacttagcaaccgtggcatgcttctgcaaacatttcaaagacctctactctggcttttagaatgctttctagagcaagtagcatgcataacgacaccactacctggaattatacactgtctttcttcagaggcacacaaagagcttaacacattaccttagttctaggttagctgctttgtttcatgcatgcttgctggtgtttctggaagaacatttatgaggtgattgctcttgaaagacttcagaacaatcaagatggtttgttgctgttgggttctttttttttttgagacagggtcttgctctgtggtccacgctggagtgcagtggtgcaatctcagctcaacacaaactctgcctcctgggctcaagcaattctcccacctcagcctccagattagctgggactataggtgcatgccaccactcctagcttttttttttttttttctgtagaggcaaggtttcaccatgttgcctaggctggtctccaactcctgggctcaagcaatctgcccgcctcggctttccaaagtgctgggattataggcgtgagccactgcactggctgggttttatattttattttatttatttatttatttagactgagtcttgctctgtcacccaggctggagtgcaatggcgccatctcagctcactgcaaactccacctcctggattcaagcaattctcctgtctcagcttccggagtagctgggattacaggcgcacaccatcacactcggctaatttttgtatttttagtacagacggggttttgccacattggccaggctggtcttgaactcctgacctcaggtgatccaccctcctcggcctcccaaagtgctggaattacaggcatgagccaccgcgcccagactggggttttttaattttcactattattttttaatagaaagcatgcaaaaagagacgacacagtcattggacagtattacaaaaaatagtcatagaagtgaatataaatgatgcaaaatgcaatacagctagagtcccttcttcaccctttttattgatatgttcacccaagtgttctcacacatagaagcaggtggttttctttactacagtagtatagtttggagtgtttatgcttcactaatggtacaaaattagctgagaaaagatttaaattggtgttttaattatccagtgtgataacaaaccacctaaaaatgtagtggtataaaacaactactgtgtattttctcacactactttgtggaggtttaaaaacaccacaaattcatcaccttggtttctgtgggtcaaaacaacccaaattcatcatctcggtttccatgggtcagaactgcaggtacgggttggctggggcctctgctcagggtctcaccaggttgaaatcaaggtgacagccagagctgtggtctcatctgaactaatgcagaactcaccagagcacatgtagtgttggtagaatccatttccttgtggttggaggacggaggtgtcctcttccttgctggctgctggccgggggccatcctcagctcctagaggctgccctcaagtcctggccacatggcaccccagtctcaccttgtggcagctccaggccagcaggggacaccactgctccctccagtgtcctctcagggttcacctgattgagtcaggcccatcaggataatcttccttcttttttttttttaactttttttttgtttttgagacagagtctcgctctgtcacccaggctggagtgtagtggcccagtctcagctcactgcaagctccgcctcccaggttcatgacattctcctgcctcagcctccccagtagctgggactacaggtgcctgccaccatgcctggctaattttttgtaattttagtagagacagggtttcaccacattagccaggatggtctcgatctcctgacctcgtgatccgcccgcctcggcctctcccaaagtgctgggattacaggcgtgagccaccacgcctggcccctttttcaacttttattttaggttcaggagtacatgtgcaggttcattattggggtaaacttgtgtcatgggggtttgttgtacagattatttcgtcacccaggtactaaacctagtacccagtagttatttttttctgatcctctttctcctcccaccctccactctcaagtagccactgtgtctgtcaatcatccttcttgataaactcaaagtcaaacgagtccagatcttacctacatctgcaaaatcaatttttcctataaaggaacgtaatcacagaagcactgtcccacagtagtacgagtgctgagccgttgtaggcagagagggttgtcctgcccacactcaaggggagagagtgcagggccagttcacccctcacgcggaagtggcagtgctgggggctcacttcgtgctctgctcaccacaactccaaactcacaactttattcccaccaatcccatcccctccagtccagggggcacacactccagcaggacttcagctgagcccagggaacgctttgctgactggtgatgagggacctacctcttcacacccatgacacccacccgctgagcccctcaccggggctccgaaggccctggtcaggtcacctctggtctcactttccattctcccctccttcctcccctccagccacagggtccttctcgatgtgcccagacatggtgggtgcacacttgtctgacagcctctcttcttttccctttgcttggaatgctctcttcccagttaccaaagatactcaggctctctccccaatttccttcaggcccttgctccaaaagctccttccgggtgaagcctcccctcccatcctccttaaagcttcagcctctacctgggacacttcctcccccactgcctgcctccttgaaactctccttagtcctcttgcagcccacacagctgaacacaggcaggagggggcgctgctgccctggctggtgtgcagccaccagaggctgaagctcactgacgtctgtctggggcccaggatcaccttccttgattccagctctctcaggctgtcaggacctggcgctgggaggcactaggccatgccctggcctgaggccttctctctccctctttgccctgtgtctctgcagggaagcccggccctgcccctgggagggtgggggcagacgtgtggagagtgggtgtacaaggccagggtttgccaggcccaggacagcctggcacctgtcaatggatgagcgcctctcccttagcctgatgtcagggtgggcatgagggtgggagcagagggtgcctaactgaggaaagggtctgtgcaacccccttctcctaccagttctcgtttctgaagtctcctcaagcacactgcggtgtccacaccattggcagcaggctccttctcttcaggtggtcttaggaacttctcagaactttttgagttatccttctggtctcttcctcctgagcacggttctcctggttgagctccaggccatgccattcaacgccctccaggacaggccgaagggcttgtctgtttggtggttgctaaggtttgaaaaaagccagctggaaacttaatccccaaagcaacagtgttgggaggtgggacctaatgggaggtgtttagtcatgagggctccacccttatgaatggattctctctctcttgttctctctctctctcttcccgccccgcccacccctccttccccaaccttgtgataccttccaccatgtcatggcaagaaggcccttgccagatgtggcccctccatcctgggttcccagtctccagaaccatgagccaaatgcatttctgtctgttacaaattatgtacggtgtggttttctgtgatgaacacagtgctgtaccagggccctcttgccaagacagccagcttataggagcctgcatgtgaggcccggacgtcctacagagcagcagttagaggtctggccttctggataggcactgccctgccctgcacacaggaccttggtggggcatgatggggctcttcaccacgctgccctcattttaggaggtgggcaaccctttctcccccttctccatgtgcttctgcagttggaagaagtgaggggggttcagacacacttaagctgagcttagagcaaagcatgtccctcaaggtgaccttgccgcatggcctgaacctagaattcccctgaccagggtggacagccatcaccatgggcctttctgcctggcctagtatggctctccttcgaactcacctagacccttgcatcaaaggactcggggactctgctgcagtcatcctagcacggtcgagaggagtaggaaggtgcccagcggctcagcctttaaggaggtctattggtcaccattgcttctgccttcttgagaaccatcaccctcggaggatccggtagtgtatcccagtcaagtgtcaaatgcgttgttccctggagaggaaggcttatttccagaaagtactctgacgttttgtaatttgtgatttctatcactggctcagtggcctacccactgctcagctcatgtggcatgaccaggctggggcgtcgggtcatcttgttctctgggtgtgtggcaacactggtttatggcgtaatttccttcctgagaagaaattcagtaatttctaatattcagggctttaggtagaggcctgaaaatcactctccatgcctctttcagtattttatatatagttgtctcttggtatccatggggtttggttccagaatcccctgcagataccaaaatttgcgaatgttcaagtcctttatatatagtggcatagtatttgcatataacctatgcatatcagccaatcatagatggtgatttaaatcatctcttgattacttctaacacctaatactatgtaaatgctttgtaagtagttgttacctggcatttttttatttgttttatttttgttgttgtttcattaattttattttatttttggaatattttcagtccattgttggttgaatccacagatgcagaagccttagacacagagggccgaccacacctatgtatgctgttcttaaagtagcaacatatttgttctgaacatagaagaaattagtcgtctattagactttaagggagtaaatatggtccaagttgatttttaaatttagcaaatagtcatagacatatcagtgtcttacagaaaatatttattggaatgctcactctctcatttgggatactgctttgccttgctgtgtcttaagaatgtcatcagagcatcacacacttgaaaaacgtttttaaaaggatatgatgataattaagaccttctccccaacccctgcccattatccaagatcaatgtttttttcctttatcctgattttaaaatcaagtacactttattgaggcatactttacatgaagcaaaatgtaccctttctaaatatgataagtttgatgagttttcaacagatgtatacagctgttaccatgactgtgtctttacccaggttcttgcattgctcaatccagatacagaatgtctccatcaccctgacaagttcctttgtgccgcaccctctagccaatcatctgttttgaggagagttttaaaacaaaggtttttgttctttttcactgatgaccataacctaccacagacagggtctctctctctctctctctctctttttccctgttcttgcgccagctgcctgacaatttgtgggattaaagctctaagctgcttactggctcttctgactagggagagggagcaagcctcattatttttctattcttttcagtgactgctcactcctcttcctccaaaatccctatccatccatccatccatccatccatccatccatccatccatccatccaactttccatctacccatctatccttccatctatccaatccacttgcgtgttgaacgtctactatgagccattggctaccaggaatcccacttccacccaaattatgtttcaacagggaagacaaacaatttaacaattacgataaaaaagaaaatatgccatacaatggaaaagaagggggcatgatgggagacccagcgggagtagctggcaacgattcttagggggaagagacattcctaatagacacctgcaggagaaatattaaagagtcaatcatttcagtagcgcttattgtgaccaataatgcaagaagtttctgggttcccaggctgatgggtttgaaagtcactgcatcatgaatgtgcccaggacccacacgttgttttgtaagagaggggttcagtaaaatgtgaaatgaccgacattcaacaggcagaactgtgcagaatgcacgctttgccactgattgaaagtgtttcttcagtaggttttgatagaatatattactaatctggtaagaaacagcttagggccactcaagaaaagaaaagcagcccctagaaacatgttctgtggctgggcacagaggtagctgctggaatttgaacaggggtgagcaggacctcgtggacctcattgtggggttagcagggctgggctgggacaatgagatcattttctaggcagagaaaagacaacatggtaagttaaaaacactgaaaagtctgcgctgccagagtacaaatgtcagccaggagggccctgacactcttgaaagagggatttgagcagtggccactgcatctacttggcactcgttcgctgtgtagaagggtcaccgagtccctcatcagaatcctgaaagaaggagaaacggtgggcacaggcagcacacctcaatcacttgtgaataatttccttctgtctttcataaacatagctatgattgaaatgacctttcacgaacagcagggaaggattgtggaagaaaatgaggtatgtgagaagcaaatccatctacctgattgccatgtaactttcggtgagtcacggagtgagaatttcagatgtgaattaaggattgccaagagtggtgatatacttgaaaagtttcctccacgttctactccctgttctactttagaatcaggaggccagagaggcaggagggaagagtacttgttattcatagtggaccttcttcctgaataatttttagggtaattatgtatgcagcttccacctgagtcactgacctttgggtgaatgttactggatatgtacctatgatacccaggcaaactttctgcgggttctacgggcactgtgaagtgtgacagactttggctgcgcgttcacttttgatcataacacgtccatagagtgcttttaatctcctgcaacttaacatatgagaaaatcgatttattttgtagtgagttctgcacatttcacagaaaattaaagctctctgaaaacccaaatcttctgtgggcagtaattcacacacaatattctggaaatgtaaaatcccaaatgcctgctgacttcaaatcaatgtttatagcttgtgtctgaatagctccatgaattgctccgctcctctccttctactgcccttcgctttgatttagccactcatttccaggggctgattttctttttttgcatggccctaagctgtttcccatcagattagtaacatattctatcaaagcctattgaagaaacactttcaatcaatggcaaagtgtgcatcctgcatgatgctgcctgttgaatgtcggttgtttcacatttgactgaacccctctcctacaaagcaatgcgtgggtcctgggcacattcatgattcaattactttcaggcccatcagcctgggaaccagaaactttgtgcattattggttttacaatttcagctgaggcttccacagaacaactcagaagaaataggctgtcctgagtgagccttttccttgacttgtattttctattctaaggtctattggcttcactggcagtgggaccactgactttttccctcctttatctaaggggacctgttgagagtctctatttggaaatatttcctgcctgtccttagtgggggtcaatgcctgaatctgtccaataatcagatttgaccaacttggtggaagtgtggattttccagcacgattaaaccttgaacatatatggcttgaaaatgtgcaaatactcttggaaatgacaggatcatggttctcaagacagagaaaaaaaagtagcatgtgaattttcatagataaacgcctaatgctaatgttgatcaggattaatgtcatttcctagatttcagcaaataaacactgggttacttaggcctttgtgggcttcccaggaaggtcaccaccatttgaaatgagactttcaggggaaaagctgccagagattaaacagaaggcttacagatgcatcttctgaagataacttagtatcttccatggacatcttttctaatagaaaagaaagctcttcaaatgaccaaaaccattgctgttttgtggaggtgctggtgaacaggggtttcatcacagtagcatctacctgtacaaacgaaatactcgaagttctgatttcagttttatccattttcttcttttgcaagtgatgcattcttagtgtggtggactctccatgaaccacagcacagaattaggagtttctaagctcaaattgacaaaggatgtctccttctgaatttaaaatgtttaaaaaggtttaaaagccttttaaactgcagaatttagaaggttcacagatttattctagaaataaaatgacaacttttctgtaaggagcatactgtgcccatttattatagaatgcagttaaaaaaaatattttgaggttagcctctccagtttaaaagcacttaacaagaaacacttggacagcgatgcaatggtctctcccaaaccggctccctcttaccaagtaccgtaaacagggtttgagaacgttcaatcaatttcttgatatgaacaatcaaagcatttaatgcaaacatatttgcttctcaaagaataaaaccatcttccaaatttccaaagcatgcattgttacttggcattaagtatttcaaaatgacaaacattgttacggtattgtaaggccaaaatataatacctatttaccagacatacacattacaactagaaaaaaattacaaatgttaacctagtataacaattccatcaggaatgaatggggaaaggcactgcatccctctcatatcgccacagatctactatccacttgacatgctttgaattcaagtcctgttagacatgggaacagcttttcctacaacatatgattcacaggtaggttaatacatcttagtctcccactgccatacttttcacccaagtgtacaacaggtatgaatatatgctatcagctttatttacaagtgtatcttgatgtcttcgtggggtaaaagaaccaactatctcaaccaacagtttccaaaaaagtttttggctatgattcatgtatagaaaccaccacataaaagaaacaacagaaactgaggtccgatcccaaacacctaaactaaaatttctcacccactaaaagttggcagtgaaactgctattctctgaattgtataagctaaattctacagaggaatttcagatcaacttcttttgcaaaagcacaagttacacgttgcacggttggggatgctgagtgaatgcattccaggaagagttccgcaagcaagtgctgttgcaaagagtcgagaatccgagaatctgggaaaggtgatacgttttccaaacgctttcctggcttcccaaaagatgtaaaacaacaacggtgtaactttatatacgaacaaaggttagtcttgtaaatcagtaatatacatgcacaaacatgagaacatgagggaagaaaggaaacgctacaatttccacattgcattgctgctgttttcacaacctctctgcactaggcggcttcctgtggtacctcttcctaccagtagagagtggcccctgcaggccacttagaaacaggaagctctctcctgagctcactgatcaacctgcccttggcacagacagaacctaccagaaaagaacaagtacaaaacactatcattatctgttttctcaagacagtcccaaatgtccttgtgcgatcaccacaaactcagtgattggcccaagtcattcccgggtgccatgaacagtaactggtgtgcagcattagaacaaggggacacggccttgattctcttctgagcaacatgaactgggatttctgccaccccgatctcggctgccacctccgaagaagtcgtgaccagccacctccacagtaaaagattcctcccgtgagtatgatttggaatgcgtcctcgtcgcgtgccagttcagctgaggtggatcggcgtgtactccggcctcctggtctggataatttttggcttaggtctcctcattctttccatttcctcttcttcctccttctcttgatcactctcacatacatggaccaccacgctgggagtggtgtcagtcgctgcgtgcaattcatacttttcccctaaggagggaaaataatcgcagggtcactcagacaagtccttgggagtcaaaaggcaaacataaaagagcattcagggctctgctgggccagctgctcgtgaccattcgattgggctgagagacacagccagacatattttgggtttgtatttctttgctagctcattcagaaaaagagagatttccattgtgcatgactctgtttttagtcaaacattctgggagtccaggcacatgagaagtatagaaggaatgcatttttctagttatacttcacatgtccaccagatatctaaactacccagagaactccctttctgtcagcatttcctcaagtgtgaatgtgagaaacttcggttcaggaaaaagatggatgaagaaacgtatttggaaacagaaccctgggcctccctcatgcagctcctatttgagggtcgcagtgcacgcccaggaagggcgccacaggaggccctgcagcagacgcaggggtggctgcacggagccaggtgctctggaaacgtttttgacctgggcatcttttccttagaacaacttctaatccccgggaccaggagtgtcctgctgttctatgtcagcctgagttctaccaggttggccaagttcaggccactctggtccagcaagggtggggagagctttctgcaactgaaaaacccggcaatgtagaatgaagggactggggcctcccgctggggtgccgctctggccacgggaagagtgtgcatctctggtgctcatgaaggcagctctgagcctggctccttagtacccagggctcatgggcactttattctgcttccctgtgcacctcagttccctcctcagtaaaggagacggtaaaggtattgacttcatggagctaacagcatgagtgagtgcccgaggcaatgagaacccggctcaccacatgcttgtccagcccatgtcacctagaaagatgtttaagaatggagactgcatcgttattggtgccctgctgggcagggatctgaaataggggcaggaggtttgcttcaacctgctccacccacagggtgtggcctcatggtcagttttcttccagggctttgtgcttgggatttcttttcttttcttttttctttttctttctttctttcttttttttttttttttttttgagacagagtcttgcctgttgcccaggctggaatgcagtgacaagatctcggctcagtgcaacctccgcctcccaggttcaagtgattctcctgcctcagcctcccaagtagctgggactacaggcgcatgccatcatactcagctaatttttgtatttttagtagagacgaggtttcaccatgttggccaggatggtcttgatctcctgacctcgtgatccgcctgcctcagccttccaaagtgctgggattacaggcatgagccaccgcgcccggcctgtgcttgggatttctttgcagttcgggtaagcgaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatgctggttaagagcctcttacaaatctacctctttgcaagtctcttatctacctactaatcatcgaaaatccagaaagctcagggtttaggaccataatttgcaaaatctccgcaatcctgttggttgaaaagcacaggtgaaatatgaaatctcactcaagctcactgttaagtgaaccaaggacaaactgattttattacgtctatttcctaaaaagccttctccaataagccctcggtgaaggaagtggtatattctggagtatgcagaatttttattaacagcatttgcctctggaactgtggacacctctttgcaagtggagaccctgttttctcccattcctaacctaggggaagactccacaccctcagccatgctcatgcccccgggccaggagctgctgtggggggagcacacgcttcctcaaaatggccatttctgatcttgaccttcacgccacaattagcagtaagtaatgtgagtcttgctttatcccacagagggaatttccgtttggacaatgttttcagaaatgtaatcttttcaatatgaaactgctgatggaccaagaaaacaaaaccctcaacccaagggaacatcagattgctggtcaaggagaaatgaggagctgacggtctcagcatttatttgacttgctccacggacagagcaggagaaggctcaaacctcttcaccccaagactctccctcacacctgcctcctcacccaaaccctagaggacaggacaggaaccaccaacattttatggttttcaaaaatcctgcattgaacactgactgtgagccaggtgctgatggaagtgcctttcactcgatgatctcatctactgctcacaattccaccagttaaggcccacattttggacaaagagcctgaggaacctaccccctccccgcagtgctcacacttttgtccctccagaggacgggaacttcctctttctttagcaagctctgtaggggaccagcccacaggccctggggtagggcagcccgaccgcggcccttccctcaccatggcctatggttctccttcccttttcctttaagaaggccaggtgagaatcacaggaaagggagaatttattttgattaaaaataacatttcttaaagggggcatcgattttccctttccaaagtccaatcactcatccctatccggagcgacagaacctggggccggggctcaggcctcccacgcaggctgtgctcagtggacacaggaatggattcctgggacactgcggggggtggaggggcgtgatgcagggtccccacgatcagccgcagtctctctaacactgcaggtggtgccaagaggcaggcatgctcccagcacaagggacggtggcgcagaagaatacagagaagctcacaaaacatgccggcatgggctcaggagagctacgggggtagtggtggtactgctccctggtgcagggcagcagctgtgtctccccctgcctccctcccacccgagggccctgctcacctggccccagcttggagatggcatataagagatcatagtttatgactggggtcgcatcttccacttgtttccatcccactggcggagaggcgggaggggagatcagaaactgcttgtctggatttggcggagccaggtgtgagcttcctatgtgtaaggtctgaggagagaaaataagcacaggtcagttgttgccagggaagaactgcagtgaggcaacagcacctaacgccagttccgggagatgggcaggtcaatgtccaggcgtcaggacaggtgtgattccaggaccaattgtaagatggtctgtaatggggagggcaaaaggacatatgaactctggttgtggcacagataggatgacagccccctcccagggctatgggagtcacaggcacagggactgcaaataattacgcttgacctagatggacagaaaatcagcagaggtgactttagtatatatggaaatttaagtcactgtcattgaggtcaggagggctcttggaatcagtctctccccgctcctcataccacagaggcaagctctgaaagtccaaagcctaggccacagttctgagaggacacagcttctcagggacagggagccagggctccacctgcccctagggttccccacccagcagcagctctgcacctccctctccgggactctggatcagatgccagaaaaaaaaaaaaaagccacttcccaggagactttaagaaataagaataaggaacaataacctacgatcctagtttggttttagaaatgctgaccagtgatgagagggctgtccatagagctcttacatctcaagctgcgcggtgtaggttttctctgcacttccagattgccctccccaagttttcacaatgaatatgcattgttttacaaacagaaaaggtcagaggagtactaagtaattatttgcataaaatcttatcccgtgcagaaaggagtgtactcacacaggaaggcctaggcacccaaggtcaaagctcagcctgtgcctcccagggcaaaaaggtcaggggtggggcggggatcccaaatgctttatttatacttgaagggcccagcaagttcgctgtcctcactttgaggaagaaaagacactttggctctctggcgtggtgtcagatgagcttcctcccactgggggaggcctttggacagggtcctctcccatcccagcaaggtatgtgtgtatgtgtgtgtgtggtgggggcgggttgggggggtgctcagagcctgagggggacttgctttactgaggagctggctgcattctagaagctcctctcttcttccctgacaatctgtcagcccctaaggacatcaaatggaactctgggagctgccttgaaggtgggtcacctgtcctaagttccccagaggagggtcaaaatggtagtgggcaggagaaaaggcaagcccaaccccagctacccctctccctgccgtgggtgccctggggctgggaaccctgccaaccagagggtttcttagcatctgcgcccagtctggttatcccctattttcctttcaagccagacctggcagtcctgggctgatttgcaggcatcttctgcagactcctgtttctctgctgagtacccccagcaccacatgagcagggaaccactctggtctgctcagtctagagtgggtcatgagctccaacccttgagcaaattcatggaaacctgctgcgcaaaccttagggtgtttgcatagccacgcctaccccgctgcaccctgcaagctccccagtgaacagggaaggctttctttcccccatcattatcaacccaggaaggtcaggggcaatgtctgaggttgctttcaaatgcaccttgatatcttcttaaaacaagtgagacgctgaacattcagagtaggaattttgtctttctcaaggtgaagtctcagagtttccggtcagcatataacataagcaacgtataagctgctttacaaaagggagggagggaggagggagaagcatgcatagcaatgaacccaactcacctgagcaaaatataacttcatttcctttcccagaaactcagtcttatgcagctggagcctggcatctgctgcggagaaggggttgctgaagtttattctgactcgtttgaagctcttaaaatactgaaaggtgatgtccttgtcatacgtcctaaagagggactcaaatttggcctgaaaaataacaataaaaataaaaggagttgaaatttacctgcatatgacccttgactagatgatgtcattacttttttttttttcttcgagacagagtcttgctctgtcacccaggctggagtgcagtggtgcagttttggctcactgcaacctccacctcccaggttcaagtgattctcctgcctcagcctcccgagtagctggggttacaggtgcctgccagcacacctggctaatttttgtatttttagtagagacggggctttgccatgttggcaaggctggtctcaagctcctgtcctcaggtgatccctcggcctcccaaagtgctgggattacaggcatgagccaccgtgcctggcctcctcaatacattttttactgaggaagtggatcatcaatcctttcaagaactcctaacttctttcttagagaaaagcctttcccctcttaggggactatggcctttagtcccaatgcaggtgattttacaagaaggtaagaaggtatgatttattacattcatcgaatcagcagaacagttgccaatacatagacactacttacggtaacaaacttttttaaaaagtagaatgagcattttccagggaggtacagtttggtaatttgctccccatgtttctctgtcctatggccttcccccactcacccccccttttttctctgtcctatagccttccccggctagccaactccaaccccaccgttcagctcagggcagtgttgcatatatcaaagatttctttaaggcttaaaagaactgcagctaatttgaaaaaaagaaatactgacttgaaaaataacaaagttggtagaaagttttgcatttcttaaaataagtagtttttaaaaatttccacgatcgcttttatctcagtctgttactttttaactctctaaaatgatactggtttaaaaattaatgttctgcaaatggaccattttctgcatcctggctttcgtgtctgtgcacacctcgctctggtgccatagggctagtgagaattaggagatgtcctgagctcttagaatgcaaagctcgaggtgggggattacaagcttaggttgctcaggggacagccccctaggctgggtcctggagtgtggctgtcggtgggggcagctgggggccactgcaactcctcagagagggagtttaactggtggacagtcaaagctccaaggaagactgcatgggcttctagtcgccgggttttgtgaatctttttaccaggcaaaaacacttaggacagtttgtgggagcccgtgtgaaaggcagaaggggctggccaggaagaaggggatggcgcagggtgtggatggtaggcagcgcggacagagctcactgaggaccttggagaacctatggaaggcgcagtgtctctgcagtgggagcgaggattcaggataagagaggagagtgtcttcaggaatgttcactgctagcaagcgcggggaggcactggtggatgcctgctccacatggggctgcgggtaggagcagggtagtcggtccctgccaggcaggtcgttaaggagcagtcggaacaacctacgaccttgctctccttgcattccccggcttttcttcagtttagggacatttctgagactttcccacgagggatcccgcagaggcacgtgcgaaggaacgcggagctggcggacggtagagttcatctggccgcctctcactctttttccccacctctcttgagcacgggcaagtttctggcaaaagtgtgtcttcgtacatttggaattttgtatgacctcatcaataggcactgtgacccactgtttagttttgaagttatgattcagaatttgggagagatgactttgaagaatatttttagaatacaggttcagggcttaggaccagaacaaaagagaattcacattatctttaaaatctagattactatgatgcctttctcttataaaagaatcttatttgttctaataactgatacctagttattatagcttttggatggcatctctacttcatttaaaaaatagtgattttactcacataaggctcatgttaagtgaactcactttgtagtactttaaaaacatagaatgtgctctgcaatctagtccaaacactatggtgcgagcccataagcattatatacaattatggagttacatttgattttttttaaaaaaagaaaccttcgcatgtcccaatatggctttggatataaagcatataacaccaccaggcacaaataccacccctcaaatagagcatacaggattcattcctatacagtattattaaagctcaattagccggatagctgctgatgaaaaaacttacattttaatcaaatgaagaagaaaagtgtagtgattaaaatgattatattaatcaccatcaaagagagctgctgcccaggaggcacactgatctcacacttaatttctccagttttattatttgctctggcggcattttctcttgttagagaaatctgggagcttgaggccaggccctcataattactacaaacatacaaatatctttataacatttatttcctaagacgaaatgaaattattcacaacgctggctacaaaagtaaaacactattcactgtcagaagaggcctctttctgaaaagttcacttacaacatacacagaatgaaaaacacacgatgccccaactctcgccttcctagtgagttggttcaggggcctggatgttgtcaaatattgagatctttagaaattccttcctcagttaattcctcaggcaacagcttttgattttcaaggctcgaaagactttggatttctttcaaaacccccaaacccacaagagagccacattctcccaagtattcagttaatagtcccagttagcataatgctttgaaaactaaagaaaatcacgttatattagaagccttaccctggtttcactttcgctgaagatatcactgtttgccacacaggcaatcagggagctaaaactgtagttaaagtttctaaaatgcatcttgctttcttacagtgaaagcgctacagacccacgcagtcaagcccctagtgagattcctttccaagaggctgtaggttccttcttgagctggtgcttataaagcagtaagggccagcccccactccctggggaaaaaaaaagtgcagcttccacagcatcctgtttggacagcaaattcctgagtcaagtcctgcatgcttgcaggcagacagggacaaagtgtaagtttctactggaaagaggtgacgtcaacaccttagtcattttccctatgctaattaactttgcttggggagaatggaaaaaacagctgaggtttgcttcacagctgctttatcaacctctcttgcagcatagtttccactggtagtaattccattcagctactcagacaacacgctcctcggccgaatgggacgacccttcttaagatggaaaatgttacaaaagaaaaaggatgaaggtctgtggcaataaacagcaattagactgtagggaaatttcaaggctttgggaaacctggaaaccaaagtccgggtgacatacttgatccctggaatttcctgaaaacctcaatcaaagtttcactttggggtattagagaaaacattttgaaatctgtcttggtcaataaaaattttaaaggacaaaaagaggaatcattttgaagtgtagttaaaatttttttccccagtgacattttattggatgaatgtcccaatttctacttgtatcccacagtggaatggagcaaacagaacctaaaacaatcctaggattttcatttgaaaacttcattattataatttgagaactggggatatgaaacacttcgatcattttcaaagcactactgaattcaggcaaaggatacaaaaacactagcctttgaaactgagcaatctagcctttgaaactgagcaaagaagcattaacccatttatgccagaggttgcaattttttgaatttttgccatcagaccttggcaatgaccttgagcaataggatataaataactcccacatgcttagcgttccaataatggaacactaggcataaatgggttaagaggtcctgcttaaagactcataaactaaatgtaaaaaaaaaaaaaaaaaggaaaggaagaagaaatggaaagaatgtacactataattgaaagggaagatgcagggaagatgcctggtttggagaagtgctctgcgatgcaagactgactctagttctttcaaaaggttgcaactcttgaaccttctaagtattttaccagtttagatccctatggcagcctgggtcctatgttcttctcactctctccaattttattatcacctaaaagcactcaagttatttaagcattctctgatttaggggcacacagggacagctctcaagcttccagaagttaaatggaatcctgccattcacatttaaaaattaacttcaaagaatcattaaagtcagccaataatttaaaatacatgcaagaggaagaaacaaagcagggcatttagccttccaaaaaaggaaaagcaaagtccttttggatgagtgagtgttgcttaatttcaacgcactgtgccttgctgccaactgtagagttatgtaagaaaccagttatggtgtttgctttgccaaattatccataactcccaacctgaaaagacataaacgcatgtattccaaaaaagtgtagaatactgaacaatgcaacatgcatcaaacaccaaggggaagtggtcatcctggatgatgcttcgagagggaatgtgtatgcttgcagtcctgcattttcagtacagggagcctttgtctgtccagcaggcacatgaagattgtggtggtgggcaggagaggctaaggggaaacagaggtgaggggagcagacacagtcctgcattccactcctccagaggggcttggaacttctctgatgttccctccccctctccaactctttgtctcccccttttctcttctcctggcatgcacctgggcaaattccattaaaaggtgatcagaagagacagaagaggctaatttagacacaagaggctgatttcactgtcttcttttctcttttaaaatcatgacacaaagttccagctcaattttgtgggcaaatctcaaacatctctgttcatctgagacaacagtgtgggctcacccgaatatacaattttgatttcgttatatggatggaaaaaaaaaaaaagaacggtgaggtatttgaagattattcaactgtctttgctcatagaaatgataaatctttcactagattgcccaaaaacatgtaattctatatctgcctttgaattgatcggttctatctatctgaattgaatttagtaaacttgagcacttccatttttagatcaggagtaagagccggtcaaaatggtggctgccactttgtagggagactggaatgcatgttctctggcaaaaaaatcactggttcacaaattgtaccagagccctggatcagggggagggcacttaggatctgccaccttggttttccttggctaaaatgtgagaggtatggagcagatttgagtttccaaagtgcgtcttgctgagtagcaggaatccttagtggcacttggacactctggttggccaacagggcaaagcacagggtttcctgggacacctgtccctgtacccatagggtaagactgccttatgctcatatcaatgcctcctcatctgcttatctgacaattcttgctaagagagtctgtctttgactgcatgtctattatacgtgaacttgcatttctaaaggtcctatgcaaatgaatttactttataaatagtgattctccccactgagaataaaaacggatccaaagcaagtatttaaaaagctgactttcctacttgtatattccttgtggttttggaggcaagtatattcctgattcttgcttgctggttggatgtcagtgatctgaagaaagcagagcaagacccacagcaagacctctgatatggttgggctgtgtccccaccaaaatctcaacttgaattgtatctcccagaattcccacatattgtgggagggacccagggggaggtaattgaatcatggggggccagtctttcctgtgctattctcgtgatagtgaataagtctcacgagatctgatgggtttatcaggggttttcacttttgctttctcatcattttcccttgctgccgccatgtaagaagtgtctttcacctcccgccgtgattctgaggcctccccagccatgtggaactgtaagtccaattaaacctctttttcttcccagtcttgggtatgtcttgtctttatcagcagtgtgaaaacggactaatatagtctcattagagctcttgagaagcattctaaaacctgcactcaacatgataaaactgaacccagaagttaaagtaaatgaatgttttagtcaactgagagctttagaagttttgcatttcttccactcacaccataaaaatcataaatgagtctttttaacctgcatttgcctcctctggctccaaacagtttccattaggaagtttccattttcagtgaggaaaaattaaggtttatgatgaattccatcattcccattacagcattctgaaagcatcattaggatgacttcagcacatccattatgaactctaaggagttgacaactgcaccaagaatgtgccccctgtgaagctgtctgcaacatgaactgaccaaagacagaaactgagttttgacttccaacactgagcaaaaaatgaggcaacttgcaaaggctctcttgtgaatgaacatgatgacagttacattttatttcagttttttgcttctaagatagtgaaatagtttttttttttttttttttttttttttgagacagttttgctcttgtcgcccaggccggagtgcaatggcgtgatcttggctcactgcaacctctgcctcctgggttcaagcgattctcctgcctcagcctcccaagtagttgggattacaggcgcctgccaccacgcccagctaatttttgtatttttagtagagatggggtttcaccatgttggtcaggctggtctcaaactcctgacctcgtgatccacccgcctcggcctcccaaagtggtaaagtagttttactgttacttcacatgtgtaaccattccctatagaatgtggagcattgttccccagcctaagttactacacaaaaacaaaacaaaacaaaaaacaaccccacaagggtttgctctcttcctcatctttaccactttgtggtctaaaaggcattattaactaaggagaaggttcttattctcaacttttaagagggattaatatcaaattcagagttgtggagaggattcatctagtgatggtggcaaagtgcctagcacaatgcctgaaacacaggtggcggctaaagcacatcagttgcctttctatttccgatttcatcgataaagatattgaggttcagagtggcacacactatgtttaggagagccggaactcactctgggcttttcattgcagattccacgcttgttccaaggaactatgcccgccttgggccaatgccctgtggtactgtagctcatttccccatctctctgggtggtccagggcaccttggatgtcctcctatgtgccctgcaggtccacagaaagtcctgtaggttctctatcccatccttcaccgtgcatagtgctgcaggtaggcagccctcagcaactgtaatatcttcccaactggcctcgcttggcctgtgtcttaccactccaacataatgtgcaagtctgacacataaaaatccctgatgctgaccaagctcggtcacgttcctctcccgctgtataagcttcagtgataagcactgttcctgctgtagcccaggcagactgttcaaggtcgtcttgtgtctttcttgtcacatatcctgccagtgctgctctcacttttatgttcctccaagacaaatggcttatatgcctcaaaacacactcccctcttctcttccccaagtctctgctcgtgctctccctctccctggattattcctcctttctcccctttcctttccttccttaagattgagtgcaggcatgtcgttctccaggaagccaacaatgaccccccgtgttaaaaaaatattattcaatgatgcctgctgaagcccgacaaggcagactttattcaggaccaccacgatgggtatagagaccaccacaaccaggtcttgcagtgggggctgggggcgggggtagattgagctcaactccgaatacagcatggccaagaagcagtgtcagggtcagtggtggaaaattactaagaggaggcatcggggtaaagaggactctggctaagctgacctaataggattcttgctgaagacaggcccgggtgatcagacatcacctgacggatggtagaagatgaagaacccaatcagatattaagggtgggggggttcctgttaaactgactttgcggggttctttgctaaaactgggttttataaggaagtgcacaggtgagcctaggaaaaggttcagaaacctgacccaaatttggccaagcaaaaaatgtttgtcaccccaaacccactcatacccttgtccaaggtttgttaagcactctccaaacttcctacgtctgtctccagcaccgtgctcacttcagtaggtgaccacctatgtgatgacaccctggttctaaacggtgaacctcctgacggcttgagccacatcttattccacttgatagtcctggtgctggtacaaaatagtctctcaaaaatgccagctaaagaaacaaactgatgtctttcttcctgtcactgtcatccactgcttctactttgatcacatagaactaaaaactagttcctctttgacacaagagtcattcatacatttgacgacagatgtcatctcattcacatatccattcatttgatcagcaaatactgaatagccttttacatgatagatatgattgtagatactctagaaaagaatagataaatgaagtgtaaaccctgccactaagatgagtagaactttggatagttttcctggatcttactttcgaacattgcaaattccaaccccccactgcccaccttatcagtctcatttaaacaaatatttttaaaatttgataatacagtcatatgataaaaaacaaaataaactttttttttttttttgagacggagtcttgctctgtcgcccaggctggagtgcagtggcactatctcggctcactgcaagctccgcctcccgggttcacgccattctcctgcctcagcctcccgagtagctgggactacaggtgcccgccaccacgcccggctaattttttgtatttttagtagagatggggtttcaccgtgttagccaggatggtcttgatctcctgacctcatgatctgcctgcgttggcctcccaaagtgctgggattacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaattatgattttatttcccccactttaagtaaataaaaggtaacatgctatatttaaacaaaacaaaccttcaatgacttccctttgctcctgaagttgaacctaagccttctggttcacattcattcacgcatccctccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaagcaggtaggggagtgaaccgttggatgctggggaacagcattctggcccagggaacagcaggtgtggaggccctgaggcaggagaatctggcatgctgcaagcccagcaaggaggctcagggtggctgcggaggagggtcatggagaaagtggttgggaatgaggacaagagagacctttagccattggaaggaccctggcttgtattctacagaagtgggagccataagggggtttgagcaaaggttagcatggtctgttatgacatgatttccatattacagaagtactctggtttctgtgttcagaatacagcgaaggggcgagggggaagcaaggtacccatgaggagacagctggggtaggcagggcagtgggagcttcttctccaaccagtgtccatacctcctccagggaccccctctgcagtacccactttctaaagctcctcagccagctcctccctgtctcattcctgcctgttgaactcttgttcatcctttaaagcctatcattaagtccaattcctccaggagctcccccatcccccaactaagtgttctttcccacctgtaacctggtgactcccacctcccgctgtcaccatagtctgcttggcatcatagtcatgttgggacttggcaatcttcatactacaacaaaagcttcatgaggacaatgcagcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtgtgctctgtgggtgtcacattcccggatgtgcttcctatgtccttgctgtggggggcctagcaggatgccaggcactggcccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaatgctttactggcagatgtactaaaaaatcttctaccaaggaggttcataatccaaaacacttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctctcttactggtaaaatttgcttggccacagggaagtggtataaagcaaaacacataaccttttttttttttgatgggctttgaaggtgttaaccagaatgccccggagaaaatacgggaggtgctggttctgcaactacagagaatgacaactaagaattctaaatctgaaataatgaaattgtttaaaaaaacactttgaagtttaatgagtattaattttctgtaagaaaacacaataactgatattaaacttcagccaggcacagttctgatactttgaaaaaaaaataagaaacgctgaagtatcttttgatactttgcctgaattactacaagagagtttacaaatatgtatttctgggataacacagaacttttattccttagataaaaaatctgagtggctgatttatgccagtgaccaaaatgatggctgcaattatgcctgctctatattcatgttgttaaaggtgaaaatgctaaagactttttttttagcagaatggtgatcatgatctgttaacacagtagaaacaaaaaaaaaatccaagtataaagaaaaaaaaaagaataaaaaagaaaagagaaaaataaaataattgggaaaaacagggaggaagagtgtgtacaaatgtacatcttaagactgaggtcacagttcatactagatttcatcttgtttgttaaattccatgtgcgctcagaattccattaactcttattccgtattgcctcaatctttccttaatatgtaaaggttaaccaccccactgtaacttcttggaaacgcactgcttgcaatgtttaagatgaaaaaatagccacaggcaaatcaaaactctacttaatgacttggagaccagcagatgaggattaggggaggcaacatttatttggagattactggggccaaagccaccctaattaattaccctttatttgttctctctttccagagccaccttgctttaattactgactttaatttctgctttgatgccattctcagccaggggcacagcactgcagcagcaaaaacctggggaagaacaatcacccaggagtgggctggctgtggtcactcaggcccagggaacaccagtgtctggttagccctcatccctgcgctaagcagctttcacaaccccacggctggttcattctcaacaagtcagtccttcacacgcaaagtaggaattctactttccagggttaatgctgcctggaaaaccttttccttccgctgcagcattccatactctccttagaggagatgattctcccagggaggctggcgcagtgaggggtccaggcacacaccacgccggcacctggtgaatagctggctgaatgtcagcggaggagtaaaggtgagagggtcatggagggaaggggaaaaaaatgagcaagatcaaaatctgcaactcttcaataaagacagaaaacccagttctgaatggcttcgctaaagatcgtttgtatccacacccagtttcaaaactcaagaggcaggtcagaaatggttttctgttgttggtttgttttttctttttcaccaagtgctgggagaaaagtgagttatgtgctcttacctgctatttccattaccatacacacaccctgtttccatgtctgcagttgagaagtcccaacagggcactgcaaacgctttctttctgcatttggcctgcattctttgctgatgacttaaaagcctgataacaagtcacacgaggaagcatgtcctgtcatcttcatgaaggtcaccaatgattcaaaacatactgaaggaacaataaactacatacaaagaacaagcaagaccccaccacaacttggatattatctctgtccacccaaagagagaacaactgtgccaacctggttcatcaggaaaatctaggtgttcccgtcaagtgactaaaatgtgggcacacatctttgcaccgagtatctgattcctaagagctgttccctttccatcaggcctagaatggcccagttagttttctcctggtgaactgtagcccattaacattgacggaaaattagttgttaatattgaaaaattgggaggtgtcacacagaaatagaacttctgacttctttttggtggtggtggcccggggagatgtggccaccctgggcccagagctccatttcactgtggccgagcagatgccccttgttggggaacccatgctcttcaaataccccaggcctcatcactgtctgtggtctactcgcccctccaccaatgatggctgctggctgaccagcccccagggcatttcaatttgtggcttaatttggtaattcatcaaaaacagattagtcacctgctagggccagccatggtgtgaggtgccaggcgtacaggcagagaagtttacccagctctggggctcaagctgttctatgcctaacaatttacaccgaattatacatggagagggcatggccctcactcccacatggtaattgtgtgtgtgtgtgtgtgtgtacttattttttcatctggcccatgtatgggcacatcacattcctatgggtgactccctgggcatctgtgaaatgttgtctcccactcctgaaattatgctgtaaatgccagggaatggtggtgacatggttatagcgacgatcttgattctgctcaaacataaaccacagttggtttctttagcaattattaagaaatgattgggccatgtcagaggaagacagaggaagaatctgaactgtaattcacttacagatttctacagaattagctcatgattcatggaggcaaaaaaagttttgtcaggaatggcattcgaagacacagaaaaacaatttgaaaggagcctgaggtccaggtgttttcagagtgtggtctttaagatagtttcttaaaagatcattcggagaagagagcattttaaactgctcttgtacaaatctatggtacattttattccttatgttgaaaatgatgggaagattgtgcctgtttcacccatttaagaaacgctccctgttggtccaagccaccgtgggctcctccatcctgagggaggacacagtggctctactgtcctctgtagaggtgaaattatgtggcacatactgtgatcaaccacagctactgccaactccccagccaattccccatccactccccgccatgggtactggccgcttccagactctaagacagaggttcttgcgcaggggaggttattaggacgagtggtggggaggggaaaggaaactgggcagagggagagtgaagctaccaagtggtcctagtggaagcctagccgactctacagggagctttgaggatgagacgacccttatcggagcaggaggaccgggccttgatacccccacgttggtcagttctgggaaggggctaccctgagaagggggtggaacttgggcaaggtggctttgctctgccccaacagggctgactgtcaagggaggctgggagacaaattctatttttctgaagtgacctggggtgtgtcactgtgaccagtgcaccgaccagctaaccgaccaacccgcaaggcccaagctcaaggaattagaaggctccagacttgcaccctaagttaatcatctgaagtctcagaaatgtgacagcctttaaactgaacactacaaaaatgctgcttattccactccaaatcattagctcatcatccatgtaaggagcttcaagaagaatatcggtaagattagcggtaaattcaaacagtttaaactttcagtataaaccgcatcaactcaaatcccgaatactgactcaacaatttcactcctaggaatttattctaaagaaatcctcatggctgtgggcaaacattagatgcaaatatgttcctgcaaggcaaataaaatatgcaaaaatatagttttatgtaaataaaatacatcaagatccgtgatcagataatatacatgctaaattcattcagtagactatagagccactcatagtaaggtggtgaaaactaatgacatgaaaagatgttcaagacttgctgttaggagaaaaaaccaggttacaaagcaatgtttattgttctcattttggtgaaaagaaagaatatgtgtgatagtattagaagactcctgtgtttttcttcttgattatttggatttggattatttagattctagcatgaatttccacaatgaacacttattacttttataataacaaaaaagcttctcctttccccttccctcactagatgctatatatcaatggtcaaggtaaccgtggttaacagacacaatatgtaagggtaaaggttagttggagagaaaatcgactttgcctgtttttgtgtagtggtttggtatcacggcttttaatatttgctctgtatctgttatgcacaatctctaaacctgctcattttaacccattaacattttggagtgctagttattgaaagaatcctatttcatacctagaaacagggatttcaccagaaaatactgattttgtctttctttgattacctctcctgcctgccatctttatctggtgaaattctcatttaatcagtagtgttggctgagccattctcactggagtcagggctgtctgagtgccaggggacactcatctgaattgtttcttgtcactgccatgtccctacatctattccttgctcacctgcattattttccccattcttcttgcagtcccagaatcacatccaagccccttttctttctccctggatgaccccttcctctgaatctcctttctaacaagactggaaggttacataataaacttctccccattacagcattaatgatgacagttgtttaatatataaggccttcccagagaatttgtatttaatcagcaaattctggagatcagtctgcatctcaaaggaatgcattgctaaggggaaaattccaggcagtaagtcagttacaggggaaaattctctgcacaggtgggctcttccggggctgggtgctgcctacgtattgttcaagcacctacactgagcagattcttgcatggactgactgggattaagggcagacttccaagaaatcactcatgtctccattcattcaaccaccatttgttaaagatctcccacgtgacttctcgaactccttggctgggtaaaattacccctagttcttagtatttaccacactttaattgatttccttcaccgaactaagggtagaccaagccagagaccctggaacccttaaaacccttcataaacatttgttgaacaaatgcatgcagccaagtaactgactcttccttagagatataaagatgaggaaggtatggttattccttcaaaaagctcacagtgggccaggcgtggtggctcactcctgtaatcccagcactttgggaggccgaggtgggcagatcatgaggtcaggagttcgagacaagcctgaccaacatggtgaaaccctgtctctactaaaaatacaaaaattagctgggcggggtggcgggtgcctgtaatcccagctacttgggaggctgaggtagaagaaccgcttgaacctgggaggtggaggttgcagtgagccgagatcgcaccactgtattccagcctggaatacagagcgagactctgtctcaaaaagaaaaaaaagctcacagtgaaatcaatcaagaaatactaagccatgaccaggtgctcagtagtctactagggcctccaaaagcctcagtttctgtccctacaggggcttaagatggaagcttgagtgatgagactgcagctccagtgataatataaatgatctctcttgtgtgtcacagacactcagagctcaggatactagaagtggagcgtagcaatcagaaaagtctagctaggtatataagaatcccatctcaacctccaattggtccagttacaaaaagtcctacagatgaaggacttgagaatagggttaggctttaaataagtgggaaaaagatatacctctgcatttcctcattactacctaaaaagaaaaggtataaggaaagctttccccaatcaacctacacaagaatctgctcagtgtaggcgcttatactagttagttaacgttccactatcatccactgtcatgtggcatcaaataagcaggtgcttttattaaaggacatatatactttactcattttgaacaaatttgatggcttgtatttttttgcatggcattgggttagtgctaatatctattaacggatgtcctggatttcttaggaaatcctacctttgcatatttcattttaaaaataaatgctattcacggggcgggagcgatggctcacgcctgtaatgccagcactttgggaggccgaggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagattgcgccactgcactccagcctgggtgacagagtgagactccatctcaaaaaaaataaaataaataaaaaaaatttttttaatgctattcatgcaacacatttttaaaattttggtaaggacataaaaataaatacattggacaaaatcttgtgtttctgcatacacccaaatttgggcttggaaagtgcctataaacagaggtgaggtggggaggatgccatgtgtggtgtggtgggatgtcataggtagctatgataaagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacaccaagtttaggtcataaaaagccatgcccttctgccttgttctctcggggcacttcctcttggaacccagttgcccaccatgctttcaggaagcccaagcagcccatgaagagcccatacagagacgaactgaggctgctggcccagagctctggctgagctcctcactggcagctggtatttttgccagctatataagtgtgacaacttgggagtggaccctccagtcgccagccaagggaaacccagaggatgatgcatggaggagagaagaatcatctctgtgcaaactgcagattcacaagcaaaacagatgactattgttatttacagccattacgttttgggtggcttgttgtgcagcaatagtaactggaacaacatttctgcgatgggcagaagtggcaaggattgtaactcattagactcagaaggcgaggtcacctgagtaagcagggtccttagtggaacagtgggtgtaagaggaaggagagatgggtgggtgtggggcttcttgccatctacatatgtagggtctgccttttacttgcacatctgtgagaggtgtacaacagagttgtagaagtatggactctggagccaggccacctgggtctgaacctggtgttccatttcttagctgtgtgaccttgggcaaggttctcaagtcccatgtgcttcagattcttcatctgtaaagaggataatcacaggacctacctcatgtggtggtggtggcacaaattgacctaatgcctacattgaggcttggtgcataggaagtttccatgaaagcgttcactgttatgatccacataggtgtgggcctcagactatgagctgggctgaatgacagcccctccctagtccctggagcttgtaaatatgttgccatacatggaagaagggactctgcaggtgtgactaagctaaggatcttgagactaggagatgatggattaccagggtgggcccagtgtaatcaaggtgtctttataagcaggatatggcagggctggagtcggagatggagacaggatgatggaagcagagattcgagtgatatggggccatgagccaaggaaagtgggagtctttggaacctgggaaaaggcaacgaaacggattttgccctagaagtaacgcagccaggctgacacctgattttagcccattgagactgattttggagtttgatctccagaactgtacagtcataaatctgtgctgttttcagccactaaaattgtttggtaatctgttacatcagcaacaggaagcaaatacaaatttaagactggagaaaggtagctttatagaacatccagcagctagaatgttcaaaggaagttgggctttggaatcaataaactgctgtccttttatttcttcttctcctgacttaggcttcgagggatgacattttctttttaatcctagcatgtgaagtggccaaagctcaggcttgggtgtcagatgggcctgggcaggaaccctggctgcagtccttacttgctgggggtcctcagtcaactggtggtgctggccaagatgaccacagtggcactgacagccagagtcagttgcctgctagccattcggagtggtcagtgcccacgaggtaccagttactatgtgctatgaatattatctctagactgaatcctatgaacttcagtttcctcatttgcaatttgggaacaatctaagtcaaaggttgttgtagaatgtgcataggtaggtgcttttcagactgtggctgccacagcagcagtagctgccttacttggcaacttgccagaattcttgccctacctattgtggtaggctgaattctcaaatggccccctggtggacaagctttgcatgatcccgggactctgtgatggattctgtttccacagttaggttatattaccctgggagattatgtggggtgaacacttaaaagggaccgggttctttctgaagtcggagaaaggatgggagagacattctctgttgctgattctgaagatggagggggccatgtggcaaggactgagagtggcctcaaggagctagagtggccacggggatctgaatgtgcttagaagcagattctccgcaagagtctccagacaggaacgcagcccaggagagaaccggttccagccttgttaaccttgagcagagaaccctgttgtgcacatggtgatttctgacctacagacctgtcaactaagaaatgggcattgtaagccactagatttgtagtaatttgtcacacagcaatagaaaactaatatatatttactgaatcagaaactctgctggtttttgtttgtttgtttgagacagggtctcactgtgtcacccaggctggtctcaacgagcctttgctgaatctcttccttgtcagaggagactgctggtccccaagatagaaagtaaaggagacccagccctgctgtcaggaagcacccgcctcgggttggagtaaaagtcacacatgggacggggctgtaagtctcagcaaacagcagtgcgagggacgcacgtggaagaggggtagtgagggcaccttgtgggcaggagagccttttaaagactgtatgacgtgaactccaagatctatccttgaaggccagggagtggttgaaagatggagccctctgatttctgacttcacttctgcaaagcctactgtgtcatttactcctcaccatcagtggagcgagagcctctgggaccacgtctcccgagtcccatgcctgccatcatggtgcgggctggaccagccttcttagtgggatatgttccccatagaaagtaaaccaagaggcaaaagcaaagcaaagctacgaaagcaggctcagtgcccccgccccttgtttcagtgtcacctcaagtttgcttcttgctctcagagggagatcacagcattgcacaacgggcagtgttgactatttgctggcccttgtcacccacccttccaaaactcgggcagaggacaatctgaacaccagtgtgacagtttctaacaaaaggctttgctagtacagtgcctgagtgtgggtgtccactgaaaactaatttcagccctgactaagaaaggcatctcagaaatgaggaagtgtattttgggctcctgtggtttctgatgaaaaatgctgcaatgtggggcatgggtgaaagggaaacactgagaaaatagatgtgacccccagtatgcttccttgaagaagtggggggctggccaggccaggcacaaagatcctttgtgttccctgagcctgtgacttctcccgctgtttctcagcagttacactaacgacattgtggaggaaacagcttctccttgcatggccctgccccttgcactctagactgtttagcctccctgctggtcagtcccctctccctacaaatgccagcagctttcccccagtccttgctgcaaccacaaagtctcgcaaggattttcaaatgccactgggaggatagcggtgccacccatggagaataatgaccccaggccctaaaatgaaacaggttgctctaacattcgaagaatagccccagcacaccaaatgcattcacttaatttcttgttcaacagaaaagaatgacctcttttaatacagagctgctttgaaacatgtcatttcaaacaggtcctaagaagatcctgatatttgtctgtatcttaactggatctctgtgggttgaaaaacgctcatagaaatgttgaaggacatcagtcaatctttaataagatgagatttctcagagatacaacatgctgtttgaccatctgaaggatgctaaaagaaagtgatttactgaaataaaatagataacaaacatttcagtgacttagaaaatggcgagaaatcacgtcaggcaagtttatatttttgtgttaaaaaatccccacctaacaacactctcttccttacatttcttcccagcaggccaagaacttactaaactctggctctagaagaaaatgacattaaaatgctgactttacaggtatatagtctagcatttgttggcagttacttattagtttttttttttttttagaaatgtaaaaactattttctttgtttcaaacgaataggctctaacttaaaataatttacttgtacaattaaattgtctgaaaaaccccaacaatgctgttaacacgttgttaacaggtacacaactcccctctattttaggagctgacgcaaagaagacagcacaaacatgaacaagaaaacaatcgctgtcgcttaaaagcaacaccgtcttagcagtttaaagacagacactgcatgctcacatactaacaataattatgagtctccaactcagagggtagaagtcagaagacgcaaacaacatccaccgtaccaggaactgaagaataggaggaagcaggtttagaatagcaatgggtttttccctgagatgtacattttacaagaagcattcaattccattttagatatggaaaaagagcgtgtttttcccattaaaagggggaaacaggaaaagtataagtagcttgacccattattatgtcctacctggaaaaaagtttttttaagtggagaaaatgattagtcatgagtgcatgacttattaaaaatgactttctgggtaacagagaccagataatacctacgtgaataaatctctccccaaaccctagtttggggcccacacttttgcaaggtctccagtgagtaagacagtaaattctgtggctggcgttttctttggaacacaaagggtcgcaaacaaactcctactcagctgcagccactacccctgccaaaattgagtagctgaggattcagcgaagggttcgggttccacgtcacccaggtgctacaggagcctgagcccaggagcggggactgtcccacatgccaagagaatagggcatatccaggagtccaggcccatcacagcagccaggtttttacctaggtctactactctttccacatcacagcttcccctcacctttctccccctccctcacctgctcactgccatgtatgggaatgcaccccaggaaacacacaattttgaaaaacatcgtcccaagagaaaaaggctgtcatgaagaggccaggcaaatgacctcaattaagtactttgtccaatgctaatggattgaattctgttcccctaaaattcacatgttgaagtcctaacacccagtgcaatggtgctatggtttgaatgtgtcccccaaaagtttatgtgttagaaacttaattgccattttaacagtgttgagaggtagggccttgacaaggtgaggaggccacgagggcagagcccttacaaagggattcatgccattgttgcaggagtgggttagttatcctgggagtgggctcctgataaaaaggatgagtttggctccatgtcctctccctgtctcctgtgcttgcttcagcttctgccttctgccatgcgatgaccctcaccagatgctggcaccatgctcttagacttttcagcttccagaaccgcaaaccaaataaatctcttttatttataagttacccagtctgtggtgttatgttatagcaacagaaaatggactaagacatggtatttggaggtgaggcctttaggaggtaattagggttaggtgaagtcaggtgagtagagtcctttttgcaagaaggtgacagtctacaagccaggaggagagccctcaccaggaatcaaccatgctggcagcctaacctcagacttctcaacatccagaactgtgagaaataaatttctattgtttaaggcacctagaatagggcattttgttatagcagcccgagcagatgaagacacctaccaccactcagctttggaaccaggattctgaaccaaagcctatagatcctatgttcttaacaactgcattttactactctttgagaagaactgaatttagccaatcaatgtaatttcacattgattttcattacttttgctttcaaagttacatatgaaattttttttgcatggctagatatgtgctggatgactaagaattttataattggcatatcaataatcaaatcagttttcctaataaaatgacatgtctgatttctgcaaaagctcttcagtgtcctctcaaactgagaaagctggaaagtagagttttcaaaagagtaaaaataataataaaaaaaagttaaggcagtactgctgagaatttaaattctctgcaatgtcgaaacttttgaaatataaaacttttaaaaacagtttcactgaggtataccttacatcccattttagcacttgtaaaacctttgtctttaactgtattgtgataacattgatatcctgcttaacataagaaatattattttaattgaaaacattattcatgataatttaaaaagctgctattaacttctacatctgtcagtaaatctactaaagtttagttcaaaatatgccggcaaaggaatcttaaattctcttagtgccatctaaataaaactgtatttcttctaagttctattgtaaacaaagcaaaggactatgccagaatatatagcaattagagaaaaatgcctacttttcctctttgcacttattttgtgcgcttgtttcttgttttgtgtaggtttgatgattttgccaaattgcacggtcagcaaacagttcgttgtggtccaacacccaggatagggactatgagaccgtttgccaggtgctaggtggtgttcaatcatctcacgcctgaagctcttcatcagtcttctgttgctcaggctcttcactgtctccatcccacgtgatgaaagacaggcgtgtctctggccagggactaaggcgccatgagcatgtgtgctttgtttgggtgttggtgtgctctgactcatgctctcagtggccctcgaaggcaccaggtgaaagaagagggtcagacaaccactagccacagctgtggcagcctcggttcaaaaatgtaaaatctgccatgcaggcagtttcaaagacttaacctatgcccttgtataattattatttttacttcttttatagcaacgttcattttctaacctgaaggtggttcaggtgatgttctaatctgcttttgagtttgaaaatgcatctaccagatgattcatggtggctgccgaggtggtgaataccgaggatcccaaaatgaaaaattacggagggaaacttagaaaagtagtactctctcacagccagagtggtgctggtgaccctccagtccaggctaaaacaggtaagcaaaatatttgccttgtttttaatatacatcaagcaaaacaaggtttaactctatctgtggcatctacagcagctgtctccaagatggaggacaatgatggggaccaggaggaggtcagcagcctcaatggctgatgttctgaaatatttctgagcggagctaagggggaagtggtttgccaacattatcagtttattcgtttgtccatccatcatccatccatccatccatccaccgaacacctacaggcactgaccatgccagctactagaacccagagatgaccatgccacccagacagactccaggaggcactgaacacagacccaggtgaagttctgaggcccaccttgctccttccccgagatgtgcctgctggtggtggcagtgacagggcggcacatcaatgatgaggtggagtatggaagaatggaagcactgccaagactcctgagtggcagaggcccattctattatctgtggacaccctcgttgtatttctaaagaggttttctcacagagcaaaaccacctgataccctaaaatatcatttagacaattatgttattattgtcccaattcttacttccacgacaaaacagcagatgtgtcatctcccaatgaagatgaagacaaaactattctcaaaaaga

SEQ ID NO: 197 - DNA, 65215 bp, Homo sapiens
ggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctcc

SEQ ID NO: 198 - DNA, 12860 bp, Homo sapiens
ttctttcatgattttaatcatttctttgccagtgttgtatacaacacattcacgtaaaactctcaaaggcggccatctgagcactctgccaacctggcccacccacagagctttgcctagaagctttgtcttttatagaacttagctcgagcaatgatatcattgacgaagtcattgtctatgtccgatggggtggcaatcgcttcaattcctgacttaaaagctgagagaccacctgaaatgaaacacagagaattaggctcaaatattaactttcaacagaaataagcaatgagcattgccaagatgttagctttccaggcaaatcttccaaagcaggcagtcccaaatcctcctccctctccctccctttctgaaaggacgtgctatcccaagaatcactgggaaaattccagattgctttctttctctttttccaaagtctttggtttttcttgttgcaaaaatcagatttgcttttttatgtaatccaggcctggcagaactagactcccagtacatcctctgctgaaaatgcttgtaacattctctcatttattcaataattcactcatctattcactcactcatttattcattcaggaaatgttttcaagcacctactatgtgccaggagaggtgccacactgactgcaaggtacccaagacacacttatttctttgggtatgtgtacatatgcatgtgtgtgctattttaccctagaattttatctctagtagttatgtatgtgtttaacataattgtgctctgctctgatatccagagaggaagatgcctggtcctgatccctgccttcaaggaccttgaagtagagactagaaactgttctgattaaggccgttagagtgtggaggacataacattggccaataggaggcaaacctaataggaattgatgtggttgggtgtgaagagagaaggaaccagagagcctaagaaagcaatctggttttcaggctgggatgactggctatattatggtgcctccaagacatgtaaaatgcagaagaaagagcaaatttatagtgggaagttagtgagttaattccatctgggagatgctgaacttgagggggcctgtggtcagccaagcagagatttccacttggatatatagcacctgaagtcccgaaaatactcacagagtaacattgttcagacaatttggaaagttgttgacagtttcttataacaggaaaaaacctatgagaggtaggcaaacagatagatagatagatagatagatagatagatagatagatagatagataaatttttttttgagagatggggtctcactctgtctcccaggctggagtgcagtgatgtaatcaatgctcactgcagccttaacctcccaggcacaagcaatcctcctggcttagcctcctgagtagctgggactgtgtgtcaccatgcccagctttttttttttttttttttttttttgtagagacagggtctcactatgtttcaaggtatcactcaatagctcagtaagcaatgaataagaaccccaacattctgcagaagaggaaatggaggttgaggatggaggacctctcaaagtaactcagtggttcagggaatgcaaatgcagcctctagacagctcctcccagggccactgctgaccccgtggaaatgctcccagggagtctcgggtcacactggccttcagtggtctcattcattgctcatttaaacaaagtactcagaatacagcctacctttgaggtgctgagcaacactccacgtggggaattttttctggattgccttaattctctctgttagaatcccagtagcctgtgaaaggtgctctttgctatcccaggcaccgacagggtggtacgtttgtttatcaagctagaaaattcagataataaagtcagcatctggatgaggtaacacattttttctgccattcctaatttcctctcctggtattcaagtcatagataccggcctttatccccaaagagtcaattctattgttctttctttcatatagatgagagtcagagaaacaaagtaaggtttgggagaaatggacatggtatagttttagctaaacattctaatatacaaaaaaaaaatttaagttgttttgaaacaaataacacccaaagtctacacatttatagtaataaataattatccagctaattcagataaaaatttgtttctaactgggaaggccagaagtctgtatttctacagacaatttaaaatcgagcctggaagcaaatatccagataatttggatccccttcctccagtttacccaaaggaacaagttgtttcaagtagggcacagttataccatgttttgatccacatggatgaaatttactacttcatgaaccccaagaggacacctgtaacaataatgctatttataagattttctcagttttagtgtattacatattatttattgcagaatggtagttatgaaactcctaaaatactttttaaaatatatctaataatgaataagccttgaataaaataaaaagatgtgttacagaaatcccagatcaaattatgctggagtggccgggcacagtggctcaagcttgtaatcccagcactttgggagactgaggtgggtggatcacctgaggtcaggagttcaagaccagcctggccaacaaggtgaaatcccgtctctactaaaaatacaaaaaattagctgggcatggtggcgtgtgcctgtaatcccagctactcaggaggctgagggaggagaatcacttgaacccgggagtggaggttgcagtgagccgagatcacgccattgcactccagcctgggtaacaagaatgaaactccatctcaaaaaaaaaaaaaaaattatgctggagtacctgtagccagatgccagggtattttggggcttggaagcactgcaaatggatttctagttcaggttgagcttctgtgaggagggatgcagtggggctgatagaaagtttctagctaaatacctgcatcaagccaaatttaagtcccctgtggtcccagccgtcttgcaggacagatccgccatggctttccctggagatgatggctgcgatgacagcagggtccacgcaatgtctctgcccgacttctttgatcagagtctggtaaggttttatggccctcaaatccatctcagcaaacatttcagaaccacggatccctacgtcaatagaaaagaaactgtttttccgggcatggtagtgtgtgcctgaagtcagttcctgctacacaggaggctgaaacaggaggattgcttgaacccaggaggagttcgaaaccagcctgggcatcatagtgagagcccatctctaattaaaaaaaaaaaaaaaaagaatttaaagttaaaaaaagaaaagaaactgtttcttctacttcagaagaaaaccatttttaaaaatttgctaagttagccacagcctctgatcactgctaatgacttgggacaaccattctaagacatccttttgatctctgactgcagaaacaaacagatccacaacccccaacaggtgtcgcttctgctctgtttctccttcaaattgctcatgcctgtaatcccagcactttgggaggccgaggtggacagatcacttgaggtcaggagctcaagactagcctggccaacatggtgaaaccccatctctactaaaaatacaaaaattagctggacttggtggcaggcacctgtaaccccagctactcaggagactgaggcaggagaatcgcttgaacctgggaggtggagattgtagtgagccgagatcatgccatcgcactccagcctgggtgacaaagcaagactctgtcatacacacaaaaaaaattctgccacactagtgcactgggaagcctgttgtactaggagttagccaatgcatgttttagcctggctccgccactagttggttctgttctattgggaagtattcccctccttgctgagtctttgggctctgatttgtaaatttgaggggttggggtctgatgtgaccttgtggttgctgccagctccgacactctaaaaccaggataacgtgatgaagacgactttggaacagtattgcttcaaatggtcatgtgtaacatgaagcaaacacagcagcaccacccaaaaaacaaagccagagtctaatatttattcaagcagtagtttcaatacatggaaataaacacagctggacaaagtttggaaagaatgggggtggaaaatgaaaagaagctggttgttagattggtcaggattgtggtttttgctcatttttaattttgatactattgtcataatgatgattataccttttcaaaattaagtgacttcctaagaaagaatctgaaaacgatgaaagggggaagccagtcatttgctctgcttttcacttaccgcagttcatcacactgtttgcatcacaagtggccccagaggtcttcatggtcatgatgtccccatagcagccgtggtacaggcgtggatgtaggtgaggcttcattgagtgactgaaggggtatgagcccctggaagtgcctaggaggcagaagtgtaactcacatgaatcctctgagaagatattacttgggttgctgcaataaacatcactaaaccaaaggcagaaggccacagacagaactccccaactctcttgttgccattatttgttcctcagacagaagttccccatgcccactctgctccgatcttttgttttgttttgtattaacacaggacgtaatctgaaaactctatgcaaaatattatgaaattcatctcttatagatcctaaatacatgtgcagtctttttttttcctttttttaagagacaaggtcttgctctgttgtccaggctggagtgcagtggcatgatcatagctcgctgcaggcaccaacacctgggctcaaactatcctcccaccccagcctcctgagtagctggaaccacaggtgcatatcaccaggactggcttattttctctttttgtagagatggggttttgctatgttgcccaagctagtctcaaactcctgtgctcaagcgatcctctctccttggcctcccaaagtgctgggattacaggcactgtagtcataccatgctctatgtcagaattaaaactgacaggtttttaagcaggaaacttgagagttttttttttttttttaagattcagggggtacatgtgcaggtttgttacgtgggcatattgtgtgatgctgaggattggccttctattgatccttcacccaaatagtgaacacagtacctgatgtgtagttttcaacccttgcctccctaccttcctccctccctccttccttttacagtccccagtgtctattgttttgagaggaattttaaaacatttctgacacaaatgcctctggagatgtgaacatctagattaacaatttgcctttcttaagccaaaattgacaaatggggtctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaagtacatgaacagacacttctcaaaagaagacatttatgcagccaaaaaacacatgaaaaaatgctcaccatcactggctatcagaaaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattactgggtatatacccaaaggactataaatcatgctgctataaagacacatgcacacgtatgtttattgcggcactattcacaatagcaaaaacttggaaccaacccaaatgtccaacaatgatagactggattaagaaaatgtggcacatatacaccatggaatactatgcagccataaaaaatgatgacttcatgtcctttgtagggacatggatgaaattggaaatcatcattctcagtaaactatcaccaaggacaaaaaaccaaacaccacatgttctcactcataggtgggaattgaacaatgagaacacatggacacaggaaggggaacatcacactctggggactgttgtggggtggagggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaaataaataaataaaattcaaaaaaaaccaatttgcctttgtttagaaagataagaaagaagggcaccataacaatttaaatatattcttattatatatcatttactgtgaagttgagttcctatgtatatttaataaaattagaagtaaaaattgaatttgccaaaataatttaagtcaaatctattcttgtctttttgttctgtcattaaaaagtgaatttctgtccaagtctacctgttacaggagaggcagagcttttgctaaaggagatacaaagttattttctgtaatgttgaaaagtttgttctaacggtttcaaggactgttaacttgtaccttaagagtccaaatatttgttataagacagtacttagggctggatgttgtggcttatgcctagaatcccagcactttgagaggctgaggcaggacgattgcttgagcgtaggagtttgagaccagcctatgcaacatggcaaaactcatttctacaaaaaatacaaaaattagcctggtgtagtggcacatgcctgtagtcccagttgcatgggagactgagacaggaagattgattgaacccgggaggtcgaggctgcagtgagctttgatggtgccactgcactccagcctgggcaacagaacaagaccctgtctcaaatctcaaaaaaaaaaaaaaggattttgttaaaatgtttgatgtaaaaaaaatagaatctggttgggcgtggtggctcacacctgtaatcccagcactttgggaggccaaggcaggcggatcacctgaggtcgggagttcaagaccagtctgaccaacacggagaaacccatctctactaaaaatacaaaattagccaggcatggtggtgcatgcctgtaatcccagctactcgggaggctgaggcagaagaatcgcttgaacccaggaggaggaggatgcagtgagccgagatcgcgccattgcactccagcctgggcaaaaagagcgaaactctgtctcaaaaaaaaaaaaaaaaaaaaaaaagaatctaaccacttctcccacctctgcttctgccatagtcccagccagcatcattgctcatctggactctcctaacagccttctaactgacctccctgattcactcttgcagcccatcctctacttagtagacggagtggccctgtgggaatatgcatgggctgctatcagtcttctctcttaaccttccagtggctttctcctcctttaggggaatagccaagtccatcctgcagcctccaagacctactagatgtggccctctgctcctgttcctacttctctttccctttgttcactctcctccagccacattcttctttgtgcttatccttcaacatgccaggcaggtttctgcctcaaagcctgtatgtttgtggtcccttttgcctagaatgctattcctcctggtatctacatgatcatgccttcaggtctctgtccaaatatcaccttatcagcagaatatatagcgagtttatagacaaaaaaagaaaatagtccttaaacatataaaagacgttaaaccacactcaaaagaagagaaaggccacattaaaacatcattataacagcattttccaactctttttttttttttttttttgagacagagtcttgctctgtcgcccaggctgcagtacagtggtgcgatcatggctcactgcaagctccgcctcctgggttcatgccattctcctgcctcagcctccccagcagctgggactacaggcgcctgccatcacacccggctaattttttgtatttttagtagaggcggggtttcagcatgttagccaggatggtctcgatctgctgaccttgtgatccgcccaccttggcctcccaaagtgctgggattacaggcgtgagccaccacgcctggctgcattttccaactctttagttggcaagagcccaaaggtttggcaataccctctgtgggagaggttgtgaggaaataggctgtcacacacattgctgtggaacacagttttgtgataggctgttcattccagcactgttgataagagcaaaggactgcaaacaacacaaatgtcattaatttagggactggttgagtaagtgatgctacgtccacagtggagcactatgcagctgcaaaaggaaagaataagacctgtatatactcctgtaaaattctctccagggacaaaatagtatttatagaattgtactctttgtgtaagaaaggtaagaaaatacaatcgtatattttgtgtgatttgctcatattttcaaaagaaacaatacaaggatgaatgaaaaactgataaaaattgttagttatggagagagtaagaggaaggtaaagggaacagggataggggatagactaactatcttttttaaagtttttattttggaaccatgtaaatgttatcataaattttaaaattaaatcaaatggggaaaaatggaatcataaaaaagaagaacaaatgaacataactctataacaaattgaaagattaataaacacatagaggagaattatcttaagtgactttaaaatatatccatataagtctataccactacataggaatccatcctgtgaacataaataatcacaagaaaatcttaaattatatttactgtctcattgttggttggtaatactgtcatacttattttgacactattgtatgtaaataagtaataatgctaatgtcattagaactaggatttttagtgtaagatagcagaggtacaaatataaaactgatgtaaaatgcttgcattcttaaatataaatgtgaaatatctgaatgcatagttgttttccttttaaaaatatatattttctagttcctgccactgaaaacacctgaaataaacgacagctccatagcaatggagcacttttacttcccacactgtggtctctaaataccatttcctgctaagtggaaccagcgctcctcagaataatggctgattgcctgcctggggcaggaaatgttcaagatgaaccaggaacatctttttgtgccagagctggtccttatatgttagagacacattaaaaaaaaaaatttttttttccagatggagtctcactctgtcgcccaggctggagtgcagtggccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctcactgcaagctccgcctcccaagttcatgccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctccctcccttcctctcactctttccctctctcttccctttttcctctcactctcttactgttcgttcctctcactagaagataaatttcattaggtcagatactagatgtttttctctgctatatcctcctcagcacctggaacaatgcttggcacaaagtagacatttaataaacatttgctgaatggaagaatggatagttggatggatgaaggaatgagacagaaagggattgtttaaattatctggatcaagtgtccttatattgacaggttcagtatcctttcactgggaggcagtctttgccaggctcactgtgtggcccacagaccacaggcatcaaagttacccaggaagcttattaaaaatgcttatcactgggccgggcgtggtggctcacacctataatcccagcactttgggaggccaaggcggacggatcacgaggtcaggagatcaagaccatcctgggtaacacagtgaaaccctgtctctactaaaaatacaaaaaaattagctgggcatgatggtgggcgcctgtagtcccagctacttgggaggctgaggcagaagaatggtatgaacccaggaggcagagcttgcagtgagctgagatcgcaccactgcactctccagcctgggcgacagagcaagactctgtctcaaaaaaaaaaaaaaaaaaaaaggcttatcactgggcttttcacaccagatctactgcaccaaaatcttgcagtataaggcgaaagaagctgccttttacccagcattcccagttgactcttacacatgtttatgaaccactgctttaagggaactggaatatgaccatggaccctacgctgcctgtgtaggccttataaacacacaagccctttttaaattaagagtcacctttcagctatacacagctaatatggtagctcataattaatctactggctatttaactctgctctcacctggcaatctaaaaagagtaaaaatttaaaactatgttgccctgttttgaccataagtaactggaaattactttcgggtagccttgtttttccaaatttagaattaaacattttagaaacactttcctttcagtcaccattctataattaaagacaacttgaacattgctcataatggcttttcattttgcttaggtcagagttttcacattctcttattcaagatcccttaccaacttaccaacctatctttccagccttccccccagaaaccccctcgtctgtccagaccacactgacccaaagacttttcattcatttctgcctctgcttttttactgaaatctttcttcccatccagcaggctcttcctttttcttattaaatcaccaagcatccttcaattgacatgtcccccccaaaagcctttcacatctgagcattctagttggatgtgagctcttcctcccaaacctttcccagactagtgcttttttcccacctatacacattgaactctcatccactgcttggcattgataattgtctcttcatgtgttttgcttccaaggcactgttccatatacctctcggtaaggtatccagcctgataggtgcattgtcagacaggaagtaagcagatcaataaatattagattatttgaaattcccatagatcctgtttttcacctgcttagcaagcagaacacactgttaattatagaaataatagttgattaatggccaagctggtcagaatgagagcccactcttccattacaggtaatcattgctctttctgattcatgattgtgctggaggtttttgtggacaccctgtgaacaatgctaaatctcagccagtgacttaccaatgagggcaattagtccccaaaacaccacggaggataacatggcggggaatcttatcttccaggacctgctctgatttgaaatagaaactggttaattttaaaacctgaaaatttcctaaagaaaaatttgctttgatattttaaaaagtttagagttatttccaattcactactcatttccctgtttcaagatagtattctcacaggctcagtacatagtttgttggcacactctctttcttaagcataaactcctaatctcacttcaatccaatttcatattgacatgagtcatgcgtatcttacatatgtaactaaatatacactcccatcccacctctaagcttggtaacaccacaattttgttccctttctttttaaaaaaaaaaatactgatcttttcattctagttattcaccctacccctggcttcaaggatcagttttggtctttcattcatttatttagaaatgggatcttgctctgtcacccaggctggagtgcagtggcataatcatagctcactatggcctcaaactcctgggctcaagcgatcctcccacctcagcctcctgagtagctggggcgacatatgcgtgccaccatgcctgggtgtttccattcttataccagggtctccgtagggaaaacaaaataaaacaaaataccaacaggagcatgagaacgtgacttagaagaggtttcctctgctccatttcttcctcaatcaactctattcttggtttcattcaaatggtagcttataagttttacaagacataagaaggccagcactaaccttgtttgcaaccttacagagaaaatctcccctctctgtttgcaaaggtcttctgtactcagcagcaaactgcacttcaagcttttac

SEQ ID NO: 199 - DNA, 16939 bp, Homo sapiens
tgcaggtcaaaattcttcctttaatgtgattcatgttattttaatgacttttaggtcaaactcagattcccagttacaggtgcccttggctagttttatctgtgtaacatttgaggctgcatatgtgatcatggtcttgggtttcatctgagatgttagaagccatgtctcttgaggtacttggctcgtgcaaggacatcattgcagaagtcacagctcaggtcctggctgcttcggacatagccagcacccccactgtaggcacagagtccacctgaaatgcatgagataggttaatgctgacctagggtactcagcagttaactctgattctctttactaactacctaacaggaggcagctggagtttcggggaatctggtgcaatgtattatatttgtccctattaattctgtgcttgagacaactgactgatagcgttacacgtacctctcaggtactggtcaggggtccaggttggaaacctcctctggatttctttgattctagtagtcagaacttcagttgtctgggaaacctgagactcactaatccaggatgtgggagcttgagagccagggtcctgcagggaaggaggcagagaagaagccacgtaagctgggtgggagggtgatccggcttactgggctcaatggcgcttgttcatttcctgtctcttgttctcctttcacctttgatggaaccaatgccaccgtcagtctcctgtgaggtaggttagatagggtggtcatagcctcccttatggggaacaaatttgccagacaggtggagagaacaaaccactgacagtgcacaaactacatggtcagaatatcctacagtgccagacacggtggcttatgcctgtgatcccagcactttgggaggccaaggtaggtggatcacttaagctcaggagttcgagacgagcctcagcaacatgggaaaacttcatctcaacaaaaaatacaaaaattagctgggcgtggtggtgtgtgcctgtaatcccagctacttgggaggctgaggtgggaggatcacctgagcctaagaggatcaattgagcctgggaggcagaggttgcagtgagccatgattgcaccactgcattccatcctgggtgacagagtgagaccctgtcttaaaaaaaaaaaaaaaatatttgcagtaaggagacaaagaacagaagggaaaattcccaaatccatgcaagcacagaaacccatgattagtgtccttgggctgacctatgctcattgtaagagtgaaaaaaaagcacactcctgggtggagaattaaaatgctgagacacgcgatgtatgtgctagcatgcacaacaatagcgcatgtgcatcccggagaccctgaaacatgcttaacagcaataaccatcccctctgtcttatgaataatcatataagctttccatgaagggattttcccaatgtcacatgaggctgtctcattctccacccagctaccagagtgtagttttgctttgcaataaacttcttcgcctacttttaatttggactcgtgcccaaattcttctgtgcggcaaagtcaagaacttgaactggccctccaacaacacctggagatcagacagtaaagccatttatacctgttagaatagctactgtcaaaaatgcaaaagacaggtgctataatttgaatgcttgtcccttgtgaaattcatgttgaaacttaatccccgatgtggcagtattgagaggtggggcttttaagaggtgattagattaatctatgaatagattaatagattagtgggttaatggttatcacaggagtgaggctggtggctttataagaagaggaagagagactaagccagcacactcagcctctcaccatgtgaggccctgagccaccctgggactctgcaaagagtccccaccagcaagaaggctctaccagatgtgtccccttgaccttggggtccccagcctccagaactgtaagtaataaattttatttttcataaattacccatatttaggtattctgtaataagtaacagaaaacagactaagacaactagggttggtgaggatgtagagaaactgaaatcattgtacattgttgatggcaatgcaaaatggtgcagctaccatggaaaactgtactgtggtttctcaaaaaattaaaattagaactaccatatggtctgggtgcagtggctcacacctgtaatcccagcactatgggaggccaaggcaggtgggctcaccaggcaggagtttgagacctgcctggccaaaatggtgaaaccccatctctactaaaaatacaaaaattagccaggtgtggtggtgggcgcctgtaatcccagctactcgggaggctgggacaggagaattgcttgaacccaggaggtggaggttgcagtgagctgagataatgccattatacttcagcctgggcaacaagagtgagactgtctcaaaaaataaaacaaattaaagtaaaaattaataccatatgatttagtaatcccctttctgggtattcatccaaaagaattggaatcaggatctcaaagagatatctgagctcccacattcattgcaaagctattcccaatagccaagaggtagaaacaacctaaatgtacctgacagatgaatgaataaagaaaatgtggtatacacatatcatggaagattattcaaccttaaaaagaaggaaatcctgcattatatgacaacatagatgaatcttgaggacattatgtaagtgaaataagccagtcacaggacaaatactgcatgatttcacttatatgaggtatctaaaatagttaagttcatagaagcaaagaatagaatgatggttgccaggggctgatggggagagggaaactgggagttgctaattaatgggtataaaattttagtcatgcaagacaagtaagttctagagatctgatgtatgacattgtgcctataattaacaacactgtattgtatgtttacacatctgtagccagcattatccttagcaaactaacacagaaacagaaaaccaaataccacatgttctcacttgtaagtgggagctagatgatgagaacacatggacacatacaggggaacaacacgcactggggcctattggagggtggagtgtgggaggagggagaggatcaggaaaaataactaaagggtacaggcttaatacctgggtgatgaaataatctgtacaacaaacccccatgacacacgtttacctgtggaacaaacctgcacataaacccctgaacttaaaggttggaaaaaaggctttctttttttttaatattaggtttgtgactgtaaatctcccttaaagcatttttaccatatctcatagtttctaatatctagtgtttctctatcatcctgttttagttatttttaagtttcactatgatttgtttctttaacctaagagttacttagtgttgtgtatgtgtgtgtgtgtgcatgtattttaaatttccatatgatcagagatatttttaatttttaaaattatcttctagcataattgtattattgtgatatctgaaatttttgaggatttctttaatagatgatatatgatcaacttttgtaaaatgttcctcatgtgcaggaaacaattgtgtatatcctaatggatacgtaaataattacatccccctcatttttctctcctgctctccctccctccccaattaacaatcaagcctcttaattgtgttcttattacatgtgttaattgttttacttatttttcttctatatctttgctggtttgtttattgtataacctgtaaataatcaagagagatgtgttgaaatttcccattatgatagcaggtttattattatagtaataataatttatgctgcatatattttgaggctattttactggcatctacttgttttaaattgctgtatgtcctggataaattcaatcttttttgttatgtcataattctctccataccaaatattttttcttctaaagtgtattttatttaatatatcatagttatcaacattattttgattattgtattcctgataggtcttctttttaccatacttttacttcaaacttttgcatattcaaatgctttaagtgtttctcacataaaccatgtaaatctggatttgggcttttaatctcgttcatacatctgtgtctttaaaccagtaggtttcctatatttatatttattgccattattaatatcgtgtagttgctactatcatcttaatttgttatttcaatgtgtctctctttttctacattcctttttactcttgtcttaactattattattattaatattgttagaggtagggtcccactctctcgcccagactggagtgcagtggcgtgatttcagctcactgcaacctccgcctcccaggctccagcgattctcctgcctcagcctcctgcgtagctgggattacaggcacctgccactactgcctgactgatttttgtatttttagtaaagacaggatttcaccttgttggccaggctggtttcaaactcctgacctcaaatgatccatccgcctcagcctcccaaagtgctgggattttaaagacgtgagccactgtgcccagcctattttgtaaccgaaactatgtctcaccctaaataaggcaaggactctctgatcctttgtctccccaccactgcttccagcacccatcatattgaccaaacctataccctgggttttacttaaaatgtggtccgggaaccagcaacatcagcaacaactgagaacttatttattagaattgcagaactttgggccccatttcagacctactgaatcagaattctcatgtaaacaagagctccaggtgttcatatgcacaataagcttcgagagtcagtaaactagacttaaaaaacaaaaatctgtggccgggtaaagtggctcacacctgtaatcccagcactttgggaggctgaggcaggcagaccacttgagtccaggagttcgagaccagcctgggcaacatgatgaaaccccatctctacaaaaaatacaaacattagccaggcatggtggtgcatgcttgtagtcccagctacttgggaggctgaggaggatcgtgtgagcccaggaggcagaggttgcagtgagctaagatcataccactatactccagcctgggtgacagagccagaccctgtcttaaaaaaaaaaaaaatctgttaagatgatagatctcatgttaatgttaagtggtgttcttgccaaagaaaaaagatagtcaagttacaaggtttgggctaaggaagggatgagcagacctttcactgctgcttcagcttaagggtgtaactcagttaatgactgagttagtgtaggtagcagtgtgatgccctccttcaatgctgccagtgcaaaccctccaaacagtccagaaagggatttttctgtctgaacttgtaattctttttccagatagtctgaacgtctaaagggacttctaacccttcttatacgcctttgattatcacttccatgtaggtttcatcatatttgggagaaatgtccaaatctagagaattctcttgtttgttgttgttgttgttgttgttgttgttgttttttgagatggagtctcgctctctcgcccaggctggagtgtagtggcatgatctcagctcactgcaacctctaccccccaggttcaagcaatcctctcacctcagcctcccaagtagctggaattacaggcatgcaccaccatggccagctaatttttgaattttagtagagatggggtttcaccatgttggctgggctggtctcgcactcctgacctcatgtaatccaccctcctcgtcctcccaaagtgctgggattataggcatgagccactgcgcctgacccaaatctagggaattcttatttcatcttcaaaggaaatggactcatcctttcctcaaaagccagattttacaaaggagacagaacagcgcagcagaaatgatgccagccctaacatcacaagatattcagtcccagttctgcctcttgcagctgccatgtgactttgtagcagcaactccttccttgtgattctatttcctcacttgtcaaggatggattacgtgtccctcacctcatcttatcagattattggatgggtctccaaatcgaagtaaaataaagtatttgaaagtactttaaaagtatcatacaaaaaagtcaagggaagcaaatttggagagatcattgagaaataaatttttctaaaatcttaaaaaaaagactgcaatactcacaggttcctcaacaacaaccacaaaagcagtgtgagatcaatggaaaaaatcaagcctcattctcacccttgccatcactgattccctggcgcagagttaattcaacagtggattagtgaccattccccagaagtctctatctggcaagtgacaccagacggaattcatgcaaaaataaaactcaatcttcagaactaagaattgtatagaaaaaggtaaaggaaaataaatttaacattttttgagaatccaacagatatcaggtacttttttgcattgtttcatggaatcttcataataatgctgtaagaatggcattttataggtagagaaactaaggcccagtgagattaaatgacttattcaaggccatgtggctacaaagtaactgaggaaagatttaatctgtgatctttctcttggaccacttaggtccagaaatccagaatagggtggcccggatgatattctggaaacacggcattatttactgtgaaaagaaattgtggctcaacatgaaacagaaatgttgctgctcatatctctcaggcagaactgtcactgtcacagctctagagaccttcattcatgctgtgttctgtgaagctttgccatcatccaaaaaacaaagcagtggtgccacatagcagaatggccacatgtgtcaacggatgaagagttacctgcaccatgctagtcctatcgcccatgttgaccagaattttgtcaccgggagacttcctggacaagacaccagcgatcacggcaggatccatgcagtacttttggccaatggtttgcatcatgggttgatatttcaggaggtatggcatgtctatttcagccagcctttcagaagcacgaactcctaaaccaaacgcaaaaggaatgatgcagcttgttgtgacttatgctgcaacaggagctcaaggggagagagaaagaacaatccaaggatctgagtaatggtcgaggactgacaatcccagattttggtcttaaatctttagtagtggccactccctgacctgaggttagggctctcctcctgtgagcttgagtcagcatcccctgagccagggtcccctgtggctgtcagtgcccttcgactgggctctcaggggctgctctggcccacccaggacaattccatggccataggaaccattggtcccattctaagcaccccaataaaatgaaatgtgcctgcctatcagctgcaacctgacatgaaggagaaattctgcaaacccttcaataagtctttagatagtgttcctcaacaagtttgttcacaattgcacagttttccactcctaaacgataccaacaaatcatgcaagtttaaacctttctgaaataataagaatgctgggcaaaaggaaagccaatattaatctacttagctagccttaccttctaggtgcttttatggtttaaaaagcaccctcggccgggcgcagtggctcacacctgtaatcccagcactttgggaggccaaagagggaggatcacctgaggtcaggagttcgagaccagcctgaccaacatggtgaaatcccatctctactaaaaatacaaaattagccaggcatggtggcacatgcctgtaacccagctactctggaggctgaggcaggagaatcgcttaaaccggggaggtggaggttgcagtgacctgagattgcaccattgcactccaacctgggcaacaagacagaaacttatctcaaaaaaaataaataaaaataaaaaataaaaagcacccttgtccacattgtgtcaatcagagctcacaacaacactgtaaataccgtactgctagccgccttgccacggatgcaggggcagctaagtgacttgttcaagaagcagagctttgggaccccatacccggaactctttccaacactcagtagcgtgaggcatgggaaacagtgaaagccgggggataggttgagagggcgaaagctcatagctaccacagtagttcaggccgtgacgtcttccaatcccacaagatgctccaggggtgtccaggctttggatgtttccatagcatccccagttgctgctttcagacaagtctacaagttgagaaaagttcagcctaaggcatggaactagttctcatcattcttctgtccatgaataaaattacattaataaaagtaacaataataaaatccattacatcaccttcactctgcaattgaaactcttgaaatttaaatgagaaatatcccataaatgatcacaaaaacttcctcaataccaaattctcacctgctcccctgcagacatgagtaactactggagctattgaagcagttacactctttgtaaagctctggtgccctttgatgttgtcaggtggtatcttggaacacaaaggagaggatttgttccctgtaaagtagtcctcatcttacttttttttttttttttttttttttgagatggagtctggctctgtcgcctagtctggagtgcagtggcacgatctcgactctctgcaacctctgccttctgggttcaagtgattctcctgcttcagcctcccaagtagctgggattacaggtgcatgccaccacgcccagctaatttttgtatttttagtagagacgaggtttcaccatgttggccaggctggtctcgaactcttgacctcaagtgatccgcccgcctcggcctcccaaagtgctgggatcacaggcgtgagccaccgcgcccagcctcttctttcatcttatatgaactctgagcacttctccgtcaaatactcctaacttgttgctctgatgaaatatttatgtttgctctggagaaacaagtataaaacctggatctctctgggatatcaacccagatccaaagtaaggcactgctcgtaaatgaggatttgaggctggctacactttctctcaggtacacttctagataagagcctaaggctgcagaagggagtgaaggagagaggcatgggaccagtctccacatgggatcacccactttccacttcttccctttatctctttctcctttccatctctctctacctctgtcattctagtcatcactgaaggggaggagtggtttcagacactcgggatttcacaaaggccattgaagaggagaatgttctttctcttcacaccaggaggagagtgcatgagtatttagatctacaattcacacaaggtgggtacacaagtatttataatatatctacaattcacaccagaatggggacacatgagtcagtactaagatacctacagtaggcaggaaattgctccttttgagaatcatctcaccattataaggctgtaagaatgtctcattagattactctttaattaattaattaattaattaatttatctatagacagggtctcactgtcacccaggctggagtgtagtggcatgatcatggctcaccacagcctcaacctcccaggttcaagctatcctgccacctcagcctctcaagtagctgggaccacaggcacaagccaacacacctgtgtaattttttgaagagatggggttttgccttgttgcccaggctggtctcaaactcctgagctcaagcaatttgcccgcctcgacctcccaaagttctgggattacaggcatgagccaccgcatacacctggtttactctgtttaatctatttgatcctttgactaaagtagattagattatcaaaccttaatgatttgcagatctttggagatatatctattgcctataatcatatgtgtcctgtgtgtttacataaatgcattttcaggttctactttcttagaactttatggggttgataaatactcgtcttttggagtaaatacttctactttacaaacttgtgataagtaacctaagaaaaatgtggaaatgaaaagactagatcttttatgaatatactaaaaattaaaccagctgacaggttcttttttattttttaatcagtgcacttttatctttatgactggtgacaaatacccttagtactgcagttggttttatcactccttggttcctgccttgtggacctctccctagccacactctatgatcctcaaaattctttgtattcccaatgcttagcaccttgtaggcatttttaaatatttgttgaatgaatgggtcaataactaaatgaatgactatgagacctcatctaagaaatctattaaatttagagtcaggaaaatttagcttctcctgaggaactttgcttcctccttttatttattaaaaaacaagtaggctgggcgcagtggatcaccctgtaatcccagcactttgggaggccagatcacgaggtcaagagtttgagaccaatctggccaacatggtgaaaccctgtctctactaaaaatacaaaaattagccgggtgtagtgacaggcgcctgtaatcccagctacttgggaggctgaggcaggagaatcgcttgaaaccggaaggcagatattccagtgagctgagattgcaccactgcactccagcctgggtgaaagagcaaaattccatctcaaaaaaaacaaaaacaaaagcaaaccaacaaaaacaagtactttccctttttcctccagctgcaaagctgaagttcaatcacagcaactaaatcagcctcagtgattagcttagtcatgtgtactcggttgccttgattctggttttctatttgaattagtcttattcattagtcttattctggcaaccacctcaattcttctatggaaataaatgctttaggaataaattcaatttggcattttttatagtggacaatgagcagctattgatggtgtatatttaaagtctggcttcaagcagtgctgttttaagcccaccttgcattccagagaaccccaatcttttgtgggacatttggggagaggctgattgttggtggctgttcctaactccaggatttgttggacagtttagggaaaaaataatcttttttgttgcattttcaagtattagaagtgccattgtgttcctgtgcttatccttcccatctccaaagtcatttgtaaaaatcagccacactcacccatcagggcaaggaggcccagcagcagccacaatgcagacatgatgacgatctggctctacggctcctgaaacacttttaaaacaaaaattagcttgagaatacaaaaatatcagtcatcatcataaccacatgtaatatttccacagaagcaggggtgaaaagaacaaatttccccatatctgacctaagaaaatgaattatttgaatcatagtgaaaaaaaagcaaaagtaggacaagtaagtgctccattcatcctttcaattaatctaaaaatgagaagactcttactcagcccacaggaactcaacatacagtcaagttactaactactttatttcaagaaggcaagacactttgaatctcaaccaccaagaaacatactgacctggctccagaccctgaaaagcaaatttctgatgcccatacctcatcccaagagcctttttattatctccattatcaaaaggagaattttgtattggtgacttcttggaatttaggtcccttcttcttcaggtttgaggaaagaccacgctttcctcagtgccctggaatgtacactggttggaagacgtttcccactgctctaaccccagcctggaatcacagaccccctttatcaccttgagccatgttccccattccccctctgtaaaaccccaatgcggcaacaaacctggaccagagcccagggagaatggagctacctccaccagcaaatccccaagaagctggctcatgggcaggggtcccaggattgaactcatgaggtgctcacaagactggagaatgaacacgtggccaacatggagcacccgctcatgtgctctctctctctcttatcccaaccattcccctaatcaccttccatgagtacaaacagccctggttctcctactggctaccaaaccaatacacaaataccaccaaggatagtttgctgttaacctcagggaatggtagagtttctggacctttgcctccaaagcgcctcccaccaagccctgccactccagggtgtatgtcatcattgccccagtcagcagagcctggcagcctagcattttgaattattactgtcattacatgtaggaatgtgcatataaacaaggcacttggtactttcataatgcttctctcatctcttttgttttgaggttaaccttatgggttgtttctttcaaacacccaggaagagatcacatctcaagatggagaggctttaaggaagtcatttgaagccaggtgtggtggcatacacctgtagtcctagctacttgggaggctgaggcaggaggactgcttgagcccagagggtcaagggtgcagtgagctatgatcacaccactgcactccatcctgggaaacagagcaagagcctgtctcaaaaaagaaaaaggaagttattcgatttctgtcttcttaaactgagggggcatatgcccttcagttgcagtcatgctttttgttattctctctacaacattgagatggtctgtccgattttgcttagttgagcacaaaatgtcatggtcagtcccaacaccaaaaagattcagggacctggaatcttagctgggtctgcaggaacgctcagatttaatcacccaacaggagtcatttattcagcatcctgagcctccagcagtaaacaagagaggacaaccaatcccaggagaaaagaatggacaaagagctgcttgggtataggaaaagctcatggtctcatgaaagtgcatcactggctttatggaaggacccttcaggaaaaagcactgctcacattcaaatgctccacccagggtatttcactctttttgctgcttttccaggaaagaaaaaatacttcctcttggaaacccaagtggaaggactcagcttttattgtaacaggagagctaccgtattttccatgcttggaactaaatatctgtgttgagaagtcactttaatgaaagagtctatgtaaatacatgtgccacttaatgggaacacagaattactttctagttgctcctgggaccaggtcatcaaggtaaagtttttcaatttcatcagggaagagcaagaagtgacaatggaatttttcttttttttcttagagccagagttttactctgtcacccaggctggagtgcaatggcacgatcacggctcactgcagccttgacctcctgggctcaagtgatactcccaccttagcctcccaagtagctggggctagaggtgtatgccaccatgcccagataattttttagtttttatgtagaaatgggtctcactatgttgcccaggctggtcttgaactccaggcttcaagtgatccttccacctcagcttcctgagtaggtagggttacaggctcaagccaccacacctagcttggaattcttaaatggatgaacaatgtcattttgtccataaatacagcatattgaagcaacccaaactctatggcccaactttacaagtgacgaaaagtactctgtgtttagaagagattgttgagacatcactcgggtgtgctcaaagagtgtctgtcagttccctatgactcatttgttaattcccctgtggctccctgcttaaaaccattatgaagatgtcagaccaaggcagcacagtggtcatgatgtcaagcacaatgtttatggtagcatccctcttctcccttcccagagagcaaaatagtaacaaacagcaagggggtgtcaacaagctggggcaacaggcctgccaggcacactggaaactgacaaccagagcatccctcaggagctacctcatgttcctggtggctttgatggggacatcttcctctactcaccctctctccactgagtactttggaattcccaaagcactgtgtaagtttgtaaggcataatggaccatgtcttcttcagttcatcaatttttctagaaaaggtagaaacaggtatctttggtcttatggttttctcaccttagaaacttttccatgaatgctctcaatctttaccttgaacagtatcattgcaggtcattggggccctccatccagcccagaaatgtgacgtattaacacctcaacgtgcccaatgaaggtgcccctgccccattgtggtgtccccatctaatcctgagagaactgagaactcctgtatgcatccacattaggcatggtctcctgctctaagctgtgttgtcacccttgtttattgctaacatgtctctgtgtctacctactcattgtgtgccaacaggcctttctttttttaattttttaattttaattttaattactttttgttttgttgggttttgctttgttttgtttgagacaaagtctcactctgtcgcccaggctggagtgcagtggtgcgatctcagctcaatgcaacctccgcctcttgaattcaagtgattatcttgcctcagcctcctgagtagctgagactacaggcactccacgcccagctaatttttgtatttttagtagagatggggtttcaccatgttggccaggctggttgagaactcctgacctcaggtgatccacccacctcagcctcccaaaatgctgggatcataggcatgagccaccgcgcccagcccctgggtttttttctttttcttttctttttgttttttctttttctttttctttttttcttttttttttttttttaatcgagacaaggtctcactctgtctcccaggtgggagtgcagtggcccaaaattgtggaatcatctcaccattataagcctgtaagaatgtctcattagattactctttaatttttaaaattgttttaattttttttttttcaaaacatagtctgactgtcacctaggctggagtgaagtgctgtgatctcggctcactgcaccctcgacctgcctgagctcaggtgattctcctgcctcagcctcctgagtagctgggattacagccctgtgccaccacgcccagctaatttttgtatttttagtaaagacggggtttcgccatgttggccaggctggtctcaaactccagggctcaagcaatctgcctgcctcagcctcccaaagtgctgggaaccaccaacacctggcctgttttaaaattatttttaattttttattattttaactttttaatttttttaatttttgtttttttaaaatttttaaatatttattttattccatttttaaaatgtttaagtttttaaatttcttaaaggccttaccagtagcatcatgtcgtactcatcctcttcttgctattctaatcttctccctccctacatatatacacacacacgtacacacacacacgtacacacacacacatgcacgtacagcaacactccagcccattgcctcacagattgctatgcaccaacaggcctaaaattaaaatagtaatagcaatgtagtcacaaatataaaataatataaaattattctgccactaagatctttttttttttgagaaaaatacaactttttagagcaaaaatatagggcagcaacaggaaggctcattttaagctgttacgctgcgtagagctgcaccttcacatggcctgtgaaaatacctattcactgaatttggattgtaatcaataattaccagcctagaagacctctgaaagtttgatcattttcttccctctgggcaggcaaatcttccctgcatagagacactgtgagctggaagggagttccttctctcagtgcgtcctctgtgcctgcttttcccatttgcgtttttgagagttcagaactccaggaaggatcatcctatgctggagatttccccgtgaacgtttccttctgcacagagcaaatcagggagacttggcccctctgttccgtctatggactctagaggcgtatctgtctttttagtctgttagccgaggctgttagacatgttggccttagttcttacacagcttgcagagaaaataagattgttatagaaccaatactcatggtctatgggttaatgtagcattggcaagactgcccatgagggcaggcaagggatttaccgtctggcaaaatacaaacaccttagtcttttggctttcagttaacaaatatgacgtcgcatttggccctattacagctacagttaagtgcacacacatttcttttctcccattattcgatttgcacatgctcacaaatccaaaagtaatgacatacttgcattaaaagatatctaaattttgatgagtgttgtaatgaacaggaaaaattattctatcatctacaaatcttttcaaacttgggttttctttgcaaggtccttaagtttcgcctgagtccaatatttcttatgcagcagagacacaatcattgccaactgatcaccatacactggattttcatcctcaataagcccgagtgtaagatccatgcctctgcttcacactcacctgtcttcagtcagtgctcctccttagaggtggtgagcccacagcgatttatatagagtcctgttctcttgttaaaagtgttcatctcatcctattttggagagatttatgacatctcataaattat

SEQ ID NO: 200 - DNA, 117096 bp, Homo sapiens
ttaattaaaaattgttacttacgttgctttatttcagctacaaataaactttatttgatgtaatgtaataaaacattttcaagtttaacaatatgtatctgaccataaataatcatttaaattatgaatataatatatacggtcacttcagcaaatttgcggttcaggaatttgtacaagctttgtctgaaaggacagtgccctcctcccctttcaggaaaggtagcttttccccatgtctggtaagaagcaatgtcaatgggagttagaagaagtccataatccatgtcagaattccactttatcctgtgagaggacagcttgctttattgtaggaaaataatattctctttcagttcactcttatcaaataaagaattgcattcatttttccccttgtaggtacaggtactcttctattctcatctactgtctttctgtctccttagctcttaattactacatagtgccatttaaaaaatatatatctgcaaagagaccttttctgtttcctcacctgcctttcatgtctaccattttttggtgggtaggggtgggaatcagaggacagaattgcttaggcacacatttgatttaagatacatagaacacaaaaacaaattctctagaaggaacagactggtgttctgaagcatttcccaagagtggtccaggtgacctcgcttcacacaatttggtttaacacaatgcagctcaacaagaatgaacatgtttatgccccatctccagaagcatcacatttcatggaaaacccatcattcccacacttcttccacataacatacagttatgggccagcccatgggtgggcccactgcagccttgtagaaaatgagagtcaaaaacatgccaataatcatgttaattacaacgcagttgggtaccacttgagcttcactgcgataaaaatcctcacagaaggcatcccactcccctctcaagacccttcagagcacgagaaaaagctttgctcatgttgtatgcttctctccatcctgagacctgttcctgagttataccataataagtgagttaacacagaaaagtacataggtggggaaatcacagagaccctgcagaaaagccaaactatttgacagaagcttgaaacaaacactgctctgggaaatcatttgtattagctgatgactggattctgttttctaacatggacatgcaacatattcaacactacgctcaccgcagtttgcttggaaaagccttctgtcatacaacaaaatacattctgtctcatgaatgattcctgcatattcaccacaacgcctagactcagaagcatgggaagtgtgcactggaactttctcccacttgcatggatttggacatatgcaaagcaccagaaactgcttcctttctggaactcagttctgttggtgtgcttactgctgagatgatctgctatcttaaactgagaacacacaatagcactgatccacagaaaaaaggagaagtcaccatctccctcataagatagtgtgtacaacagatcaccctgtttgtcatgttttagacatcccaagaaaggacagaagctgcattccattctgcagactcagcaaatgacttccttctgtttccacctctattttgccttgtttatttcatctccattgttctgctttcaatcatgaatcatgacctttttttctacagtagtcagcattttgtctaaaaaaaagagagagaaaaatagaaaataatttagtagaactgtaaatgtgagttttcattttgtggtaggtggacttaatttttacagcagtcagtaatttgaatcatttgtggcttttaagggattatgagtatccttcaagggaaagaaaaagtgttgtgactcttttcataaatttcataacttccacaagttgccaaggctttaatatatttgcaaatcagccccaaataacccatttagaaattcacctttttaatacagctatagcaaaaaatgactttgctctcaaaaatccttgcaaaatactattgcacctgccccacttgaaaagaataatgactaaataatgattaccaatgagacgtgctctctccctcaaacctaggaaggtgtgttattgtaaggtatgtgtgtagggaccaagaaacttcacttctctccctcgttcctagatgctcagaagtggcattagtgatagagaagtgtcagccaagggctgagaaaaagtccctttctcctggtgtaaagccactcccctgactctgcacctccacaggcctcaacttaccacactacatcatgtgcctaagagctaggtctatgaggacccagagactgggactgtgcccctaatctccacctacccaccccatctaaagcaccccctaccctgccatttggctgtcttgcctgcagtcctgctcttccttctttgaggtccccctctcagcccagcccttcagatgggtgatcaatagatggattttgctggagacatggtttctagcttttcccctcagcctcacacaataacacctgaggacaagtactgcacttcagcccagactcagcactctaggctccacgtatctgaagaggggactggcaaccatctgtgctccacagacacattcctagcccagggccactgtctcttcccagcacaggagagacagtgctttctccagctcagcacggctctgctcacatagttcatgttctgaattcctccagaccacagcactatctccaaagtctccctttccttgctacccacctgctaaccaattgtgatggtctggagattgtagcacccacacagataccggtggcctcttttctggtctcaacagcaccctccttgtgcaggccctcctgcaatttatggcaattcaaagcaaatccataagtaaatcaaattttaaaagaaaaaaagaatccttgattatatttcattatcatatttggttttatattaccaatctgtgaatacttgtgaaaaggattaaaattgatagcagtaaattaaaattaccagtgcaaaagtattcacagcttttcctccatctattcacttcattaccccagggaaaattttcgagtgcctgatgaactcctgaggttctggttatgctgatcaagaaaatggggagaaatgggtaaatatttgggagtaggaacagtcttacaggtttgtacaggaaagaaagaaactattatgtaggagaatacgtagagccaagaaggcagagcaaggcgaaaaggtaagagagactagaagcccagaagctagatgggaggaaaagagctggagaaagccctgagtctggaggagtccagaatctgcacggtggccacaagatgagtgagagctagagagaggcagggggagcaaagggttctgattacaagtctcctactagccaccaccacctctgcagccaccccagcacactagattaaaagcttccagagacttcaactgtcccttactcatctttctaccctaccatgcctggttccatgctttgtacatagcagaccctcaaatgtttctgggaaaaacaagccaatgaagagactccttacatccattttctacatttggagttatccacacagtgctactgcatcagtcttgaccattttgatgactccattcccctacttgcagattcactgatcctacttgcagattcactgatggcttactactacagagtgtcccacatttagcattaaggattaggtacttctttgttggggggtgggcggggggttgctggcctgtatactgtaaaatccttaagagcagccctggcctctacccagtagatgccagtagtgtgccacccagacttgtgacaaccaaaaatccctccagaaatggccaaatggctacagagagttgggatgggaggcaaaattactcctgattaagaaccatttgtcaatattaaaagtccaaattcttggagctagcatagaagagcctttataatttcatctcaatctacttttctgctttgatctctaacagttcctgcacccaaatgcttagcttcagccagatggtcctttgtataagctcccacattggtgcctttacaaaaaaagtcctcttcacctagaataccatttctgctctcctttcactataaatgctttgaccaacttcatagacatgcttgagttcatatccttcaggaagtcttctctgattagggttagtgtaagctctgagttattttcctttcctttgaatcccatagtttttcctgtctccacctttccttattacagaaaggttgccatgtgcatatgtcttagcctagccaggctgctataacaaaatcccataaattggtagcttataaacaacagaaatttatttcttatagtttgagaggctgagaaatccaagattaagccaccaatagattccatgtctggtgagggctcgctgtctgcttcatagatggtaacttctagctgcttccttacatggtagaaggtatgaacaagctccctcaggcctcttttataagggcaataatcccattcatgagggccctgcccccatgacctaattacctcctaaagaatccacattttcatagtattgcattgggaatttggtttcaaaatatgaattttgcaggagacacaaacattcaggccatagcaacatatgtctgtttgtgtaaggtatatccaacaaaattatgtgcataaggacatgaaagatatcatctgttttctgtatcttcctcaatgcatggcagccatattagaaatttcctaaagttgatggatatttttaggctaatcgtccttaatgaagtagatattctgtaattataaattcaaactgagagaaatgcaaagaagatacagcagactatggcctgttggccaaatacaactggcagcccctttttgtaaataaagttttattggtacacgggcctatctgtttacttatgtcagtgacaaattactcatcagtgagatgagtagtttcaatagagaccatatggctagcaaagcttaaaatatttaccacttggcccttcacagttaaagtttgctgacctctgtcttaagcttacaggaaaacaacacccaagcctccagactagctaaagatacaaaggcaaatatctttagactttatgttagctgatttatttttataaaaggcacagtagcatagaagttaaaagcacttttgaacacagatgtcctgggctcaaatccagctctatcactctctatatgactgtgggggaaatcatttgacttctccacgcccttgttttgttattttcagaatggaaatgaagaaaactaacctatcataaacttttgaggattaattgatcaaattcacataaagtgctcagcaaagtgtctgagagtgaatcctcagcaaacgcatgttattattttaaactggaaaacctttttgtgctacattttaaagattaccattttatgatctatctgaattatctatgaatcattaactaaaataatcaataaaatgattctcaagttttttgaccctatggatgcatgcaaatatagcagtgtttccttgctcatgactttatctgttctttcctactttatacactggctgcttaactggatcccctgccacccatctttcccttgtctgccctcctcactattgccagagagaccttcccatgttactcctgagaactaaaaccaacacgctttccttttcctgtgctaaaaaatgctgcagccaggcaaaataacctagctatttgttctaggaaatagtcactttcagaagactatatgccaacaaaaatagcctacttatcaagactagtttgctcattaacactcacttcacagccctcatctagctgtacttaccagtctaaagctattatgtcataaactctgcctaatcctcaccagttccctaccttcaaatcacccagcccaagccccaaaaccctatcaatatccttgccttatttccttcatctgagaaactactaagactgtctaggagtggataccactcgtagtgcagtaagtctaataaactttacttacttagagtaacaattcattctcattgtcttcttagagagcttatggctagtctccagctcaaaaatattctgagactcttcactgcctatatactgaagtcacttgacaagtataactgcataacattcaatacaagcatcggggtgattcatatcacagctaccacttagggactgtgtgaacataggtcagttacttttgttcctgagccttaagttgttcttctgaaaagtggggatgctagaagcacctattttgcaggtagcatgctgcatagcatgtagcgggtgttcaataatggttagcagttattacttttatttatcatctattatgtgtcaagcactgtactagattctgcagaaagaaatctgattaagacattgttccttctctgaaggaattcaaaatcctaatggtcagttcaacgaactcttataggcatagtaagatctctgggtttgcttacagtacatgttctagaacttaaaattacattttttaatgctactttttatattgtgaacaatctcgtgtacaaaagagtatatagaagtaaacatgaatgcctgtgaagctacactcagcttaagaattagcatagctgtagtcttccaactttcagttgtaagataaaggcagtccagtataagaaaaatgagtagcactgggattcagatgatgtggaatctagacttagttgtgacactagctaagtgtgagacatctcacttttcaactcccagttagctcttctgttgaaagacaggggtggacaagatgaccaggaaggtccctctctgctagagtggtccctggttctctagtctactcctccctgccaggctcagtgaagaacgacacctccaacactaatctgctcattctctcaccagaaccttccaatttttcattccaagtttatttttcccctgactttcaaacgtgaagaaatctcctctacctcacatttaaaacaaagtcttcatcagacatgttgacacctctaactagtatactatctctttccttctttacaatgccaaatttttaacatgtgggtcacttctgaaatttccatttctctatcaccatcagatcctttttcagatcccaagaacctattgtaattgcttccttgaaagtcactaagacttcttagaccaattcttggttctcacctgccaagatgggcaggaacatttcctaaaagctcctgtggctctttttcttttattttttagaggcgagtcttgctctgtcaaccaggttggagtggcatgatcatagctcactgcataatccaacccctgggctcaagctatcctcctgcctcagcctcccaagtggctaggattacagaggcgctccaccatgtccggctcttgtagcttttaagaccttgcctcatcctggcatctccccacactaacaactcttctttttcctgggctgcctcctttcagcccaggtgaatgtaactgcatactaaaaagatcattgtgcctcctacctcaaaagaagaatttatctgtgaaggatgaggttatcaaaaaagctttactggacagaagaataataacaactaaaataataatgttacacaaattcagatgtaaggatatcatttggatgtcatttatggagaaagaagggaaaatatcacctgccttgttgtcaatcacatcaattgcaattcatcagcaaattagtctcatctaccaatccaactaagtacctatttttggcttttggaattttactgggtggaagactggagtctatactgttgtcaattcaaatctggtatgtttagtaaaaactaagctagctactcgttcaggaagctttctgtgatgtgcctcaaaaagctgcataaaagggtttgggggataaaaggaaaatagtgataaatgaccttacagcacaaactcaggtctctctggcctctcagcaagcttcagggcttcatgcatgcctgcagctgagagcttccggttgatattccggtactggcactggagcaggctgcgataggtggtcctcaggtcccggttgaagaaggcatatataaaagggttaatgagagagtttgcatagcctagccacagaaatgtcctctccacccacagtgggatgcagctgcaggaagtgccacagatgaagggtctggctgtcgagaggaggaaaaatggcagccagcacacggtaaaggccccgacgatgatccccagggtggtggctgctttctgttctcgcttaaagatggagatgtttttcctttcatgcttgaggagtctcgaaaggtttgcacactcttccacctccttctggagcttcactatgccattcagggcgatgacgctgtctggctccactcgagggaagccaggaaacttgtgtttggcagcactcttcctggcagccttgtaaatctggtagtacatgaaaagcatgacggacatggggatataaaatgccactgcggtagagtaaatcgtatagccaaagtcctggctgatcaagcacaccttatcatcatttacattctgagcccatccaaagagtggaggtaaggtgatggaggcggagagaagccagacggagagaatcatcttcgccatgcatttcccattctgcctcacagggtatgtgaggggccttgtgatcccaaggtacctagtggagagatggaaagataacagatgaacaccgtgatcataactggtcaaccaagcaagtcctgccagccaggtaccagcgccagtcctcgcaacagcccttctaggtaggcatcattactcccattttgcagaaaggtaaactaaggctctgagatgttacctattttattccgggtcacacagaggcattgccagattgtagcctgagagccctctgactctaaagtcagtccatgctttgtgcatgccttatagtttttcacaatccacgaagtcaacaaagtttaaaaagctctccgtccccatgaccacagccaccaaaatcaaccaggacaacatatcaactctgatgtaggatgttgtgacacattctcaaaacttaaccaaggtctaccacactctggtattatacacccagtgatcaccccagctgtcttaatttaggccagcttttaattcattttagctttccctttgcattacagcaaaagcatttctttaagatcacacagattcgtgagataatttgggaatcctagagtgttgaaatggttagcaaaaaatgatcattattattatcattattattgttattattttgcccacagaaaattctcacacaacagcaatgtcagaggaacaatctaagaaataaaagcagcctgacttctctctccagttcttaggagaatcacaaaacaagggtgcaattctgaaaaatgttagggaaatccaacattttctctgtgcttagttctatagagggaataaatattactccaagtctgtgatcaaggatttgtaatgcaaacaagtctgtgcacacagagaaaacatatacagaaaagatgttctgccaaatgcttaatatttttcagcttttcaaacctgtgttttcctcatatttaatagtcgtagagtcttttttggaaagctaggagcacttgagaagcaaagacagaaaaaaaactggtcattttgttgttgtttttacttcctttatgtgtataaaagatacattcttgaaacataaaaaggaaagatacagagagtccctaacttaccaacaggttattttctgaaagttagtcagttagtaggttagaactcaaaaaacaatttctgctagaaatatcctttaatacttaaattatcccacaaaagtccaaaatcatactttcacaatgaaaattagcatcactataacacttacaggaagacaacactgaaatatagtaaaaaataatgagccagatgttcttacttctctagaattctttccttcaataagtattaatggagctcattttactggacaggttctgttccaggtgttggggataggacagtgagtagaagagacgaaaatcctgcgtgcaggcaaatggggaaatcatgtcagatgaaggggaaaacctgaggccatggtaatgttgaagggaacttctgatcccttccaaggagccaggcgttcatgacgctggttcttcatttgcaaacttccgcctccccttttccttaataaagctgacctacaagcactacccttagatttatcagctgtagttaggattatgatgtggctcccaaacagaatgagggaagagaaagagggaggctttcctgagaatgcaagaataagagctaagaaaaaggcgggcagtgcgggggaaagtaactcagaagaagagagggagtgaaggagtaaggaagagggaaaagggaagagggagggaaaagaaaaatctagtccttgttctcaaccagctcctgtgaatgtggccttttgggcaccttccttatttccccagcagcctttcccagacatggattttgatttctcgtctttctttgtctacagccccagcataaatgcctgctctcaagcctcaatgtggcatccaagacatgagcccaggatggtgcctcaggttcaccaaggagtgaagtccagcaggtagaggttactttacacaattccccaggaggccaccagatggcattgtcagatcattttacacctacttactgggaaggggggtgtttcaatagggtaggtggttgaagtaacaggtattatgttggaaaaattatgacaaaaaaggttgtattttatttgtggagcatttaaaaaattagcatgcctggaattcacaacctagtaaactcctattttgaggaaatctgttttctctcccatttcttcacactttccttactagaactatgccttcccacttaaataacaatcccatctttttcctggctaagtaaataatacagaattcacaaagattaatccggagagattaatagagtacaaagaacatttcagaattttagataatctcatttaaatggtatgtttattcattctagtacacttaggctgacacattatatttcaatcatgattagtccatattcagtctgccctggatgtacaaattatatttcataaactctgttctacattaggcaccattctctaatgatttcaagacatcctacaataaggtagttatatttacttcttaggctcctcacttccacctggtgagacatcataaggctaaaatcaactgaaatattactagaaaaaaaatgagtgcttactaacgtgtctggatataaaataaataaacaaaagttaatattttgttttaaccattaacaatcagaaaatagtgtggagatgatgcaattaacaacaactaaaaacacctaggaaaaagctttttaaaaataatacctacagtctatatgaagaaaatacaaaatgctactgaggtacattttttaaaatacttaaatccatgggggaaaaaacttgttttttcaataagaaattctagtattataaaagtacctatttcccctcaatctataaataccatataacccccaatgaataaactggcatggcttttgttaacgattttaaagctcaccaagtcaacatgcaaaaatgtacagataatctgaaaaagaataatgaagggatacttatcccattaaaaaaaagtataaagccacagaaataaaagccccaaaataattattcaaaaagatatcaataaaacaagataggttcaaattgattcaaatatataagggaattcaatataaaaggagtcactttaaatcactagtaaaaaattggatattcttgaagtctcacaactggccagcaattgaggtaaaagtattactggcttcttatcgtttgattaaatataaatctcacatggatcaaagattatcatgtaaaaaaattaaaccctaagaaaatattggcaagtatttccacaattctgagatgacaaaggccattcttaactataatacaaaagcttgaaagtacaaaatgaaacatcaataaatgtttgtaacaaacaaaataaataagtgacatttataagcaacatttagtttaattcaaaaatcattctgtgaagagttaaaagtcaaatcataaactagaaatctaaatggcaatatcacaatattcacagatttcctacaggtcaatacaaaacacagccatcccatagtaagaacttcagagtttgtaaaagaaaaaacaaaaagccaaccatcccaataaaaatatttaagcaattgatcaaagaagaaaaactaatggacaaagccaggcgcagtggctcatgcctataatcccagcactttgggaggccaaggtggaaggatcacttgaggccaggagtttcagaccagcctgagcaacatagcaagaccctatctctattttaaagagagagagagagagagagaaagaaactaatgaccaataagcacttaaaaatattcagaacttcattaataaagagatgcacattttaaaatgacacatttttatcatttgcaaatatttaagaaagacaaaatccaatattagaaaactgaaaaagcaatcattctattacgttgctattgggaatgtcaactgaaataattttggaagacagtttggcaattatcacacatctaggattttgtcttaagaagataattgtacaaatgcaaaatgactaatgtgcagacatgttactaaacacataatagaggaaaaagaatgcaatctaagtattatcaataggagattagatatgatatatatatatactgtatataatatgtataatgcagccattaaaaatgatgatgtacgtctgtatttactaacacagaaacaacagaagagtggattaaaaacacatagctcttaaagataagtaatagaatatcatataacatatattattaacctttctatataaaactgggtgtatgcttgtgtgagcatgtctgtgtatgctcagatgtctacaagaatatcaactaaaatatcaatagtagttttacctgagatgaagaaattttaatgattttaaatttcctctatattttctatgcttgatatttttgtagtgagcatgtaaaaaaaacactattttaagaacaaaataaaagatttaagaggattctgagattcctaatttatatgattctggcaatagaaacaatctggttcataaaatctttagaaagctgataattaaatcttacattgttttatttgattagcttgtcaaaagtactttattagaatacattcataagtttatacaaaagaaaaagaactcattggcctttaaaatcccataattactacataaagtaatattggtattcagggaagtgtttctctaaattatacattcattcttccaaaccttgtataggataaatcttaccttcaagggtgagaaagaaaaaaagaaaaaaaaaactagactgatttttaacattccttaagtatgcatgtttaatatttaatcacactaacattttatcctcactgttaattagaaagcaggatgcttataaagccttcaaaattttactgtaaaatgcatacgaatgttaaagtacagtaaatctcagagacgaaagcactgaagtattatataattgaggaatatatgcaactcacaataggggtgccattgaagtacaggttcagagaaaaagaggattagggagttataatctgcatagagagggatcggaagtaaattaactctgctgcctgtcttccattctaactgtatagaaatggtagataatggttctttaattaaatggcttcttctgagtttcactgctatagaatgataatttagggagtaaaagaaactaggtagaattattctgaaatatggtggttttttagagcgttcagcttaaaaagcgttcacacacttagaacacctcctccaggagattcctcccttgcagttggcaaaatccactagaatctccggctgatgtcagtggctgctgaaactgccagattataagaatcactcaggagctttagaaacatgcagattcccaagccactattctcattcaaggattggagacctagaactttgtgtttaggattgactgttctgggtctttatcccccacactgctgtcaaagcagccttctcccattcaattacaaggactttatacttaccacatgaagggctttactttactgtatatttcatctgaacagtttgcttccagtttagcctaacaaaatcattatgaatcatgtttccattatctcagctattagatttcccagtcctgtgctaaatgagatatgtgtggtctttatattttaatcaagttgtagatttttcttaaatgcataatacacaacaaggttttttaaaacctttttgaccatggttcacaaaaagaaatataacattttatataataaactgatatgtgtgtatatttatatttaggaaattaaacaaaagtttcacaaatctgtatttaccattataaaccattatctactctcttctattctatttcagactttttaaatgctggccttaactcactaaattgatttcataacccattaatggatcaaggcctaaagtttgaaaattactcaccttcaccaaacatatcaaaaggtgtttaacatcacgagtcatgacaaaaatgcagattagcacaatgaaatgtcactaacagccatcagagtggttaaaattaatgatgatgatgataaaaactataatgccaagtgttctgtgaagatatgaaacaattgtgattctcacacattactggtgggaatgtaaactgatgcagtaactttgggaaactatttgtaatatctattaaagctaaataatacacactctatgatctagcaattccaagtatataatgaacattaaccaaaatacacatacaaaagtttatagcagcactgttggtaatagctccaaatgaaactaatccactctacagaagtaaaattagtataactctataatagtagaataagtacataaactgtggcatatttatgcaatggaattctataaaacaatgagaatgaacccactactgcttgtcaacatggatgattttcacaaacataagctcgagctaaagaagctaaaaaacaaaaaagaacatactattcaaaaccaggcaaaactagctgctggtgacagaagccagaatggcagttacctccggggaagaggaagtcctaagcaatgagggtgcaggaggaaagcttggagttctgaaaatgttctttctcttcctctgggtgtgttacataggtatgctcaccttgtagaaagtaagtgagctattcagttatgatttgtgcagtgttccggatgtatgtaaatcaggtttttttaaatactaaaagtaaatttttaacaatacactgaacttatcatttgccattaacctagatgctaacctgttctctaaaaccaatgttacagtggggttccaatacacttttaaaccatttccatcagtgtttctaagctacacttacagttaggaacaataaacaacttaaattccttattctgccctcagcattgagggagagaagtagataaaagagagaggggggaagaaagcaacaaaattcaaccaagtttggaaacacagtagcaaagcctcctctttgagaaaggatattattattaaacaaaaaagagagtttcccttaagagagaaaatcagatttaattaaaataaaataagtcacttaattctaaaagtgcctgtaaaaattcatatattatatttgttaactgttgctacataactaattaccacactttagtggcttaaaacaccaccaaggaaaaccctgtcataaaaaaaaagaaaagaaaagaaaaagaaaaatacatgtctattaaaggatttttagacaattatacaaagtcatgaaaatgaatagtgtgagaaatagtaatgacccctgaattatacttgttaattacttcagttgtatatggattcacaataaactaaattttccaaagaatttggccttttattcctcagaaaaagggggcggggatggcagcaaagaaagaaccaaaatttatcagcaataataaaagaaatgaatggcataaaaccttagctaaaaactttttaaaggttagaggcaggaaaagaaaggaaaatattctgttttatgatggttctgtgtggctttcaaccccatcccatagaagcagtactcaagaaacagggtgagtaaatccttaaaattccaaataacaccttcatactggggagaagcaaatcaagagggtgagaagacaacctaaagaaaagtactgaaaagccatgaagagcagaagccccacataccattttagcagagttaagggccaacagaacttgtcatctttcaggacactgagctcaaccaggggagtatgccaacttccagaagactggtaaatcctgagcttagcgggatgttgtctggtccaggacatctaatgagtattcagagtaaagagtaatcctccttaacaaacttcactcagctgcggtagaatctactcccttcctttccccgcaaccctacacttccgggcaactgaaaagtagatgcactaaatactagcctaaaaagagaaaaatagcatatcaaataaggcagaatatcgatgaaaattcaaccacagtatgtgagaacaaacattagggtttaaataaacaactcatattaagaatgagcaagattaaactgttacagcaactacagaaacatgctccaacaataacaacaatgaaaggaaaaaagaaagaaagagaacatggctaagacttgaagaaccaagtcaaaaggcaaacataacattcagaatagaagttgttttcctaaaagtacttttcactgtaagagaccttaataaatatatgtgatcactgaagtagaggctcaaagatgttaaaacagcagaatgagataaaaagagactgctaagttaagaaaataaattgaggccagaacatcatcagggcagatctaatggatgaatgagcaggagctgagaatagaaacagacagacacacctggccaggtgcagtggctcacacctgtaatcccagtactttgggaggccaaggagggcggatcacgaggttaggagttcgaaaccaccctgccaatacggtgaaaccctgtctctactaaaaatacaaaaattagctgggcgtggtggcgctggcctgtagtcccagctactcaggaggcagaggcagaagaatcgcttgaacccaggaggcggaggttgcagtgagcagagatcgtgccactgcactccagcctgggcgacaaagcaaggctctgtctcaaaaaaaaaaaaaaggaaaggaaagaaaagaaacagacacacctgaaaagcaaatcaatggcatgaagtaaaaaggcttgaggtaatcatatcaatgcatatggaaaaatttattcaaaatttattcaagcaattagaaggtgacaggtaaggagaacacacaaagataagacataataataacatctccctgaagaaaagtacctaacaagtaggggggaaattgtttaagtaaatagagctgcaacatgtaaaaagtatacagtgatataatttaggacattttccttgaatcagtgaaagagctgaatcttaccagcaaaaggacacataacatagttgggaaaaagcgatatagaattattatccatgatacttatcctagtaaagttattgaacttcaagacatggaaagaccactgcaggcatttgggaaagaaaaaaaaatcagaaaatatgcaaggtagaaaaaaaatcaggctgattctcaacagcagaattccatgccaaaatataatagaaaatgtctagaaagattgagtgtataaaatgtgaaatagcggccgggcgtggtggctcatgcctgtaatcccagcactttgggaggctgaggtgggcagatcacctgaggtcgggagttggagaccagcctgaccaacatggagaaaccctgtctctactaaaaatacaaaattagctgggcgtggtggcacatgcctgtcatcccagctactcgggaggctgaggcaggagaattgcttgaacccgggaggtggaggttgcggtgagccgagatcgtgccattgcactccagcctgggcaacaagagtgaaactctgtctcaaaaaaaaaaaaaaaaaagtgaaatagcattatgcctgttatctaagattataaagctaagaagtagacattctcaaacatgaaagaacttgaagagtaaagtgcccataaaccctattttgggggaggaaataaaatccatccaactaaaaatgaatcaaaatgaagaatttaaaaccagggaaaggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaaaccagggaaacaatggctattactgaacttgtttaaatgcaacagtaacacctatgggaattatattagcataacagaatgtaaattttacaaagtaaaaataatataagccacaagaatcaggagctggggggaagcaaggtaggatacagtgttagagcactaatcaattcaactttcaaagtagagatcaactgatactgcctaaagttgtaacattttaaaattgtaacatatagtttatacaaatccaacctcctgatggctttcatattttcccataatctttacacaatctttcaggaacagatacctcttaaaattagtgctgtacaaaggaaaggaaatcagtatatcaaagggacatctgcatccccacgtttattgtagcactattcacaatagccaagatattgaatcaacctaggtgtccaacaacagtttaatggagacagaaagtgtggtgtatatacacaattaaatactattcagccataaaaagagggaaagcctgttgttcacagaaacatgaatgaaactggaagacattaagtgaaataagccaggtacagaaagttaaacaccacatgttctcactctaaaattagttgatctcataggagtaaaaaggaggacagaggataacagaggctgggaagggtaggaggaaagaacgatatacaaagatttgttaaaggatacaaaattaaagctagataagaggaacaagttctagtgttctatagcattgtaggatgactatagttaacaatgcatatatagattcaaatagctagaaggagggtatcgaaaatattcccaatgcaaagaaatgataagtgtttgagattatggatatgttaattaccctgatctgatcactatacattatatgtatcaaaacatcaatatgggctggacgcactggctcacacctgtaatccccgcaatttgggaggccaaggcaagtggatcagctgaggtcaggagtttgagaccaacctggccaacatggtgaaaccccatctgtactaaaaatacaggagattagccaggcgtggtggtgggcatctgtaatcccagctacttgggaggctgaggagggagaattgcttgaacccgggaagtgtaagttgcagtgagccgagattgcgccactgaactgcagcctgcgcaacagagtgagactctgtctcaaaaaaataaaataaaataaacacgtaccctataaatatgtacaattattatgtgtcaaaaaaattaaatgaaaaaatagtagctctgactgaaagttctacttcagtttatttttcttgttttaaattcaagtaaacttagttttaatattttgttaaaataacatgtatagtgtgatatcatttttataaattttttaatcaatcaactttctatctacctgtcattgaatcaactaaccagctagccagccatcctcctaagtggacataagcataaagaaacatctaaaatgatacttactacatgttatttattttatttttctgcctaacagtttagatgatttgttttcttcttcatattttttataattgaattttcataatgagcacagacagttttcaaaaaattaaagaattactctaaaatactgcaaagctttattttttctttttggactgtttctaccttatcactttctcttttttaatatacatatatattgtgaaatgattaccacagtaaagttaggtacagaatggaactctgatggactcttccaggattttaactcaagtgtttcagttagtgaaggaggcttctggatctttccaggcatgtagatgtctttaaggatgcaatcaggcctcctcgtcacaagcgtgtggccatctatgggccacatagatgtgttactatgtgaggtaacacatctattacctcacatagttaccattttgtgtgtatgcgtgtgtgtgtgtgtgtgtgtgtgtgtgtgtggtgaggtttactctcttagcaaatttcaagtatacaatacactattgttaactatagtcaccatgctgtacattagattcccataccttatcctacaactaaaagtttggaccaacatatccccatttcccacatccccatccccctgccaacaaccatgctactctctctttctgagtttgactttttagattccacaaacaaatgagattatgcagtatttgtctttctctatctgacttatttcacttagcataatgccctgaaggttcatctatgttattgcaaatggcaggattgccttcttttgtagctgaaaaatattctattgtgtatatataccacattttctttatccactcatcccttgacagacacttagattgcttccatagcttggctatagtaaatagtgggctattaacatgggagtgcagatatctcttcaacatactagcttcatttcctttggacatatacccagaagtagaagcactggatcatatggcagttagttgtatttttattttttaaggaacctccatactgttttccataaaggctgtactaacttacattctcaccaacaagtgcataggggttcccttttctcagcatcctcacgaacactcgttatttcttgtctttttgataacagctatcccaaaaagtgtgaggtgatcgctcattgtggttctgtttatgtttccctgatgataagtgatgttgagcaccttttcatgtacctgttgtccatatgtatgtcttctttggaaaaatgtctattcaggtccttttcccatttttaatggaattatatgggtttttgttgttgagtgatatgggttctttaaatattttgagtattaacctctcataagatacatggtttctgaatattttctcccattctgtacatggccttttcatgttgttaactgtttccttttatgtgaagaaggtttttattttaatgtagtcccatttgtttatttttgcttttgttgcttgtcctttggtgttatgttcaaaaatatcactgccaatatcgatataaaggagcttttacccggtgttttcttcttggagttttatggtgtcagatactacatttaaatcgttaagcaatttcaagttaatttttgggagtggtgtaagataaggattggatttcattcttttacatgtggatatagttttttcagcatcatttattgaatagactattctttccccattgtgcactcttggcatccttgtccattataagttgaccgtgtatgtggaggtttccatggattccatgctgtcaattctgttacattgatctatgtgtctgtttttatgccagtaccatattgttttcagtaccattttgtaatatagttttaaatgaggaaatgtgatgcctcgagctttattcttctttctcatgattgctttgtctgtctggggtcttttctgattccatatgaattttaggattgttttctgtttctgtgaaaaatgccattggaattttgataggagttgcattgaatttgtagattgtgctggattttatgggcattttaacaatatgaattcttctactccatgaacatggggtatctagacatttatttgtgtcttcttcaatttccttcatcaatgtcttatagatttcagtacctaacatctttcaccttcttggttagatttattcctaaggattttattggttttgatgctactataattggaattgttttatttctttttttataagatgcatagataaaacttagtcatttttaaattttactttgagttctgggatacgtgtgcagaacatgaaggtttgttacatacgtatacatgtgccatggtggtttgctgcacctatcaacccatcatctaggttttaaggcccacatgcattaggtatttctcctaatgctctccctcctcttgccccccatcccccaacaggctccagtgtgtgttgttcccttccctgtgtccatgagttctcactgttcaactcctacttatgagtgagaacatgcagtgtttggttttctttcctgtgttagtttgctgaggatgatggcttccagcttcacccatgtccctgcaaaggacatgatctcattcttttttatggctgcatagtattccatggtgtatatgtaccacgttttctttatccggtctatcattgacgagcatttgggttggtctttactaatgtaaatagtgttgcagtaaacatatgtgtgcatgtgtctttatagtagaataatttatattcctttgggtatatacccagtaatgggattgctgggtcaaatggtatttctgcttctaggtccttgaggaatcgccacactgtcttccacaatggttgaactaatttacattcccaccaacagtgtgaaagcattcctatttctccacaggctcaccagaatctattgtttttggactttttaataattgccattctgactggctggagatggtatctcattgtggttttgatttgcatttctctaatgatcagtgatgtgcagcttttcttcctatgtttgttggccacataatgtcttcttttgagaagtatctgttcatatcctttgcccattttttgatggggttgcttgtttttttcttgtaaatttgtttaagttccttgtagattctggatattagacccttgtcagatgggtagattgcaaaaattttctcccattctgtaagttgtctgatcactctgtggctttctttttcagatagtttgttattactctatggaaatgcaactaatttgtatgtgttgcttttgtatctcacaactttactaaattcacttattagttcttagtttttggcagagttttggtacagttttttttcagtggagtctttagagttttctacatataagatcatcatgtcacctgaaaacagaaacaattttacttcttcttttctaatttgaatgctttttatttctttttcttgcctaattagtatggctaggacttccagcactatgttgaacagaagtggtgcgagtggacaaccctgtcttattcccaatattaaagaaaacaatttcagctttacaccactgagtatgatgttaactaaaaggatgttgaattgtgtcaaatgctttttattcatctgctgacataattatattatttttatctttcctcctgctaatgtggtgtatcatatttattgatttgcatatattggaccatcttttgctagtattaatattatgctgaggattgttgcatctatgttcatcagagatattggcctataattttattttctcatacagtcctcatccaactatggtatcaaggtaatgttagcctcataaaatggatttggaagtgttccttcctgttcaactttttggaagagtttgagaataattcacattaactcttccttaaatgttgggtagattccccagtgaagtcatctggctctggactttagtttgttgggaggttttttattattgattcaattgacttactagttattggtctgttcagattttctctttcttcctaattcagttttgatagcttgtatgtttctagcaatttacccatttcttctaggctacccctagaagtatccctattagttactttataattattcatcatagtctcttatgatcctttgtatttctgtgacatcagttttaatgtatcctctttcatttctgatttatttaattattccctctcattcttagtctagttaatggtttgttgatttatcttttccaaaaaaaactagctctggtttgttagtctttactactgttcatctagtctatttcatttttttttttgctctgatctttattatgtccttcctcctgctaaatttggcctttttctatttcataattccttgacatataaagttgcattgtttatttaggttctttctttttttcttaacatgtaggtgtttattcctatcctttctcttagaaatactttcatggcatcctgttagttttggtatgttgtgtttccatttttgtttgtttcagaattttcaattactctttacatttcttctttgacccattggttgttcagaactatgttgtttaatttccacatagctgtgaattttccacttttactattgtgattgatttccagtttcataccactgtgttcagaaaagatacttgatatgatattaatcttcttgaatttgtgaagcatattttgtggcctaacatatgatctatcctggaaaatgttctgtgtgtgcttgagaagaatgtatattctgctgctgccaggtggaatgttctgtatatgtctgttaggtccatttggcctacagttctgctcatatctggggttccttattgatattatgcttggatgatttattcattgttgagagtaggatatttaagtcccctactattattgtattgctgtttatttctcccttctattctattagtatttgctttatatacttaggtgttccaatgttaaatgcataaatatttaaattgttgtatcttcctgattaattgacctctttatcattgcataatgaccttctttgtctcttgtgattgttttggcataaagtctattttgtttgatataagtggatccactgctactctcttttggtactacttgcatgaaatatctttttccatcccattttccatcccactttcagcccatgtgtctccttaaagctcaagtgagtctcttgtaggcagcatgttattggctcttattttttatccattcagccattctatgtcttttgtgtgtggagaatttaatccatgtacattgaaattacatattgataggtaaacattcaccactgccattttgttcgctgttttctgcctgttttgtagttcctttattccattcttcctctcttgctgtcttcctttgtaacctgaagattttttgtagtggtggtatactttcttttctctttatcttgtgtgtatctactacaggtctttcctttgtgtttaccataaggattacataaaatatcttatagttatagcatcaccctaatttaagctgataacaacttaacttccactgcacataaaactctacagtcatctcttcaaacctttataggttcactttggcagggaaagaacttcactactcagtccagcctatggttcttgacaggccaactggtagcattgacagacagacagagcttcctgttgcgatctctagttgagtggggccactgcaggtactctaaagctggctgggtttcctgcctgggatccgaagtcaagcagggccactggctgggctccctggtctggcggggctactagctggactctacccacaagctgtgctcagcaattgggaagagccttaggctggactccatggccaggcagggtgggatgaggtcacgggctttgttcctcaattgaatagggctactggattggctctctgctcagtggggtcataggctgggttccacagatgggtggggttgctggctgagctccctggttaggtggggcctaggggtaaaccctactttaaaattataatttcagccattaatttcatttgtctgccaattagtccttctttatataaatctcttcatgaacttggcaagtttggaattaacagctgattcaaccatattcaatttctctgaaatttttgcaaattatctttgcactatgaattctcgttagcttcttagtttattaagtaaatgttgggagaaagttctatgcatcctaacggtataatctcccaatgagctgtggtggactaaatatggccatatattctttgccatccctctttgatagataaatttttctccttctctttattctgggctggccttgtgacttgtttttaccaacagagagtacagcaagtgatgccatgtgacttctgaggctgacccttaagagatgtgcagcttccacctttactgcttggaaaattccccctgcatttagctggtatttggttgggctgtaggatgcttcactcacattctcagtgcttccccaattatgctttccttcttagcatagttagcctaggcttcctcagagcacgacagacttcttatgtatcagctggcttcccagggggagttttccaagcagtaaaggtggaagcttcttagattatcccaaaatttggatcccagccaagacttccccttggagctccagacccatgaatcgactgcctccttcacatctctacttgggtatctttaaagtgtcttattcactccttcctctaacaagtttttattaaacacttctataagtctggcaccatctcgacatgtccaaatatatcatctccacaaaactgaacatccttccatttccccaacttagtgagtctgtcccagaaatctaagagtccttctcattcaccatcttaacccagctctgcctatgttacctcctcaatatctctaaaacctatctacttttctgtctccattgccatcatttaagaatcattctctgtccgcaagtattgcaatagcctctaaattggttccctcgcaactactattctccttcctaacccattatcctcaggtatccagggtgatctttcttttaatgttatttatttcatcaaatatgaaacattttcacacacttcgaagatatataaggcatatattgagaaaccttgcttcaaattctgtttccatcctcttcatcccccacctccaatatgtatcacttttattaaaatcttgtgtgcccttcatcttttctttgtccaaatgcaagcaaatacaaatatgttcttatctccctctttcttaaatgtaagatagcatactggatactctcttctgcatgttgcttttttcacttaatatatcctcaagatacttccatactagtgcatcaagagctccctcatgcttttttaaaactgcaagtattaaattgtgggactttgccatcattcatttatccagtaataaataagcaatgggataaatgaattcaaatgatattcacatcattcttattctcatgtccaccaatcaaggacaaaatgaaatccacacttcagatgagaaagatcaaacataaagaataaaacaactccaacttcttcctcggtaatgtgaaccctaaaacttagtggctgtcagtccttcagttggcctttgaagaaaaggaagaatgttgttggccaaggctcgtgttcagttacagaaggtaccactgaaacagcacagtactgatgattcctcccactagccaagaacactttgattactacagcccacagcactacgttccaaaaaaaatcctgcaattactaagggtgtgtgtcccagagccatctttgcagaaaagaagagcttcctcaaatttcctcaattgctgaattatttgaatgtaaacattttacttctaactgtaaggataccatgcatagtaatctaaatccatccatattcaagtttttaaaagcatataaaactgtggcacctgggtaagctttgagtaagacatttgtctccatatttcatactttgataagaccatttctctttcttaaggaagtcgtatggaaagtttgggattaaatttactctatactctctttcctattcattacttttgataattgttaattaatttgcccatttccattaatcttcccccaaagcaatcaactaacaaacgtgtttaatatttaaatgcatgttatatgtgcatatgtatgcatattttcaatgtgttttctttctgaattaaattgcttatctgatcgaggcctatcacaaatgttcatatatttccactaaaatagagtaaaatacaaatccttatatacttatcaaaattattttctggtttaaagtttaaataataagctttagactttacaactataaccaaatatgcactttaaaatagccatgaggataaatgaacaaaagaatttttagaattagaaaatcaattatatattccaacctagaaaaggaatttaaaaaattagattccaaaatccaaagcaaaaactttaacagcaaaaccagttgccaaaataacaaacattattgacaaaaataaaactattattatttaaattactgacaaaaataaataaaactgaaaatcccttttacaggcaacaaaattgacagcagcagcaggcagtccagagcagccgctgccatcacgctggctgcagcaaggaggtgcgagtggtggcagcaggagccgctgcgggagcagcagtggcagtggctggacccctgtgccccgcatccccaaggcagctgactgctctgcacccacccttgcgcagccagacggaacctgcccccaggcccacagcctccaggactctgaagccctggcccagcatgaccattctagcataccgcacctgcggggagggcacctgcagggagggcacgggaaggaggcagagctgggcccaggatggtgctgcgctccatggagctggagggagccagggataagagggaccctctgagagcctgctgccctgggggccactgcgacagggctgagccgagctacctgccagcactggagcagcacagttgggcacggaggggcaggcagagaggagcccagagaggacctggaggccccaccccaggctgcaaggaggcatagcctgggctgcctgcaggctccatggagagggcggggctcccaccctcccaggcacaggacctggggtctctgactctgtatcctcaggggcccagaaggcccaccaaccccttgggttgtctgctcctgctgcctggcctctccccactcccagtgcctgctcccatctcagagcgggattggggccgagcccgggcactgtcacagcccagccaggtgtgctcacactcaggacagcactgacatgccagccccctgtcgccctggccctctctagacattgggcaccaacaagcactgcagggaagccaaggtgggtgctgagggcagctcggcactggcctgcaggtgccccttggcccaagcagcctgggtgccatggaccctagcaggaggcagaaaggctcctgggcagaaggcggtgggttcccagtgaggccccaccttcgggccagggagggcctgaagactggggctcacgctgccagtcccacacggactgagatgggaacttgtggtgcctttttcagacccacccatggccacccatggactaatgggcacacacttcctcccatctgaggcccataaaagccccaggctcagccagagcagaagggatggcaggaccacaagctgcagaaaggagctaccctctctgctgagaactgaacactcatcgggatgaccagctgcagacaggagctaccctctctgctgggagccaaacacttgttgggaagacctgcctgcaaagaggagctaccctctctgctaggagctgaacactcaatgggacaccctggccttagaaaggagctgcaccctgtgggtctctgctggttgttctattgctcagtaaagctcctcttcgtcttgctcacccttcacttgtccgcatacctcattcttcctgtttgcagaacaataactcaggacccaccaaatggcgaggctaaaagagctgctataacacaaacagggctgaaacatacccactgctcaccaggttgcaggcaaagagaaggagagaagagctgtggccctttggggagaccagacctgaggagctccctgagccagggctgtgactccctctttgagacctgtgattcctggtgtcctcaagcttctgggtgccaccacattccccaatgccagccagggaagctgcttgcagtgtgcctggtccagccacagcctcccagagagctgacgcccatgccagcacctggagctgcctgccccatggcagcagccagcatgtctgactgtgcagtggccagaccccacattcactcacacacccctcaccactccacacctgactcacaatctcccttgaaggtgtgggatccaggctggtagcacaagccaagtgcagcctgccaggccgagtgggcagaacaagaacagcagccccaagcaaaactcaggcaaacgcaccaccagacagaggtttccagccagagaaatgacaacccaaaaatcctataacaaaatgagagattaaaagggaaaggaaatagagggaaaaaaaagtaaaagatacctaactttcaaggtaaattttttaaaataactttttttttaggaaaaaaatcccttttggtcagaactataagccatttatgtatacaagtatttaggaagttagttgaagtagaaaatcaatgacaaaattaccataaaatttattaagcgtactatattcagacagtagtcaaatttctaaaaataaaaccctaggtcatagcagcataatttttactcttacttaatactttcaaaaaagcaaatagtcattagatatagagtttattatttattatcatctttcattctaatcctttatcctcatatccttttgatgtttttcttttaaaatggaatcattataatagatgtaaataatattcaatagtagtagcctatatgagccattagttatagtctaataatttcaatgtcttacttttcttctaggaaataaaaaatttatcaataagagtggagatttttcttctcttctacctctcccatttaacatattagccattaaaaaaccacacaagttcggttcaaaggatgctgctatttatctcctatttccttgtagtcccttttcacatgacgtatctttaaaataaagcaaaaatcttccagaatttaaaattgtagctaataaacttaccgtccatttctaagtgtgtgtgtgtggtgagggcgtcatattattttacacatgtatctacccagaaacccaactgctttgtctaagtttaatgaaacatggtatatattttccttttatgcccagaataagtattactaaaagcagaacaagaacaaaattaattctgcctcatgtttttattaaatactagctaactgagcatatgtaacatgccagggtctgggataaaagtttatctacagcactggattcagtctttacaaccctctagatattattatcatccctattttacaaatgaggaaactgaggctcagaaaggtttactctcccaacatcacataataaagctcaaaactaggtttcaacatgagttttctcactccagagcttcctcttaaccaatacacacacacataatcatttacaaagtatatccatacacatgctcttctcatataatcccaattttccatttccagttgaagaataactgaaatttctagttgggaaaaactcagaaaccctgacagtaactcagtatagaaatacccatttaaagcatcccttgctttcggtcaaactcatacattgacagagaagtcgcagctgcttgaagcaaccagctacactgtgggatagtcacaagtgtttaaaagttctacattaagtcaagaaaaaatgctccttttaatgaattttcctctataggtgtcattctttttttttattattgtgggtacataataggtgtatatatttatgaggtacataggatattctaatacagacatgcaatgtataataatcacatcatggacaatgaagtgtccatcctctcaagcatttatcttttgtgttacaaacaatctactgatactttttaagttatttttaaatgtacaattaagtttctattgactatactcaccctgttgtactatcgaataggatgccttattcattctttttttttgtacccattaatcatcctcacctgctctccaacccccactactcttcccagctgctggtaaccatccttctactctctatgttcaattgctttgatttttagatcccacaggtgaaaacatgtgatgtttgcctttttgtgcctggcttatttcacttaacataataacctcgaattccactcatattgttacaaaggacagaatctccttctttttttatggttgaatagtactgcattgcgtatatgtaccacatttcctttatccatttgtcaggtgatagacccttaggttgcttccaaatcttggttattgtgaataacaacagcaacaaacatgggagtgcagaggtgttcttcttttacagcaattgaaaataaggctatttttttttccgatctgccaactatatgactgctgacatttgtgatacattcctttcacatcctctgttcagttaggtcctttccattagcgatgatataaccctaagctcaagcaggaataagcaagatggcaaacataatggctcactgaataaaaaaaaaagctcaggttatcttcaggcccatcttgatccaggagctcaaatgataccatcagaattttccacagaagatggcatcaattttttacagaattgaactccagactccaaatgtgtctgaatcagcacagattacatgaaaaggggagcagctttctactttttccacttttctgttatatttatcaatcaagttttatataaatatattgatcattcaaagtatttcttctttattggagttgtcagttcccttagtactcagtactcattttgtgttaattacgtcaccagcttgttccttggggagaaattctacaatagtacctcttattatgacttctgcagttttatctgacaggtttataatttggaggctgcttcatgtgaattttgttatgacatagcatcagtcagatatatagttactttgctggaaaaatttttcagaaaactcaactcaaaatggcccaaataagaatgatttattaagtaggacagatctgaaatagttaatttggcagcccaatgacacggtgagggacttggtttccttccatctttttactctgccatcctcagtgcatgggccccacagccccaggaccacaatatggctgctgcagttgcaaacatcacatacaaaccaagaccagcaaaactctgacaaactttcttcataagcatcgctttttaagaaatgaaacctttccaagatggccttttcagccctccactcatagcgcagtggtaagaaatacatcacatacccattcttaaacgaatcacaggtagaaatataaaatatacaaaatataaaacaatcctgagtggtttagtgaaacatgactgcgtgcagcagagggactgcctaaagaaaataaagctctctaaataacgaagaagatgagatatgccgttgggtagaaaacagaagaaaattaaagttacccatactctcatcactcagaaataggtcttactaatattttgatgtatatccttctaataattttccctttttgtttgcttcacttaaacttatttcatccatgtattcattgatgtgtttattgaagtcgagggcctactacattccactgctcttcgaggcaatagtgataggatggtgataaaggcaaggaaacaaatcatcatccttggtgatttcaggccgtgctcggtgctgtgtagacaattacagggatagagggagggggtaaggtgtgatggcgagttgagaggtctctgtcccagcagagtcctgcaagaggtgaaagagggagctgtgtgaagatgttgaggaagagaatcctacatgcaaaggcccacagggaacaccatgtggccatgatcatgaaacagcaaaagtgccagtgtggccagcatcacacacgcaaggggaaagggaagtgatacattccaaagtggtcagaagccaaacctcacagggcccagcaggcaactatgaggccttttgttttattctaagaaagccctggagggttgagcaggggaagacttggcctgacatattttttagtgctcactcaggctgttctgtagataacagactctatagagacaaaattctagaaagtagattcttgaagaatttgtgacagcttttctcagttcaatttttcttcagttacaagaacagtgctttctattcactgactttcttctgtatctctgagaatgtttcaattacttggttgagaccagcactgcccaagagaaacacaacataaaccacaaatgagagccatatgtgtattttgaagtttctagtaaaagaaagaagtaaaaataaacaagtgaaattaattttaataatatattttttcatacaacatatcctaaatataatttccacatataaaattattagagagatagtttgcattctatttcttgcataaattcttttaaatctagtgaatattttacactgacagcacatcataattctcatgggtcacatttccaatttttaaaagccccacatggctattgcctaccatataggatatggcaggtgtagacaatagggtctacctgctctttgttcccccagtctgttctcagtactatttcatgtctgtaatagttgactacttaaattcgtaaatactttaatcatgaaaggtctggctaatttccatatccaatatcactcaggtctgttggatggacactgtttccttcttctgctgtctctaacttttcattttcaaatgttttaattcagatacaccctcatatgtatgtatgctgaccaactctaattcacagatatttatttgagaaagcagcaggtaggtaatctttatatcctttaataagtgaataaattctataaaccttagacaagatgcgaagcttctaaccttttcttctttctctgaagtttataatttaaatttgatttagtcatacaggtaatttcctaaacttcatacctcacatgtcacataggttgaaagaacatgagtttgttctgttttttaaattttaaaaccaatatttatgtggaaaatatcagattaagagtaatacttagggagtaagatcattttcttttttgaatcctaagattcatgttttgctccttaatgtgaaaaatctttctaaaatatattaggtagatatccacttagataagtatggtatacagactataatagaattttctttgctgattacaaaggctacacggtctcagtgttgttattccataatagctgtccacatacagagaggcaaaggaaagaaaatctaattaattgaaggtcttagttagctgaggactggcaagaattcattatggcatggcaaatgagagcaattaattctgtagaataagtgagtatatatcagataggaatgtttttgggctgaatataatagcctcactaactggcttaaataaataaggttttcctctgagggtcagcaggccaggacaggtatagtcacttactctacaatactgtcaacgacccaaaggacccaacatccttctaaattcccatttttaaaagacttacctgtggccttaagatgcctcctacaggccgggcgtggtggctcacacctataatcccagcactttgggaggctgaggcgggtggatcacgaggtcaggggtttgagaccagcctgaccaacatggtgaaaccctgtctctactaaaaatacaaaaattagctgggtgtggtggtgggcgcctgtaatcccagctactaaggatgctgaggcaggagaattgcttgaacctgggaggcggaggttgcagtgagccaagatgacgccactgcactccagcctgggtgacagagagagactccgtctcaaaaaaaaaaaaaaaaaaaagatgcctcctacaaaaagaggtacaccatccatgttccaggcaagaagacaggcaaaaggccaaaaggcaaaagataatgccaaccaagtctgtccatttttaagaacttttccaggtgccacctgcaagaaatttcattttggtctcactggccagggctgtgtaacctgaccatcatagcacgaagagaggctgggaggcaactatctcaactgaaagcattgctatcctaaacaaaaccagataaccagcagttgtgaacaatgaggttattgcacaattcagggaaacaaggagttgggtccttaattgctgtgtcctgtgacagctgatgggaagtgaaagcacatagggtcagtatgagagatcaaaatctgtagcaagatgtaacaatgccacttccttatccaccacccccaaatcccacacaccccttcatctcttcctcttctgtccatgctgaaaattcctctatgaacacttccaaggctacaatttcctacagttcttcaatcttccatttcccctaaagttgattctaactagctgaaccatggattccaaaggacaaggatgttgacattactctatccacccagccatttcagcatagcagagtagaccactggacataatgagctcttgattatcctcctgtgctatggtttgaatgtctgtcccttcagaaactcatgttgaaatttaatccccagtgtggcagtattgaaaggtccggcctttaagagaagactgggtcaggagggctctgccctgatgaatggattaatccattcatggattaatggattagtggggtaatgggttaatggattcatagattattatgggagtggaagtggtagctttataagaaaaggaagagagacttgagctagcatgctcagcccctcaccgagtgatgctctgcaccacctggggactctgcagagtccctaccagcaagaaggccttcaccagatgtgacccctcaaccttggacttctcagcctccataattgtaggtaatacattccttttcctcataaattacccagttttaggtattatgttacaaacaacagaaaataagctaagacatcctaaaacagagactgtactaaacgaaaagtcccactgctatgactgctcaaacgtggctcctttaaatgaagtggggtctcccacagaaacatacactatatactcaccctctacctctgtacttaatttaggtggctttccacttgcccacactcactgttttcctgtctcttccactgtctaaatgtgtctccattcctggatactattttccatgtgatctgcttctacctctactcttcccaactcaagtctgaacttgaattttttagctttgatcccaacactctccagatacaacttcaaaacagtcttccttggcctcaggcaccctgacctttgccttgttcctgcataacccccagctggtgtacccccatcaggagaagagatcaggcactccaaactttctgcacagtgtgctagattgagggagtcaaccaccatgaagggagagaactgctgccctgattctcactgatgaaaggccaggaggaaggattttaaacatgccacttcatagtgttgtttccttgcacagcccccaggagccatccctgaagaaacatagtgcctcttgaagattttttaaaagatttttccagtttgtccttctccccctttggagcagagaatgttagaacagaggaaaagttaggacaaatagagaaagagggaccaacatcaccaggaatgacaaaatagaattctctgtacttctaaatctgctaagaaataaaacctgatgtgattgtgagaagtgggcaatgttctgtcccaagaaggaagacaaggccttccctgctctgaccctgcgttttgctccagcctcattgctgactccctgcctccacctgctttttgtttctcgtatactgcactggtccaaagaagctaggttatgggctggtcacaaacaactccaaaatcacaacaaatgtacatttttcactcgtcacctcttctctgagtccaggcaactctttaggccagctctcctccatactatggctaagtaatacctctctgtgtcaagatactcctacaatgcccaggccaggggaagagtgctctggagaacttgacacccatagttaaatgatctcacccagaaaaaacatttgtcatttctcctcacattgcataaccttgatgaaccacaaggaggcagggaagtgcaatttgtcacgtgtccagatggaggacaaatggaaatatttgtgagcgacacaaatgcctaacacacattccatgttattttttacctccatactttagggtagtgtggcccctgtgcttaggacaccccatccccaacccttttcttggttaatctgtattcccatcagtcatccttcaccctccagccctgcatgcaggctaggttagaactctgtccatatcattgcactggtcacatcatgttattgtctatcttactcaaaattacaagcttctataagtgtatcacttgtcctttaaaatttcaagtatgaggccaggtgtcgtggctcacacctgaaatcccagcacattgagaggctgaggccaaaggatcacttgaggtcaagggttcaagaccagcctgggtgacatagcaagaccctgtctctacaaaaatacataagtaaacagtaagaaaataaaattcggccgggcgcggtggctcatgcctgtaatcccagtattttgggaggccaaggcaggcggatcacctgaggtcaggagttcgagaccagcctggccaatgtggtgaaaccccatctctactaaaaatgcgtaaaattatctgggcgtggtggcgggcacttgtaatcccagctactcgggaggctgaggtaggagaattgcttgaacccaggagacggaggttgcagtgagccgagatcgtggcactgcactctagcctgggcgacagagtgagactccatctcaaaaaaaaaaaaaaaaaaattcaagaatgaagcacagtatgtgccacatggaaagtgattcgtaaataaatgataaatgattaaatgaatacacaaatagcaacccagagagtgccaagaaacagtgagaggcacaacaccacagggcagtggaacagacccacactcacacacactcaggacaaaggtcaaccaatatcatcaagaatgacaaaatcaaactctccacatgtataaatctgctaagaagtaaaatccaacgggattgttggaagtggtctgtttctttatcccagaaagagacagacataacccctagtgcctggaatgttgtgggaccacatgctttagtttcctacccttcctaagagttccattggtttgaagaagaaaacatatacaaaactcccgtgcaaggaataaacgtttacatctatgacagatatggcttgaaatttaatattctgaaacttttcttaatttttagattagaaaacaatatatgaccacagcaaaatttcaaataatgcaaaatagtatgaattgaaaagtggaagtcctctcccccatttctaccctagatccccaatactgctcttagaagtaatcattgttaagtgtattcctccagaaattctctatgcataatttatttatgtatgttgatatgtaatcttttcctaaaaatgagatcatattttgcatattctaaaacttgctcttttctccacagtatatatatatggcatctccctattagtatatataaacacatcctatcaattttaaagctgaattatgagaataaggaatttaagccgaacccctaacaaatgagcaacaactttttaaagttttacttttaaataactctttcgaagagaaaaaaagtctttcagacattctcctctggaaacaactagaaaactaacttcatattccccacaagatccagaagacatcagaagggtaatacatggtcaacacaatgctattatttatcttctaattgaagataagaactgattttttaaaaaatccttttcctagaaaatactgtgtgttattctaccaggaaataaaaaatctgatttcaaatgtccttatttcaaacattttatcttgttatataataaagcttcttcgtttatttatcttaggcagagaatcagaactaaagtccttccccatcaacttaaagaaatattcatgcttcagattttctacatcaaaatctagatttagctggaaaaagccctctagccactgttctttgcccattacaatttagttaacggcataaccctgcctgtggccatagtaagcacaggcagcagtcaaaccacaattggtaccttactcaaggctttctccaagcccccagcctttcttccttgctttgggcactttctcctttgactgcagaccttgactctctcacttctctgcctgggttggatcaggctggactccaggaccaagcattggcctctggctctgctggctcctgccttgggaggcctgtcatgcatgggacatcacaaatacaggtgagagagctccactccttgataccaccctagcagagttcatggcacctccaattccacagacatgggcgagagactgcactcaatgccccagactcctcaggatacgacactggctgctctgcttcaaagagaggacactgagcagcttccagaggcaacaacattcagaaatgtgtgctcagaaggcttaatcttgagcaaaccattgacccccgctaaggcttaattatcgcacttgtaacatagggctactaatagtaattatgtaataagattataataagtttaagtaaaataatccatattatattttcaatacaatgcatgatacatagtatgcccctaataagtataaatggggatgatgatgatgatgatgatggcaatgatgaagttaaatctcttcaaaacatctttggaattcctgacttccttgagcaatcaaacctgctagaatcatgccccatcacctttcctatacttcaaggaatgagatcacctagattcttccagaggaaaggcattctgataaataaataaataaataattgtgctcttaaatggtgcaaaagactcaacaaagatcttccaaaacaaggtaaacccctgatccatggagatgcttctgaggctccgcaagtgttcattgacatgtacaattttctaatattttctaatgccactcattctggggcctttttctcctttcccacaaatccgcttcatttttgaggtgttttttgtttgtttgcttctttcttgctcataccattgattccatcttttatatatttaaaacagtgaacatggctattttatgtttggtatttgataattctaacctgtcaagtctgcagatccattgtgctgtgtatagtttttggtggaagtgccttgtttcctgataagttttatgatttggtgactaggagcttactgggactggaactgtgggaattctctaaggcctgtaataagggtctgtttctccaattaccatttgcatctacttctgtcaggccagcagtgctgtcagtccaggacccctttaaattaaattccagtttgaagtgtttttatttctctatttttttctggacctcaggagaaggatgaacttagcccctagccccatgagtgcctgctataattacagattctcaagaaagacttcccactaccagtgcccaagttgaaaaggcaaatttccctggcaaattttcctcccctgggtcatgtttttaaaagccctagatttggtggcagcttcagtcttactccccactttgtaaaagccctgtgtttatttcctgcctccagaatgcagcctttatattcaaagttctgggtcgccagaaatcagcacctatccccaatggaagctaatagcttctatactggtttacctcttgggccccttgctttctctccatttcatatctctaaggattcctcttactttcttgccagctcagccatgcaattaaaatggtatgtatttttaaaattttatccaggctttttagtgttttgctttttagagataggctttttagaatatttgatccatccataatgctactagaaataaactggattttaatttcatgttaaaattttactcagtattttctccaccccattacttgaatggtttatgtttgcctctccttgtcacctgcttcaattactgtgatgtttctgctgtactttggagtccccactaatacacagttcacctctgcctgggtcttcttttctcatgctccactcatggtgtagctatggctcttcaccattactttttccaactaggttggtccaccggggaaaggttactatataattatcctttttattctatgacttcaagcaaaatttctagaacatttagttcttgacagctacaatacaattatacaaagaaagatggggattaattacattcttactaaaacaagtcatattaagtagatgatgtggaatagtataacattttatacattatctgtcacaaaatacaccacatacaaaactctctaatcatgatgccagccagctgccagccagctgaggagatttaaccatttatctcttaaaatcctttcgttatcttaaaattaattatataggactctgaaaagatccattaataactctcctttcatcatgtgctaaatacctctgtgttctttctctgaagctcaagtattggggttctgtgcctatcctcttagcctaggtttgaaccctgctctaatccttcttaggcaagcatcccagagcaggccacttcatctcttggactgtctggccctcatctgcacaatggaaatataataattcctcccctacaggactatgtcagggtttaaatatgaacccttttaaaaaccttggtacaatgccagcacataggtcatcctcaataaatggaagccataaaaacaaattctactactatctagtttttttaaaaacattcacccaatattatcataaatgcagtagtatatataataaatgaattacaactgagccaatatcagtataatgtcaggaagccaagaggtttgcttaaggaatggggattaatgtgaattgactttactaccttctttcactttatcctatgtggagccaacacactctctaagacaggcagtcgggagaaagcctaatgattctcaccttgatccagaacaatgtgtaatagctgaccacatgacttggcatcattagttccagaacatacagttctatattacttcccagtttcttaactcctattcacgttgtcaaccactctggaaaaggctcaagcttccaccattgcacaggctgctcctctgctgagaacattccatagacttcttcaggctaagacttactcattttttagatatcagctaggatgccgtgtcctccagaaagactctctgatctcactgagctccctgctctgagttctcagggaatcacctcatcatccgctgcaggaggctataagtgacctgctgatttgtctggattcccagtaatataagacgcattagcacaagaactgtgtttttcattgttcaggtcagcaataaacccaaaccctggtacaatggttgatatgacataagcattaaataaatattggttggatgaataaatgaatgaatgaaacatgcagaaaaccgtagcaaaaactgtacctgtcccataaacatcagaggcagctagaaacatcaaaagtgtttgatcactcagaaaggcctaaatatctaattgacaatctaattaaagaagtggcagagacatgtattttgaactctgtcttctcggtgaaagcgaagtagagtctaggggattttcaaaccctatatgtaaattcctttgataccttcgtaatgtctgtctatctgcctcctcacctccactgcccccagacacacacacttctccatataacacatgactcagtacctggtgcacaggcactaaatacatatgaataaccaactgcacttctgcattcccccaccaatcttaacactgcctgtggcaatagccatttcagccaagaaccagtactgagcgtccagaactccaaccttgattttgtgatgtattttaagaaatactatggttcattcttatactttactttagtcctcaaaactatgctgatttttttccccaacaattcttactccttctcagaacgcaccacaacacctgatgacaagaattgggccaagaatacagcaatccacaaagtcttgtggccttgacgccccttcttgggagagctggaaagcagccatggtactgccagctgagcaacccgacctgggaatgtatctgcccctgaagtgtgatttctcacctgtgttcatgtgaccactgggatgtggcctttctacaaggtgctttcataccacctggcttccttcttaaatactgctcattccaagcatttcttgggatggaacttcctcagcacatatgtcgggtttatctctaacctgggccaacctgtgttttcattaaaaacacataatttagaagagcaggcagattaacacctgatctttactcaatattataaacctcacacatcccaacacagaggataaccatcggggtgccctaacactcagtaaatgccaagtggcccacggcaggccttggctaaggatggttcatccacttcattatcaggaaaatgctgtggttctcccctgctgctaggtatgtgttcatggttctctatgcaggccactgattttttttcccacatatgtattttggggaatttgaagctaacgaggaagccagatgtggtgcctgagctaacacttccacgtgtatttgttcctaatatctaagaaccaacataagaataggctatgaaatgcttaaatagatggaaaagtcatgagaccagggaagagtaagaaaacctgacagagtttaacttctcttattcttggttattacctgaatttttatttttaaactacaaagcttaaaattcatgaataatacaggaaatctgtaaaatgccatttttcaggaataagcaggacattaaaatgcaaattgcagttctacacacagcggtactcaacgtgacaaattaagctcttcctattccttgtcttgacatttgccttcaagatgtttgttcaatgtagagagaaagcaagagggcaagagggagaatcagacaggatgagtggtgatacctccaggagaccagccccatgtaagaggtgcccaaggcatgaaaggtcttcatggacgccttcctctctggcacaatacgtgggaaaaaatcatcgtctgcgttactgcattttctcaggaagatcttcttaggaaaatggcatactttaataataagatacctctttagaatgagtaggacagaaatctagaagaaagtgagtaaactagaaagcttctgagctcctgttagacccttacttccacacatcactcactcaggtagattcacaaagccatcctctaaccgtgccttattcattcaacatatttactaaagaggagggcctactatgtgccagacacactggggatacatcagtaaataataagacaaaccgctgggcacagtgggtcacgcctgtaatcccagcactttgggaggccaaggtgggtggatcacaaggtcaggagttcaagaccatcctgggcaatatggtgaaaccccgtctctattaaaaatacaaaaattagctgtgtgtggtggcacgcacctgtactcccagctactcgggagacagagacaggagaatcacttgaacccaggaggcagaggttgcagtgagggagatgggatcacgccactgcactccagcctgggttatggagcaagactccatctcaaaaaaaataaaaataaaaaaaataataagacaaagctcactaccttcactggacttacgtgctggtagctgtgggtggggatttacgtcagctatagtgctaagtgctttacatatttaactcatgtaatcctcacaccagccatatgaaggaggtaatattatcattcatattttagagatgagaaattgtaaatgaatgaggaattgtaaatgaaatgtgaatattactattcacattttacagatgacaaagctgaggcacaaagaagtgaagtaatttagctagtaaactagcaaatgaacaagctgggatgtgaaaccagggactctgtctccagaatgcgcatgttaaaccactttattagactgcctctcttatgacctcttccgcttgctcccttgctatttctgtataacaataagagtatattctcccaaagtcaggatctgaggcctagttgtcttcgtaacccactactcacaacccctgtagggtccggttcgtaagtgttaaatagatattaaataaatgatttgcctttgattattaaattacccttaccctgagccggagctgcaacagtgggtgttagcaccatctagtggagaaaggcctggcaaggaagactgccattatggaatggttgacagccagcaagggattatagcaattacctgggtaactcaggtaaacatcttcatgtaggtgctttgccatcattctgcagacctctgacagctgatctgataaccccccagatttaccaaaaacgaaacacctagtacataaacagtattccaagcccaaaatagatccagctttggtatttttaaggaattaccaaagaacactttaaacggagctcttctggaaaatccatgattatggtcacaatacaatagggatgatctcaacttcttacaggaaaggcctacatatatacatctacaaataactgcactaaacttgttaaagcaaataagatcaatcattcggagaccaagaattagaatggatccagatataaagcttaaaagaaaatggttattcctaatccctacagctactggaactcaactctctttgcacattcttttactaaatattagctaattgtgatatcaatgtatcagtatgacataagattaaacaatggctctacctatactttgtttagagtaaaacaaaacaaaaattttgaatgtacttcatataagacctcttagaaaaacaagaaaaataaaggagcattttatttcagttagtcatgtttagttacttttcccctttgacaaaaagcaaagaaaaacagaagagaggaggttgatgaaaaaattcagggaaatagagtaacaggccaaagtggagaagacagaaagtgtctgcacttctagtccccacttcatagcctagcaaactcctatttatcccttaagaccttgctcaagtgtcacctctactgtaaggtccttcctatctgcaccccaccccagctacttactcccattatcgcgatcccctagcacttgatccataacactatgatgcaatataatgttatattgtcatcgtgcaccaacttatccttcttcaacagagatgatggggactttcttaagtttctcagtatatctactggctaactgactactgaaaccagaagtaaataatgatcctttgaaacaaataccatttccttcctccttctatgctctgcattgttataccacaaaaagctcctgaaagtagcataaattctcaagcaattctcaaggcctctgctttgactcttttgtgattttttttgcctacatggtcttcacaactagtcttctcaagacacaaaatcaacaatcattgaagtgtaaagaagaaaaaataacaaggtctctggttttaaatgctatttttttctcttctgcccacaataaaactgtgtcaggagggatatgccacacacacatcagtgcatctgcctgaactgaaaagaaggtggaaaggttcactgggaaaatcaaatgttctttataaatccaagtgccgagacatgatctgtttctttaaatgctgttagcaaatgtactgctgaaggttaacagacaattaagaatcatcatagttctatgaaaatgataaacaaaacagaaagatcagcctttcgtgattgcataaaatcagccacaatcaaacaaaaaaaaatcactagggaaagcactgcacttgctgaatgcattatgatggtatactgtctgtggtggctaaacatttggatttggggaggtccagagcgccagatttcaaatccatgttctgcagtggataagctgggtgaccttgaacatattatgtaatctctttatgcctcagttttcttatctgtaaaatggaaataataatagtaccatcctgggtttgttatgagcagagtgcctagcatgcaaaaagcgttccataaagattcattcatttcattatttcatttcattttttcaagaaaatatctacttagtgcacaccctacacattgtactggaaactttcatatacatcatcgcagttcaaatctagaaaaatgaaagagttagacacaatgtaccttcccagtgctaacatccttttatcctagtcatgtggaatgaaaatgtgtttccagggttcagcaaacatttgattcaagtttcattgctaaacatattaatcatttttaaaactggaataaaaagtattacccacacttgagttctttatcaaattttaatacaagggagaccccaaatgacttaatttgtgctgcctggttaactttgcttttttctggagccctcaaaataaaactttgcagtggatatatttgaactccttaaaaatgtgacaccgattaacaagactgcaggtctttttctgttttgatttgttcttttaattcagacctgtatatgtctattcacataaaatcatacaagtgaatacaatcctctggcatttgtgtgttccactcaattaagtgacaggatacattcatatggtattttctgccaaacggtgacaaattaaactagctgatgaatccgttaattgactctctaaactgaacatttaacaattaataactgcatgcacttgttacttgctgtgattttaatttgaaacaagcatttcctagccttttgagctactgtttcagttaaattgaagaagaagctatttaaaaatactgtatcagttacactaaagagcaagctattttaaaaaatactgccatttgtaactactcatccatgtaaatctagattttctcaatattatgcagagagagagagagaaagggagattgagggagaggaaaagacagaaaaagagagtaagagagagagaaaattacattggatgcttagactgatgtgactacaactgtcttccataaacaacaatttcacaggaagtttgttaaatcagcctcattgctcttttgaatggcagtaagaatcaaatctcacaaatttgaactaataaattcatacaaataaaacactccccttcatctcttccatatatttttatcaatcctacatatatatttcattttgaaaaggggcagggttcagaaaactttgtcctaagcccttctctattgtgagaaattaccatgggccagtaactgttataatttctaggtgggacacaaactcaaaaaaattatcaaatacctgaacacaagaaggtttacatttagagaatacagatatatatatatatttagaatgagacaaatgtggaaagtgccatcaaagtgtatgtgtgtatgtacacataaataatgtatattatacacaatacctaaagcagtgagggggagttagattgggggtgagtaatttcaactgggaagttaaagaaaggttatatggataacctaatactgaagttgcacattgaacactgaacagaattcaacaagaggactaagtgtaaaagaccacagaaagattcagaggtaggagattgaaaatgttcaaaaaagatgagtgccccaggtgtatgtaagcattttagtttgtgtgcattgaagggggaagaggagcgggcaatggcaaggctagcctaaattaaaatgtcatagcccccaaaattgcacttagaataaacacatatactatgtcaaatgagcccagagaagaatttttaaggttaattgtgtttatgatccctccaagtgttttatttcacttggatacgattacaatttctagtaagttgaagctgaataattttccattttatcactatcatctttcttaacaatttctcacaaacatgaaaattattccattatttgacaggggttttggctcctcaagtatgaaatatctaggcacagctgtttcttacagttctttgggatttacctgggaaatctccaaatctgttttcagtatactacaaaaagacatcaggaaattaaagagcagtaaaaagagcagaaaatcttgtggctcaaactcctcgttttcagaagcatttaccacgcagaaagattaggtgactctgttgcaaggatgaaataaaacagagtatgaagccactttatcaaaaacatgaaaaattttaaaaactgttcacacaagttcattatacaatctctgaatgacaaaaacataattatgaatccatgaatcaaattttcaaatttcttgccttccagtccaacatcacccatgtataaggcaaagtagtgcgagttaaaaataagataacaacaagtttatagttctaaagccttcagcgtctaattgggtaaatgaagaatacagcctgtaataggactcttttgggtttgtttgtgggttttcattgttttgttggggtttttttgttttgtttttggtttggttttttttggctgcagctataccagcaggaattaatcataattcttgatttatagcatattataaacatatctttttcataggatttttcaatggttacacttttaaatatatatatttcaactgtacattatatatatacacaagagagcttttttataagttgtaaagagattatggatggtccctaactaactacggcttgacttaccatttttcaactttaccattcggtatgctcctcaacttacaatggggttacatgtggataaaactatcataagttgaaaatatcattacattgaaaatatactttcagctttccatttttacatctaaaatggaaaggcttatctaataagggttctgataaacccttaaaatggatttatcagaacttatcagaatggagaaagaacagtatttcaacaactggtgctgagaaaaccatatatccacatgcaaaagaatacagttggagccttaccttataccacatgtgaaaattaacgacaaaaaaaatgaactgaagacctaaatataagccctaaaactataaaactcctaaaagaaaacataaagaaaagcttcataacattggatttgacaatgacttcttggatatgacaccaaagcacaggcagcaaaagcaaaaaattaacaaatgtgaagaaacagaactttaaaacatctgtgaatcaaagaaaacaatcaagagggtgcaaaggcaacccatggaatgagagaaaatattttcaaatcatttattcaatagaattaatatccagaatatattccggataagaacttctacaactcaacaagaaaaaagcaaataacccaatttaaaaatgggcaaagggcttacatagacatttctgaaaagaagatacacaaatctccaataatcataattatgatagggtagagaggtgaaaatcacaataacatacgggcagaacttgaaaatcaactaaaggaatcattaataaccatagaagaggataattccaggaatgcaagaagagtttaatattgggaaattacttatagtagtacatcaatatttctaattatatatatatatatttagtatagatagtgaaaataaatttaatattatttttaaaaaaacaatttttaagaaagctcaaaaaaaaaaaaaaagatcaccttggaattacagacaagtgtacaatgtacctcaactaagacactgtattagtcagggttctctagaggggcagaactaataggatggctgtatatatgaaggggagtttattaaggagtattgacacacacgatcacaaggcgaaatcccacaataggctatctgcaaggtgaggagcaaggaagccagtctgagtccccaaacctcaaaaatagggaagctcgacagtgcagctttcagtctgtggctgaaggcccaagagcccctgacaaatcactggtgtccaaaagctgaagaacttggagtctgatgttcaagggcaagaagcatgaggcatgggagaaagatgaaggctggaagactcagcaagtctagtccttccaacttcttctgcctgctttattctagccacactggcagctgattagatggtgcccagccagttgagggtgggtctgcctctcccagtccactgactcaaatgttaatctcctttggcaacacagatacacccaggaaaaaatactttgcatccttcaatccaatcaaattgacactcaatattaaccatatttaaaccatataaccaatattaacagacacaaacacacacattagcctcggcctacacagggtcaggatcatcaatatcactgtcttccacttccacatcttgtcccactggaaggtaggtgttcggggcaccaacatacaaggagccgtcatctcttgcgataaaaaatagctccttcttgaatacctccttaaggacctgcctgagattattttacagttaacttgttttctataagtagaaggagtacactctaaaataacaattagaagtatagtatagtaaacatacaaaccagcaacataattgtttatcattatcaagtactatgtactatacataatttttatttttgttttctgcttttttaaatttttttgagacaggatcttgctcaatcacacaggctggagtgcagtggtgcagtcatggctcactacagcctcaaccttctgggctcaagaatcaagcaagtctctcacctcagcctcccaagtaactgggactaaaggtgcacaccaccacacctggctatttttttattattatttgtagggatagggtctccctgtgttgcctaagctgatctcaaactcctgggctcaagcaatcctcctacctcagcctcccaaagttctgagaacaggcatgaaccactgcacccagcctatacataattgtatgtgttatacttttacacaactggcagtgaagtaggttaatttacaccggcatcaccacaaacacgtgagtaaggcattgtgctatgacgtaaagatggctacaacatcagaaatcactaggaacttttcagctccatcataatcttatggaaccactgttatacatgtggtctgtcattgaccgaaaaagcattactcagcagcgcatgacagtatatacattttctttatccattcatctgttgtggggcatttaggttgtttctatgtcttggctattgtggataatgctgcaatgaacatgagattgcagatatctcatcaacatactgatttaccttcctttgggtatataccagtagtaggattgctggatcatatggtagttctatttttaattttttgagaaacccccatacttttttccataataactgtatcaatttacaaaccaacaacaatgcacaaggattctcttttctcctaaataaaaaacaagataggaaactataactacagcacaaactcacttttcataaacatttatacgtacggaaaaaaattagcacctccttctaccatgtccaccaccactttctaaggagagtaatgacagaagtacaaaaatttagaggctctctgaatgataacaatgaaacaaatgataaaggtagaagacattatcagtttaggtgtgaaactagaagtaagaagacaggagatggcaagataggagtctacaaaagcaagaggaagatttaaagaaaaatgctctgaattagcataaagttgtaaacccaaaagttatctgaaacaggtctcaatcaatttagaaggtttgctttgccaaggttaaaaatacatccatgacacagcctcaggaggtcctaatgacatgtgcccagggtgtttggggtacagcttgcctttatacattaaggaagacataacacatcaatcaatacatgtaagatttacattggtacattggaagggcgggacaacttgaagcttgcagggatctgtgggggttgaggggtgtttccacgtcatagacagattttaacatgttctgattggcaattggttgaaagggttattatcaatagaaaggaacgtctgggttatcataaggagttatagagagcaaggttttatcacgcagatgaagcctccaggtagcaggcttcagagacaatagattgtataaatgtttctaatcagacttattatctgtgttgacgttaatgctggtcagcttttcctgaattccaaaagggaggaaggtataatgaggcatgtccaacctcccccttcctatcatggcctgaactggtttttcaggttaactttggatgcacttggccaaggagggagggttccattcagatggctgggggaatctcaggattttatttttggctgacaagcaataaatagatgcaagatactgtcacaactaactgaattattctatcaaggaacagaagtcccacaaaacaatgaggaatgtatcagggaaactgttccacaacacaaatgttccaacctatggatgtttaaataacaaaaggttgaaaagagtgaaatctttcaaaagtaatttgtgtgctttcctgaattctgaaacagcacttacaaaacaaattttagaccaggtgtggtggctcaaacctgtaatctcagcactttgaggccaggagttccagaacaccctgagcaatatagccagaccctgtctctaaataagccaggtgtcgtgacaagtgcctgtaggtcccagctactagggaggctaatgtggaaggatcacttgagcctaggagtttgaggttacagtgagctatgattgtgccactagagtccagcctgcgtgacacagcaagaccctgtctctaaaatgattaaaaaacagacaaggctaggctcacggctgtaatcccatcagtatgggaggccgaggcaggcagatcacaaagtcaggagattgagactatcccggctaacacagtgaaaccccatctctactaaaaatacaaaaataaaattagccggatgtggtggcaggcgcctgtagtcccagttactcgggaggctgaggcaggagaatggcgtaaacctgcaaggcggagcttgcagtgagccgagatcatgccactgcactccagcctgggcgacaaagcaagactccgtctcaaaaaaaaaaaaaaaccgacaaattttaatcttctcctgatgattcagtgccataatcacaaacatcaagtactgcactgtctatgataaaggtatgtcctcaaaagcagccaaattttctaggattatttctccaacactgggtccaaatttctaggtttttttcatttttatgtgtttttctgaagctttttatagcttttatcttaaacacactgagttttagagctggaaggggcctcagagaccagttcaacccacacattttacggagaaggaaactattttcttcctccaccatgaagctctggctccaatgtattcctgttttaatatgtctattgtgagcaactcatctcccttttctaattttctgcttctaatctgacaactgggaaaccagataagcaaacttgttagaattgtatcaaaaatagccataatctaaatgaaaaactattctaagaacaaaaagtaagagtttcaatgttattctgtagggtcatacattgtggtaacttgaaggcctcttttccattctttgcattttgggaaggtgtttacaagacaatactaaaggtttccaggactttcacataaatgatgctaattctctgaaaagaaactcttccccttatggactatgtgatcttgagtaaactgttcaatggctctgagtctctgtctcctcacatgtaaaaaagaaatgaattatcagggtagataactgtttaattcaatgaggtcacatgctgtctttgttcattttgtgttgctataacagaataccacagactggatcatttataaagaaaatacatttatttcttaacaattctggaggctaggaagtccaaggctgagggactcatatctggcaagagcctttctgctgcaccatttcatggcagtagacaaaagggcaagagagcataagagggtaaaagagggcaagacagggtggaactcacttttatcaggaggccactctttctataatggtattaattcactgatgagggtagatccctcatggcctaatcacctcttagtggtcccacctcttaataccatcaaaatggcaaataaatttcaacagagttttggagggaacattcaaaccacagcatatgctttaaagaaggctaaaaaaatgggagttgttgttttatctccacttcttctcaagcagcagaagaagccatgtttgcaaaagctaatactatcttcatgttatgtagctcattcaggactgggtacaatcctactcaaagcaatattgggttttccacaggaattctcaaaagtagatgtcattagaatcacctaggagctttaaaaactcctatagcctaagccccacttgcagatagtctggttaaattggactgggttgggtcccaggtataggtactttttaatatatccccaggctggacacactgactcatgcctggtgctgggaggccaaggagggaggatcacttgagcccaagagttcaaggccaacctgggcaacatactgaaacccccatctctacaaaactaaaaaaatttagccaagtgtggtggcacatgcctgagtcccagcaactcagggaccaaggtgggaggatctctttagcccaggaggttgaggctgtagtgagctgtgatcatacatgcactccagcctgggtgacagagtaagactgaaactaccactgcaaaattataactgagaaagtgacagagatctgacctaaccaactccatcctgcttctaacctccaagctgtccttgctcattcctgggtgtaggctgaatcaactttgggaggaacttagttatagtttatactttgaaacaaagataataacagccctttcccaaaacaaaccgccttcttgcccgagaactagaccgcctttgtagagctaacaaattagtcaaaagattagaaattatggtttaggagtcatgtagctggaagctacaagattctgaccctccccaaattgctcctggggataacatcactattgtaaaacctaagattagtgcctgagatattttgcaaaccctgcacttaatggatcagctggcaccatatagattgataaactggctcatctgatcttgtagcccctatccaggaactaacagtgcaagaagacggcttcaactccctgtgatttcatctctggcccaaccaatcagacctcctttgactcactgctccccaccctgacacccaccaaattttccttaaaaactctgatccctgaatgctccaggagactgatttgagtaataaaactcatgtttcccgcacagccggctctgcatgaatgaatgaatgaatgaatgaatgaatgaatgaatgaatgaagagatccccaggtgattctcataaaagcctggggtgagagccaatgctcctgagaaatacattgagcctgctgggtgtcggtatctgtctgcattagatcaaaacccctaacagccccagctgtccactggtgagattctaggctggtttcttctttgtgcttccacactgatacttctaggactccccgcaaatcatctcctgtacccctcaaattgcttgacaaagatttaagtctgatctcataccaggtatatacactggtataatggtaccagttgtttaaatataatatttccaaacttgctggcaaacagctgctgttccaagctcctgagggtcccccacctttccatcatccaccctatgacccaaatccattctgactggtcagtggtgatagttaaacattgtattatccctagctttgatgacctggtgctttgccccaccacactaaaacttagaggttgaaagtattttaagtaatgatttttaaaaaataacagatgggagaaaaaatacctccaaatcatatatctgataaagaggttgtatccagaatatataaagaactgctacaattcaataatagagccacaaacaatccaattaaaaagtggaggtaaactgtgtatggatatctcatcaaagaaattacacaattggctaagataacaccattaataagaagaaaaatacaaatttaaatgacaacagaaattctacacactcactagagtggctataatgaaaacatctaacatgacaaagtgtggtgtgaatgtgaaaacaaaactggaattcccatacattgatttgagaatgtacaaccacttacaaaagtttggccgttttcttagaaagtcaaacacacatctattagcaattctgctcatggtaatctacccaagaaaaataaaacaatgtcctaagaaatgaaaataaaattctaagcccccaactgactgaatagaacccctcttggccaaagaaaccctagagaaaccttggaagctgagtcacagtgacaagggatagattagccacgccttactatactcccaccctcccaccctcctaacagccatcaggctttcttccccaagggctaaatagaaactagtcctttcaaaagactactaccttatcttcacatgtacagaacaaatacaacatgagattaatcattccttcaccccccgagatgaaattaaccctttcttcactcctccttgagacgtgttttctctattctctttttcttcaaacattcaccttatcttacgtaaaatgtagatttactgggcactaactaaactctcacaagtatgtaatcatttgtctcactgctgtcccaccctttcccctttataaggaaaaatatataaatactaaatatcctgagaacctctttgtgaaaaacaaccatagaagcttctgttttttctgggcatgccctcagggtggctcaataaagctccatgatttgagacttatgcctcacactcatgttagcagtcatttcattaactctgacgggatctcagggaagagatcagcccctttgacccgcagcaattctcctatcagtgctggcaagagattctctctgacagattgtgcacatcaccaatgctcaaaagctgctctcttctcctgaggttccctgatctgaaatttttgatttcagatcccaaggttcattttgccacagaactcctctaaaaagggagtttgctcacttccaatggagagcagtcttcagcgtgggccccatctccaggtaaggagctggtttggggttttattttgggatttggtagctgaaggtcaaggtttattgccagctggctgtaatttctccttaagctcagagatctcaactatatgtaaattatgaaatcactttttctgttttttggttttagtctatcttccattagatttgaccaactcttcctcccagccacaatgttgactaaaactccatagttgcagaaagtcaagctccaaccccggaaacaccagctggttaaaagaaatcaatattttaccccccaaaatatatttatttgacatattataaagtggcccagccagaccttccctaatttggatctaggaaagattagctaagagtcttcattctgaaggttcccatgtaaacatgattaaataaattgtatactttttctcccattaatctgccttttgtgagttaatttttcagcaaaacttcagagggtcaaggggaaagctcctccttggcccccacaatttggcatagccagtaggatccccaaaatcactcttctcttttggaagtcagaatgaagagaactcaggaaacttacaagccagcaaataggtaagaaattcttatcagtgagcctcctggcctccttgtgcaatctgattgaacagatggttaaaaatcaccgttttgtctcaaagttttgattattgggaaaaaagggatttgtgtgactagtcttggggtgtagtgactctggtgtatttttggtactttatggtgtgaatgttcatattgtttgaccccttgcctctcagaaatagccttttttgttgccattttcctttgtctttctgtgttgttctctcataaagagcagtgtcatagggtagagaacatgggcctagaatccctataagcctgctgttcaagccagccctgcagatgagtccattttatggttctgactagaccggtgtctgtttagacaaacttcgctgtgggctcctgagagggaaactggatgagttttccctcttgtcttgttttatgtgcttgggttacttttctagtctctgccatccagatggcatgatttttcagggtcaggccagccagccaatctgaaaagactaggagtccaagacacataatattttaagtaacacactgttctgaatgtgtcaagctcttgagaggagttttgacttaaaagttccatccctccggggcttttgcagtctttcgctggcttaagtctatttctgagagagaattttggaggatcacggggattgcttcctctatgccctctccaggaatatatggtaaaaacctggaaaattaccacctgggctttaaatgaagaggcttttgaattgagtcactactggaactaagtacactattggaaataaaaaagattttagagatctcttattctaagcaattgatggaaaggttaaatttttaaaagaatccgtaatagcgttatagctagccttaaaaattctctttaaagagcaaaatctgacctaaaacaaagttaaaatcccttgtacactcaaactgcctgcttttgattccatgtgggattaacaacggaagctgctccactttgtagtctggtagttaaaattcatgatcatggaatcagtccttttggtttgatatttgtatgacttttgccacttattgatccttttcccttccatggacagcttttgatttcctgtcttccatctgtgggggcatatggtggttttgggcctttgtgtgtagatgaccagctgagaaactgagaccatagagtatatggccagacagacaaaaatgagttgtaccccatttgtggccttttttttttttttttttttttgctgtctttggtgtcattctgttaccagcagcagatccatatgggcctaaagcaacctcagttcttgcctcctcagaagaaagaatttgtctgaggggtataaaggagaagaagataccaaagcaagtcttagagtaagactaaaagtttatttaaaagctttagagcaggaataaaaggaagtaaagtacacttggaagagggccaagcaggtgacttgagagatcaagtgtgccattcgacctttgacttggggtttgatatgttggcatatgagggtcttgtgtcccttctcccctgatctttcccttggggtagggtattcacatgcgcagtagcctgccagcgcttgggaagggtgtatgcacagtacgtttactggagttgtacacatctcacttgaggtgtttttcccttactagttgaatatccctaggaggtcaaatatcacttaaactccactatttgccatttgatgcacaaggttgaacccactcgccccactcctgagatcttatcaggaagctgctgatcaccagtttcaggtgtttctgtttatcgggagaccgccttttcctgagtctggctatgaccaattattattttggagagagagttaacaactgcctgaccatcatctgatggttgcctgacattcctggtgttggggagaggagccctatcctgccctggtcatgtctgactacctacctactgtaacaattctggatcttaagaggactgctttgcactgctttggagatactttgtgtgttcttggctaagccataatggtacgaacaggaggcaggaaaatactgggtaggagagggcagagtccctggcaagggttccacctgcaagcctgtgcctgtggccctaaatgagaacttcacatccctgtttctcccaccgagtgttgctttttccaaaaccacctgggcctgctatgcccccaacctataaccataaaaaccccaagctccactggcagaggagcagagcagtgtggcagagaaggagaaaagagaacaagcaactgaatgttgagatgagaaggagcaactgagcatcagagactaggaaaagatgcagcttaacttcagaagacaagacttcagagaggagcccagacatagatggctgggcttcagggaaagatcaccttcttcccgcaccatcccctttccagctccccttcagctcagagccacctccatcactcaacaaaacctccacgttcaccatccttcgagtctgtgtgacatgattcttcctggacaccagacaagaacctgggtaccaagagggcagggtatatgtctccccactgagctagttaacacttagccatctttggacagcaaataccaaaagagcattgtttgtaacacatgccctctggggttccagaggttgtgggcaactgctagaatgtgccatgggctggtacgggttcattcctgccagcgcctaaaggcactccccccagctcctgcacctgctcacctgcatgctccccctcccacaagaggtttgagctcagcagctgagcaaaacgagccaccacccctccccactccttcaggtttggtaaaggagttcaaaggccagaaatatcagctgtttatcccaggtaataagagatctgaaagaatttttttcttttaaagacttctatggttagcagtcagcttcattaaaagctgatatctaagctataattacaatttttttttaaaagagctttatgctgtttctctttttggatcctgtcttggggatttttatttatttattttttctgaatcctgtctgttcctccttcctcttgcaacctccaatgtcatagaagggaccaaaagaaggggaggaatttctgacaatctaagatcttttggggaaaacataaaagttgacaaagactcctctgttgggaggaaaattttgtttttccttatgaaaacccaagagttgtaagcagacagatgcctctcaggtctaaaactctgcactgttttatattgcattacctggtctctagcttttgcagggtaccagatattactttgtactatgaaaggtcttgacattggtgtgtgcactggctggtgagttgggcaatagctacaatgttaggggtggctgaagacagttatttacaggaaatggtcattactatagggggctactcatttctttgcatgtttggatgagaaaagcatggtttgggccctaaaaaccacatgctttattgtccctgttccttaaaggactccaccctgaagccagttatctaaataacacacaagctaagttgaaaaagaacacctattaaattaaatcagtctttgaatctctttgtgaaagaaatttacatctttaaaggaaatcatcatttgtaaatgcacctctgtctctgcacctaaaccgctaggaagtttaactacagggaagacagtgtcttaaagttaacataacaaaccttgcttgcctttgttttgttctaagttctgtgcctttgaggtatgcattttctactttctctcccctaagagtcatgtgtttggagatgcaaatgtagagttgcctagctaataattgttttaaggtatgaaacaggtaataaagagattgatactctaaattaggggagagaaattttttgaaacctgacaaatgaaaaatcttataactctgtaagatctgcttctatgtgtctatatgtttctatgtggcatgtgtatgtgatgtttcactaccaaattttatgaaagcactctaatcaataggcttaaaggaaattaagtgcttaaatcaaatatcagaacaacatgctagcccaaatgcctgttagctcatgagactttaggaatctttgataagtaaaactagttgtaaaatttctttagtaatttaaaatctagagatcatgttatattaggtaatcccaggtttttcactgtaaattagggttacttagttagaatagttgttaataaatataattaaaactactagatataagagaattctacatgcagagttcataaagaaactaagatgcgttttggtaaaggttataaataacatgaggatgtggttttttgctaaagaaaaagtaaatttgtctagtttggaggctacataaagatttcttcaaaatgaagaaaaaatgagacagataaaattaaatggatagaaagagaaaggataaaagggtagggaatgaggaacccttgacggggtcatccatggtatggagctgcagctgtgctgtattaagttcctaaaggtaggctgggcgcggtggctcacgcctgtaatcccaacactttgggaggctgaggtgggcggatcacgaggtcaggagatcgagaccgtcctggccaacacggtgaaaccccgtctctactaaaaaatacaaaaaattagccgggcgtggtggcgggcgcctgtagtctcagctacttgggaggctgaggcaggagaatggcgtgaacccgggaggcggagcttgtagtgagccgagatcacgcctctgcactccagcctgggcgacagagcgagactccatctcaaaaaaaacaaaataaaaaaatttaaaaaataaaaaaataaaaaaaaagttcctaaaggtaaaagttaccagtggagtttagcaatggatccagctcctggggaactggttcacaagatacatgaggaaatgcaaactaataaggaaaaagagaaacattcaatcccttggttattgttatctataatagctaaaacaaaagtaaaagagtgtgctgggctgggccttggccaaaccaagttctgatgagggactgtctgatctcagatcaccagcctcaaagccacctgcaaaggggaaagatagactggggcaacaaaaagtacctctgagacctgtgattaccaagaaggtagctaatgtgagggaagggtaaaaccaattaactactgaaaccagagggcataatgtaaaggaactgttccattttgcacatcagtatcatcagcttcctaaaaaacctttactaaaacggattgtaacagtgactgattttggagtagtatcttgcattttaaatacgacagagtggaaaaaagatgtgtaggttgatgcaggacacacagctcactactgaaaaatcacagatgggcaaatgtgatacagactgacaggagggtattcttagagaacagctgatatagaagttagaaagaaattattgggctgggcacggtggatcacacctattgtcaggcctctgagcccaagccaagccatcgcatcccctgtcacttgcacgtacacacccagatggcctgaagtaactgaagaatcacaaaagaagtgaatatgccctgcctcacctcaactgatgacattccaccacaaaagaagtgaaaatggcctgttcctgccttaactgatgacattgtcttgtgaaattccttttcctggctcatcctggctcaaaaacctcccccactgagcaccttgcaacccctacgcctgctcgccagagaacaaaacccctttgactgtaattttcctttacctacccaaatattataaaacggccccacccctatctccctttgctgactctcttttcggactcagcccgcaggcacccaggtgattaaaagctgtattgctcacacaaagcctgtttggtggtctcttcacacggacgcgcatgaaatttggtgccgtgactcagatcgggggacctcccttgggagatcaatcccctgtcctcctgttctttgctccgtgaaaaagatccacctacgacctcaggtcctcagacccaccagcccaaggaacatctcaccaattttaaatcgagtaagcggcctcttcttactctcttcttcaacctctctcactatccctcaaccactttctcctttccactcttcaatctctcccttctttcaatttcaattcctttcattttctggtagagacaaaggagacatgttttatccgtggacccaaaaccccggcgccggtcacagactgggaaggcagccttcccttggtgtttaataattgcagatacgcctctctgattattcacccacgtttcagaggtgtcagatcacgcagggacgcctgccttggtccttcacccttagcggcaagtcccacttttctggggggggcaagtaccccaaccccttctctctgtgtctctaccccgtctccacctttctggggggcaagaaacccctaacccttctccttcactcttagcagcaagtcccgcttttctagaggaggggcaagtaccccaaccccttctctccatgtctctacctcttctccgcctttctggggggcaagaaactcccaaccccttctccttcatccttagcggcaagtcctgcttttctgggggaggggcaagtaccccaaccttgtatctctgcgccccgatcccttatgtccatgccccgacctcttatatctctgtgctccgatcccttatttccacgccccaacctgttatatctctgcgccctgatcccttatttccatgccccgaccttgtatctctgcgccccgacccctttcccacttttctggagggtaagaacccctgaaccccttccctcctgtctctatcttttctctgggcttgcttccttcactatgggcaaccttccaccctccattcctccttcttctcccttagcctgtgttctcaaaaacttaaaacctcttcaactcacatctgacctaaaacctaaatgccttactttcttctgcaatgccacttgaccccaatacaaactcaacagtggtaccaaatagccagaaaatggcactttcaatttttccatcctacaagatataaataattcttgtcgtaaaataggcaaacggtctgaggtgcctgacgtccaggcattcttttacacatcagtcccttcctagtctctgttcccaatgcaactcgtcccaaatcttccttctttccctcccgcctgtcccctcagtcccaaccccaagcatcactgagtctccaatcttccttttctacagatctatctgacctctcccctcctcgccaggccgagctaagtcccaattcttcctcagccccctcttctccaccctataatccttttatcacctcccctcctgacacccggtctggcttacagtttcattccgtaactagccctctgccacctgcctagcaatttactcttaaaaaggtggctggagctaaagacatagtcaaggttaatgctcctttttctttatcccaaatcagatagcgtttaggctctttttcatcaaatataaaaatccagcccagttcatgactcgtttggcagcaaccctgagactctttacagccctagaccctaaaacatcaaaaggctgtcttattctcaaaatacattttattacccaatctgctcccaacattaaataaaactccaaaaattaaattctggccctcaaaccccacaacgggattaattaacctcgccttcaaggtgtacaataatagaaaaaagttgcaattccttgcctccactgtgagacaaaccccagccacaactccagcacacaagaacttccaaatgcctgaaccgcagcggccaggcgttcctccagaacctcctctgccaggagcttgctacaagtgccagaaatctggccaccaggccaaggaatgcctgcagcccaggattcctcctaagtcacgtcccatctgtgcaggaccccactggaaatcggactgtccaactcacctggcagccactcccagagcccctggaactctggcccaaggctctctgactgcttcccagatcttcttggcttagcggctgaagactgacactgcctgatcacctcggaagccccctagaccatcacggactccgagcttcgggtaaccttcacagtggaaggtaagtccgtccccttcttaatgaatacggaggctacccactccacattacctccttttcaagggcctgtttcccttgcctccataactgttgtgggtattgacggccaggtttctaaacctcttaaaactccccaactctggtgccaccttagacaatactcttttaagcactcctttttagttatccccacctgcccagttcccttattaggccaagacactttaactaaattatctgcttccctgactattcctgggctacagccacatctcattgccaccttttcccccacttcaaagcctccttcacatcctcctcttgtatccccccaccttaacccacaagtataggatacttctactcccttcttggtgaccgatcatgcaacccttaccatctcattaaaatctaatcacccttaccccactcaacgccagtatcccatcccacagcacgctttaaaaagattaaagcctgttatcactcgcctgctacagcatggccttttaaagcctataaactctccttacaattcccccattttacctgtcctaaaaccagacaagccttacaagttagttcaggatctgtgccttatcaaccaaattgttttgcctatccaccccatggtgctgaacccatatactctcctatcctcaatacctccctctacaacccattattctgttctagatctcaaacacgctttctttactattcctttgcacccttcatcccagcctctcttcgctttcacttggactgaccctgacacccatcacgctcagcaaattacctgggctgtactgccgcaaggcttaacagacatcccccattacttcagtcaagcccaaatttcttcctcatctgttacctgtctcggcgtaattcttagaaaaacacatgtgctctctctgccgatcgtgtctgactgatctctcaaaccccaacaccttctacatcctaggcatggttagatactttcgactttagatacctggttttgccatcctaacaaaaccattatataaactcacaaaaagaaacctagctgaccccatagatcctaaatcctttccccactcctttttccgttccttgaagacagctttagagactgccccaacccgagcgctccctgactcatcccaacccttttcattacacagagctgaagtgcagggctgtgcagtcggaattcttacacaaggaccgggatcgcgtcctgtagcctttttgtccaaacaacttgaccttactgttttaggctggccatcatgtctccgtgcagtggctgctgccaccccaatactttcagaggcccttaaaatcacaaactatgctcaactcactctctacagctctcataatttccaaaatctattttcttcctcacacctgatgcctatactttctgctccccagctccttcatctctctgatccacctgacgttcaccccatttccccacatttccttctcccctgtttctcaccctgatcacacttagtttattgatggcagttccaccaggcgtaatcgccacacaccagcaaaggcaggctatgctatagtacaagccactagcccgcctcttagaacctctcatttcctttccattgtggaaatctatcctcgaggaaataacttctcagtattccatctgctatgctactactcctcagggattattcaggccccctctcttccctacacatcaagttcagggatttgcccccgcccaggactggcaaattagctttactcaacatgccccgagtcaggaaactaaaatacctcttattctaagtagacactttcactgaataagtaaaggcctttcctacagggtctgagaaggccaccgtagtcatttcctcccttctgtcagacataattccttagtttagccttcccacctctatacagtctgataacagaccagcctttattagtcaaatcagccaagtagtttttcaggctcttagtattcagtgaaacctttacatcccttacagtcctctgtcttcaggaaaagtagaacagactaaaggtcttttaaaaacacacctcaccaagctcagccaccaacttaaaaaggactggacaatacttttaccactttcccttctcagaagtcagacctgtcctcagaatgctacagggtacagcccatttgagctcctgtatagacgctcctttttattaggccccagtctcattccagacaccagaccaacttagactgtgccccaaaaaaacttgtcatccctactatcttctgtctagtcatactcctattcaccattctcagctactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaaccatatccaggccatcaccaatcattctatacaacaaatgtttcttctaacaaccccacaatatcaccccttaccacaaaatcttccttcagcttaatctctcccactctaggttcccaagccaccccaatcctgctcgaagcagccctgagaaacatcgcccattctctctctccataccaccccccaaaaattttcgccaccccaacacttcaacactattttgttttatttttcttattaatataagaaggcaggaatgtcaggcctctgagcccaagccaagccatcgcatcccctgtgacttgcacatattcgcccagatggcctgaagtaactgaagaatcacaaaagaagtgaatatgccctgccccgccttaactgatgacattccaccacaaaagaagtgaaaatggcctgttcctgccttaactgatgacattgtcttgtgaaattccttttcctggctcatcctggctcaaaaacctcccccactgagcaccttgcaacccccactcctgcccgccagagaacaaaccccctttgactgtcattttcctttacctacccaaatcttataaaacggccccacccctatctccctttgctgactctcttttcagacttagcccgcctgcacccaggtgattaaaagctgtattgctcacacaaagcctgtttggtggtctcttcacacggacgcgcatgaaacctataataccagcactttgggaggccgaggcgggccgatcacctgaggtcaggaggtcaagaccagcctggccaacatggtgaaaccccatctctaccaaaaatataaaaattagccaagcatggtagcacacgcctgtagtcccagctactggggaggctgaggccacagggtcgcttgaacgcgggtggcagaggttgcagtgagcaaagatcatgccactgcaccccagcctgggtcatggagtgagactccgtgtcaaaaaaaaaaaaaagaaattatttagatagtgagggttcgggagtccttggtaaggttttcctttcaatgaaaagcagccccaaaatcatttcttttctaacaaagagcaacctgtaaaatcaagctgcagacatagacacacaagctagaagcttgcaagggtgaatgccagcagctgtgccaataggaaatggctacctggggctaggcaggttcaaaatggcatctccatcttcccttctccttgccaaaccacatgtacagtaaggaaaagacagcatggcgctggccaggcaaagactccatttgcctaataagattagggtgggacgaccagcttcctcaccagctatgtaaacatcgcacctggtccaaccaatctatgggccctatgtaaatcagtcatagcctcctcaagcctgtctataaaatccggtacactccacagtgggccagaagtcccattcaggtgcccctctctttcgcaagagagagagctgttctcctttctctttctttagcctattaaacctccgctcctaaacccacttcttgtgaccacttaattgatttccttggcatgagatgacaaacctcaggtatttactccagacaatggtgctgtttcatagctagcctagtggactggataaaagccctaagaaggggaactatccaactctacttagtaatgccaagtggagcacgccagatgcagctgctgatgtgcttcatctacaagccatgagggactcactttatgatgataggaatattcacccactaaatatgcccattacctagttcatgataaatgctgtggttataggggctaaaggggctccttccaaatgggcaccctatgtaatgctactcctactgttgtccagaacaacacgagaagccgtagcaaattggctgtttcagcttcccctcatgggtcttacagatgctaataatacattaaagtaattaagaagagcatggggaaaagcaaaagggagagtcaaaggactcattccaggaaggtggaaatttttaaatggttattctaaaaaataaggtgaagaaagaaaacaatgatagaaaaacaatgaaactcagagaagaaatgagagagaaacatgggattcatcccatcagggtagtagaagtctttagatggttattaagaaattaaacgaataaaatagaaactgatggggttaaaacaaaggtcttagtacaacattaccaagggctggatggaccaaagggattttgctagttccccagcattaaagggccccaaacctttttattccctttaccctagattggagaaatttttttaaaaagtcaaaagacaaagattacaatgagaaagctggccaataattgcctggggcatagtgaggcaggtgaaccaagatatggattgacaaaagggcctaagtcccttggctcaacctcctgctgggaacccaggtccttttcaaaagaaagggtaaaacggtcataaaagaagtttctgggaccagaatgtaaaaatgcaggattgcaaaagttggattttttttttgtttttttttttgttttgttttttttgagatgtagtctcactctgttgcccaggctgaagtgcggtggtgcgatctcggctcaccgcaacctctgcctcttaggttcaaccaattctcctgcctcagcctcatgagtagctgggagtacaggcgcccaccacctcacctagctaatttttgtatttttagtagagacagggtttcaccgtgttggccaggctggtcttgaactcctgacctcaggcgatccacctgcctcagcctcccaaagtgcttggattacaggcaaaagttggaatgtttaaacaggcattttctaaagtgattgtgtcttctttacctaaatgtttataaaaatggatcttgtatctgactgggagaggtttcccctacctagtactataaaacagaaaggatgtaaatgcgcccctcaggcaatattaaatggacatgtgcgggcaggagaacaacacatgctggggccttttgtggggggcctgagggagagcattgggaagaatagctaatgaacactgggcttgacacctgggtgacgggatgatatgtgcaactggccatcatggcacacgtttacctacgtaacaaacctgcacatcctgcatatgtactcctgaacttaaaagttgaagaaaaaaaaaatggacatgctaaatgagaaccagtaagattgcccaagcccacagagtggagagtaaaagctagaatgctggtgggaacaaattctgtactttgatagccctttgtagagcatttattgcaggttttggcaaaagtctgtgagcacttcccaatgatgattactgagactttaagagaatttccacttgaggagcatttactgccttgctaagggacattaagtgaagctatccctatgctaacagggatagcagtgccccattgaagtgcccagggttccctaataaaatggaaatggtttatataggatgatgccatctggagtgtacaacgaggagatactcatgagcaaagagctactttctccctaggactgcgtctgaagctatgcgaggagctcctggattttacattacccaataaatagctctcacctgactgataaagagctgcttggtttgtggatggtagctccaagatgaaaggacaatgtcctgcttggaaggctgctactctgattgtaaagcatacttttgtgagcagaatatacctctctgagttctccaaaatttggaaactatctgtgagtattcctgaaacttattttgcacataaattggccatactatcatttctttttagtaaaaaaggagagattagagagagagaaattctatttcaaaggaaaactataacacaattattattggattccagctgtgacttttgttttgaattattatttttctgcagtgggtctctaaaaaagaacctagttataattttcttcatgatgtttttagttagctctctcatggaataagttcctcttccattctgacatataaattctcttttgtcaaatgattaatgttatttatttccccattgtttcacttcgtctgagaaaactgaagttgcggtgttttgaaaactacagatgatttaagagcctatgaatctccctaatttgatatcccaccgggcctgatctgtttctccttgccaatcccctgctgctaaaactatacaagcaccctccctctaagcccggggactatcatggaagaagcgggcacatgaaactgttaggtctggttttcagggatataattaattcagaccctacaaataacctggccttttggctttggtttttagctcttttattgcataaaaggttttaaacattgatgagtgcctgccctctatgccatctggcctagaacacttaaattggctgttaagttttttggctctatgtctcttggccacaagggccccaccaagggacaggacggacctgaagcagatagccataccacctcagcaacaacatgggacaaaatgaaagtgtggccactgatgctgcctctggccaatcttagccaaaagggggaaaaatgagaaataaaaacaattctaaacatccaacagactgaacacacctcctcttggccaaggaaaccccagagaaacctgaaaagctgagttcacagccatggtgaaatgggaagttggacacacttcctgatactcccaccttcaggggagccatcaggctttcctccctaagagctaaaaagaaactagtcctttcaaaagactactagcttatcttcacagggacacaacaaagacaagattaaacatgctttcacccctccctaaggtaagatgagattaatcattccttcacccttccctgagacatatgtttcctctattcccattttcttcaaatgttcaccttatcttatgtaagatgtagatttactgggcactaactaaactctcataagtatgtaataatttgtctcactgctgccccatcccccaccctttttaaggaaaatgtaaaacactaaacttcctgagaacctctttggaaaaagtcataggtgcttctgtgactcaagattttcctgggcaagcccttaaggtggctcaataaacctcaatgatttgagacttgtgccttaatcactcatttcggttgtcagtccacagaaaaaccggtatataaatgttcataatataactagtcataatagcaagaaagtggaaacatttcaaaatgtctttcaactgttgaaagaataaacaaaatatgctatactcataaaacaatctattcagaaaacaaaatgagctactgatatacactgcaatatccatgaacctcaaaactatgtaaagtgaaagaagatatacacaaaagaatacatattttatgagtctatttatagaaaaggcaaatctatagacagaaagtgaatggttgcctggaactagaggacagaagtgggtatagactataaaagagcactgggaacttttgggggttgctgtggtttaaatgtgttcatatgttggaatcttaatccccaacgcaaccatggtgggaggtggggccaaatgggaggtgtttgggtcattgagggccctgcctttattaacgtaacattgttctgcactcattaatgtaacactgttatcacaagagtggtcttgatataaaagtgagtttgcaactggtgcagtggctcaggcctgtaattccagcactttgggatgctgatgctgaggtcaggagttcaaggccagcctggccaacatggtgaaatcctgtctctactgaaaacacaaaaattagctgggcatgatagtgcacacctgtaatgccagctgcttgggaagctgaggcagaagaattgcttgaacccaggaggtggaggttgcagtgagccgagatcgcaccattgcactccagcctgagcaacacagtgagactccatctcaaaaaaagaaaaaaagtgagtttggcccctgcttcctctcatgttctcacactctcttggcctcacactctcttattcttccaccatctgccatggaatgattcagcacaaaggcccccactagatgctggcaccatgttcttcaacttcccagcctccagaaccatgaactaaataaacttctagagtttaaaaggtatagattggatttgtgttcccacccaaatctcaggtcaaattataatccccagtgttggagaaaaggcctggtggaaggtaactggatcatggaggcagacttcctcccttgctgttctcatgatagtcagtgaattctcatgagatctggttgtttaaaggtatgcagcacttcccccatctctctcttcctcctgctccagccgtgttaagacatgcctacttcaccttctaccatgattgaaagtttcctgaggcctccccagccatgcatcctgtacagcctgtggacccatgagccaattaaacttgctttctttataaattacccagcctcaggtaattctttatagcagtgtgagaatagactaatacacataaattagccagtctcaggtactgttacagcaacccaaaatgaagtaagagatattaaaaaatgttctaaaactgaattgtgttgatagatacaaaactctaaaaattcactcaaaataaatgacctatatacttatctatacccacttaccctgggtaattttatgatcttgaaattataccttactgaagctgctaaacaataaaaactttttaaaaatatatataaatataagtctacacttctaccccttcttagaaattctctcctcctcccttatcactaagctgcctctttaaacagagatgcctagggctggggatgcaaagcccacaggaatctgctgggtttcaaaccttttttttgaacagagtacatcatccctttttaatttctcctaaaatatccattgatttgtaggtaatgtagtgttacaaccccaaattgcctcacgaaggctttgcctgatagttggtttctatttctggggccaactcacttctaattgtcctcttggtttctgagatcactttttctctgacactggatttagttcagcctcattccttagaacaaaaccttgcaataagaaacacaaataccaccacagaccccagaccaggaatcattcagattggcatcagctagcttcccactagctttgaggaagggtggagtttaagaagtgtttcacaaactaaaaggcttatcccagagattcccatcttaaaaaaaaaaaaagaacatcttttaaatgtcaaaacatttttgtaacccacatttagtagtgattttattttagtatcagttgattgaaaaaaatacagaatgacaaaaagctactataatagcttaaatgctcttaagtaaatttgcattttattaatcataaccatatctacatttatcaggaaggaaaatctatttaaaaaaagaaagaaattcttgcacaagctgcttctgcattctggggaagcacagaattcacccctgggggaataagtcagtcttttgtttggtatggcacagtctttaggctgtgaaagggatggctctaggctagtctgacagttgagtcaggctgaaaagagataaactgttctgcataatgaaataataaagatttttaggtggtcccctggtaatttaaaggagtgatggctttttgattttctttttatttagttgttgttggcagggaagtagggacgagaaagaagaatctgaacacggtgttcagaagttttggggagaaaagttttcatgggaagagttgttgaacataacttcagaccaccattagtgcttagtgcaaagatctggacactcccagacatcctgatttacaaagggggatacctgctgtaagaaatgtgccttctagtaattttcttgagttaaccctttggaatcaaaagaactaaaaatgagttttatacatacaggaagaagatcccaagcagctgaactagtactgtacacagaacaaaacgtcaacataggtcctacaagacagtcccactgagtctgtccattgaaaggacaattgtaacatcctagcactacagtaaaggcaacacagatgttccttggcttatgatgggcttacaaagcatttacccagacagaaccccatcataagatgaggaggtactaaatgtatattgcttttgaaccactaaaaagttgaaaaatagtaagtggaaccatcctaagttggggactgtctataatctctttacaacttatttttaaaaagctctctagcatatacatttttaaaaacttaaccatcaaaaaaccctatgaggaaggtattatcaacccagttttacaatgtggaaattgaggctcatgtggaataaaattatgtgttatatctcataagaaagtcacagagtagcaggaggtggaacaaaatggatgaatacaagcttccaccaatcatcctccctgaagaaatatcaagtttaacagctatctacacactcacacaaacacacacacacatgcacacacacacacacacacaagcaccttcataagaaccaaacattaagtgagtaatcacagtgcctgattttaacttcatatcactgaaagaggcactgaagagggtaggaaagacaatcttgaattgctgatgccatcccttccccaacccccagcagcagccccaaagcatagagaatccgtgcacttgggggagaaagagcacagtgattgtgggactttgcattggaactcagtgctgtctgtcacagtgaaaagcaaccctggccagaactcagctgaaataaatggagggagcatttaaaccaaccctagccaaaggggaattgtccctgccagcagttagaacttgagttccagcaagccttgccactgcaggctaaggtgctctggggtcttaaacaaattagaaaggcagtctaggtcacaaggactgcaactccaaggcaattcctagtgctgtgctgggttcaaggccagtggacttcggggacacatgacctagtgagacaccaaccagtacagccaagggaattgacgtggtttgatgttaggtgtccccacccaaatctcatgttgaattgtaatcttcagtgttggagaaagggcctggtgggaggtgactgaatcatgagggtggacttccccgttgctattcttgtggtagggttctcatgagatctggttgtttgaaagtatatagcacctcccccttcactctctctctctctcctgctggcaatgggaaagacatgcttgattccctttatttctgccatgattttaagtttcctgaggcctccccagccatgcctcctgtacagcctttggaactgtgagtcaattaaacctcttttctgcataaattaccgagtctcaggtagttctttatagcagtgtaatcacaaactaatacataaaattggtaccaggagtggggcattgctataaatatacctgaaaatgtggaagcagctttggaactgggtaataggcagagtttagaacagtttgaagggatcagaagaagacagaaagatggtaggaaagtttggaacttcctagagacttgttaaattgttgtgaccaaaatgctgaaagtgatataaagaataaagtccaggctgaagtctcagatggagatgaggaacttattaggaactgaagtaaaggtcacacttgccatgctttagaaaagagactggcagcattgtgcctacccctgccctagagatctgtggaactttgagcttgagaaagatgattgagggtatctggcagaagaaatttctaagcagcaaagcattcaagacatggcctggctgcttctaacagcatatgcttgtattcataagcaaagagatgatctgaaactggaacttatgtttaaaagggaagcagagcataaaagtttggaaaatttgtagtctggccatatggcagaaaagaaaagcccattttcagggaaggaatttgagttggttgcagcaatttgcataagtaaagaagagcctgatgttaatagccaagacaatggggaatatgcccctagggcatttcagagactttaacagcagcccctcccatcacaggcctggaggctgggagggaagaatggtttcatgggccaggaccaggaacctgctgctctgtgcagcctcgagacatgtcacctggtgtcctagctactctgctccagccatggagccacatctaaaagaggccaaggtacagttcaggccactgttccagagggtgcaagccagaagccaccaaggcttccatgtggtattaagcctgtgggtgcacagaaggcaagagatgaggcttgggagcctccacctagatctcagatgatgtatggaaatgcctggatgtgcaggcagaagtctactgcaggggcaaagccctcatggagaaccccttctagggcagtgtgtatggggaaatgtggagttagagtacctacacagaatccccactggggcactgcctcgtggagctgttagaagagggccactgtcctccagaccccagaatctaccaacagcttgcaccatgcacctggaaaagctgcaggctctcaacaccagcccataaaagcagccgagggggctataccctgcagatacacaggggtggagctgcccaaggccttgggagcccatcccttgtgtcagtatggcctacaaatgagacatggagtcaaagaatattattttggagctttaagatgtaatgactgccctgctgggtttcagacttgcatagagcctatttgtttcggctgatttctcccgcttggaatgggagcatttacccattgtctgtactatcacagtatcttagaagtaactaatttgttcttaattttacaggctcatagtggaagggacttgccttgtttcacatgagactttggacttggacttttgagttgatgctggaatgagttaagactctgggggactgttgggaaggcatgattgttttgaaatgtgagaaggacatgagatttggaaggggccaggagcagaatgatagagtttggctctgtgtccccacccaaatctcataatgacctacaatcttcaatgctggaagagaagcctggtgggagttgattcaattatgggggtgaaaatcccccttgctgttctcatgatagagttctcatgagatccagttgtttgaaagtgtgtagcacctcccctttcactctctttttcctgctggccatggggaagacatgcttgcttcccctttgtcttctgccatgattttaagtttcctgaggtctcccaagccatgcctcctgtagagccttcagaattgtgagtcaattaaaccccttttcttcataaattactgagtctcaggtagttctttatagcagtgtgatcacagagtaacacaggagggcttgtactaaccatcccccaatcccaggcagtgcagcttgcagctctgaacaagattccttccttccacttaaggagaggagagcgaagagcaaagagttgtcttgcaatttggatatcagctgagccacaacaggatagggtaccaaacagagttctgaggtccccattccatttcctagtgcccagatgacatttccagacacacattgggtcagaagggaaaacactgtcttgaaggaaaggatgtagtccttgcaggattaataacctcctgactaaagagcctttgagccctgaataatcagcagtggtatctaggtagtacacactgtgagccttggatgagactctgagatgtactggcttcaggtgtgacccagcacattcccagctgtggtagccaaggggagggattccttcttgggaaaagcagaaaaaagagtaaaggggacttagtcttgcagcttagataccagtttggccacagctgggtagagcaccaagcaggcccttggtgttccctaattccaggccttggctcttggatttctggacctgtcctgggccagaggggaacatatttccctgaagggtgagtcccaatcctggaaacattcaccacaagctgactgaaaagctcctgggccttaagtgaacatcagtggtagcctggcagtattcctcatgggcctggggtaatggtggctatggggagagacccctcttcttgtggaagggggagggactattgggaaagacattgccttgtggcaccagcacagatttctttggtttctgacttcaggtcctggctcctgggtggcttttctgggcccatctggggccctggggaactccactccctgaaggggaaggctggctggctttaccacctgctggctgtagagccctagggccttgagtgaatacaggcagtagccaggtagtggttacagtgggccttgggcaagactcagtgttttgacccagggcagtcccagtggtggtgaatacagggctacttatataacccctttcccagctccaggcaactcaacacagagagagaagctccatttgtttaggagaaagtaaggcaagaatatgacagtctctgcctggcaatccagagaattcttcaggatctcatccacaaccaccaaggcagtacctctatgagtctgcaggcttgtacctctatgagtctgcaggcttatacctctacaaggctgccgcctaatgcagacatggcggcagtgaccaaaaacttagatcacaacatccaagtcccttcaaatacctgaaaaaccttcctaagaaggatgggtacaaacaagcccagcctgagaagactacaataaatacctaactcttcaatgcacaaacaccaacaaatatccacaagcatcaagatcacccaggaaaatatgatctcaaaaataaactaaataagtcaccaggagccaatcccagagagatggagatatgtgacctttcagacagagaattcaaaatagcagttttgagaaaactcaatgaaatttaagataacacagagaaggaatttgggatcttatcagataaatataacaaaggaattcataatttgaaaaaatcaaacaaattctagagttgaaaaatgaaattgacatactgaagaatgcatcaaagtctcttaatagcagaactgaccaagtatcagaaagaattagtgagcttgaagacaggctatttggaaatacacagtcagagaagacaaaatgaaaaaagaatttaaaaaatgaagcacacctacaagactagaaaatagcatgaaaggggcaagtttaagagtcactggccttaaagaggaagtggagagagagatagggattgaaagtttattcaaagggataacagagaacttgacaaacctagagaaagctatcaatatccaagtaaaagaagattaaagaatgccaagcagatttaacccaaagaagactacatcaaagcatttaataaactcccaaaggtcgaagataaagaaaagatcctgaaagtagcaagagaaaagaaacaacatactatgagctctaatatgtctggcagcagacttttcagtggaaaccttacaggccaggaaagagtggcatacatatttaaaatactaaagaaaaaaaaacttttaccctagaataatatatctggtgaaaatatccttcaaacatgaaggagaaataaagacttgcccagacaaacaaatgctgaggtattttatcaacagcagacctgtcctacaagtaaacggaattttttcagtctgaaagtaaaggaagtaaatgagcaataagaaatcatctgaaggtataaaactcactgataataataagtaaacagaaaaacacaaaatataataacactgtaattgtggtatgttaactactcacctcttgagtggaaagactaaaagatgaactgataaaaataataattttaaggcacagacagtactataagatataaatagaaacaacaaaaagtttaaaagcaagaggatgaaggtgaagtgtagagtttttattacttattgcttgtttatgcaatcagtgttaagttgtcataagtttaaaatactggggtaatcccagcactttgggaggctgaggcgggcggatcacgagctcaggagatcgagaccatcctggctaacatggtgaaaccccatctctactaaaaatacaaaaaattagccaggtgtggtggcgggtgcctgtggtcccagctgctcgggaggctgaggcaggagaatggcatgaacccaggaggcggagcttgcagtgagtcaagatcatgccactgcactccagcctgggtgacacagcgagactccatctcaaaaaataaaaataataataataataaaataaataaatgaataaaatactgggctataaattattatttgcaagcctcatagtaacttcaaaacaaaacaaaacaaaacataccacaaatatgcaaaaaataaaaagaaacaaattcaaccataccactagagaaaataacctttactaaaaggaagacagaaaggaaggaaagaaggaagagaagaacacaaaacaaccagaaaataaataaaaaatggctgaagtaagtccttacttattaataacaacaatgaatgtaaatggactaaactctccaatgaaaagacacagagtaggctgggtatgttggctcacacttggaatctcagcactttgggaggccaagggtggaggattgctagagcacaggaatttgagaccagcctgggcaacaaagtgagaccatgtctctactaaaaataaaaattaaaccaaaaattagtcaaaaaagacaaagtggctgaatggatttttaaaaaacagacccagtgttctgttgcctactaaaaacacactaacatacttcacctataaagacacacataaactgaaaaaaaagaatggaaaaagactttctaagcaagtgaaaaccaaaaagaggaagagtagctatacttttatcagacaaaatagaattcaagacaaaaatcataaaaagagacaaagaaggtcattgtataatgataaaagggtcaattctgcaagaggatataacaattgtaaatacatatctacccaacaccggagtacccagatatataaagaaaatgttagcgctaaacagagagataaaccccaatacaatgatagcaggagacctcaacaccccactttcagcattggacagatcacccagaaagaaaaccaacaaagaacttaatctgcaccatggaccaaattgacctaacagatatttacagaatatttcatccaatggctggagaacacaatcttctcagcacatggatcattctcaaggatagaccatatattaggacacaaaacaagtcttaacacattcaaaaaaactgaaagaataagtatcttctctgaccacaatggaataaaacaagaaatgaataacaagcaaaatcttggaaaccacacaaacacacggaaattaaataatacactcctgaatgaccagttgtcaatgaagaaattaagaagcaaatcaaaaaatttatcgaaacaaatgataatggaaacacaacatatcaaaacctgtgggatatagtgaaagcagtaataagagagaagtttatagttataagtgcctacataaaaaaagtagaaagacatcaagtaatcaacctaacaatacatcttaaagaactggaaaatcaagagcaaacagaacctaaaatcagtagacaaataataaatatcagagcagaaataaatgaaattgaaatgaagaaaaccatgcaaaagaccaacaaaatgaaatcttggttttctgaaaacataaacaaacttgacaaacctttagccaaactaaggaaaaatagagaagacccaaataaataaaatcagagatgaaaaagaaaggcattataactgatactgcagaaactcaaaggattatgagaggcttaatatgccactaaattggaaaacctagaagaaatggataaattcttagacacatacaacttaccaagattgaaccataaagaaatccaaaatttgaacataccgataacaagtaatgagatagaagctgtaataaagaatctcccagcaaagaaaagcccaggacccaatggcttcactgcttcatttcacaaaacatttttaaaaaaatcaatcctactaaaactattctgaaaaatagaatacttctaaactcattttatgaggacagtattaccctgatgccaacaccagatgaaaacgcatccaaaaaataagaaaactagataggatgtagaagtctcagggggttgaaaatttaaaaaaaagaaagaaagaaagaaaaaaaaagtacaggctaatatccctgatgaatattgaagcaaaaatcctcaaaaaaatcttgcaaaccaaattcaacaacatactaaaaagatcgttcatcatgaccaagtgggatttatcccaggtatgcaagcatagttcaacatatgtaaatcaaccaatgtgatacattatattaacagaatgaaggacaaaacccatatatcatttcagctgatgctgaaaaagacatttgataaaattcaggatccctcagcatgataaaaaccctcaaaaaactgagtgtagaaggaacatacctaaataataaaaacaatatatgacagacccacagctagtatgatactgaatggggaacaagtgaaaaccttttctctaagatctagaacacgataaggatccccacttttctttttttggggttgtcaaatcattttttttttatactttaagttctgggatacatgtgaaaaacatgcagttttgttacataggtatacacgtgccatggtggtttgctgcacccttcaacctgtcacctacattagtctcctaatgctatccctcccctagccccccaccctgacaggccctggtgtgtgatgttcccctccctgtgaaggatccccactttttgccactgttattcaacacagtactggaagtcctagctagagcaatcagacaagagaaagatataagaggcattcaaattgcaaagaagtcaaactgtccttgtttgcagatgatatgaacttacatttggaaaaacctgaaaactccacacgcaaaacaaaaaactatctgaactgataaactcagtaatgtttcaacatacaaaatcaatatacagaaatcagtagcatttctatatgccaacagaaaacaacctgaaaaagaaatcaagtaatcccatttacaatagctacaaataaaattaaatacctaggaattaaccaaagaagtgaaagaaattgaagagaacacatacaaaaaaagttaaaatgtttcatgttcatggattggaagaatcaatattgttaaaatgtccatattaaccaaagaaatctacagattcaatgcaatccatatcaaaacaccaatgacatttctcacagtaatagagaaaacaatcctaaaatttgacaaatatttattgactgtttatcttgtgccagtatacccaccaatagcgaacctcagtaatccaaacttgaataccattcaataattgttaccaataaactgtaacaacagtcttcctttgaagaagatcctgattcactgccattttggttcatgggtgttattaaactgatgaatactctgcaattattaaagaacaaaaaccatttacctgaaggcattaattacactcacacacaaaccacttgcttacacagcttctaaatttgtaaccagatgaaacacagaagcccattcatggaattttttattctggaacacctaagaaaaggcaaaagtcatagctgaaaagttgcctaagtacagctgagcaataacgtgagcaaaagtcactatagaaagatttggccagccaggcgcagtggctcacgcctgtaattctagcactttgggaggccgatgtagcagatagcttgtgcccaggagtttgagaccagcctgggcaacatgatgaaaccccatctctacaaaaaatacaaaaatatttaccaggtgtggtggtgcgtgcttgtagtcccaggtacttggagggctgaggtgggaggatcgcttaagcccgggagatggaggcagcagtaagccaagatggcaccactgcactccagcctgggtgacaaagtgagaccctgtctcagaaaaaaaaaaaaaaaaaggcaagcaaacaagctttggcccagttacgatgctccacaaaaaagttaaaaataaaataaatgcctactccaactaatgttgtgccactcactagtctttccacactagggttatgttggaggatctccagacaagaggtcagtccggtgcaccttcagagttcaggctctgccacttagcagttgcttcaagcaggcacttactctctataccgtggttttctcttcataaaatgtgaaggttgtactacataatctctaaaattctgtatcaatcagggtctcagcaagaaatagattgcacattccaattagggtagttcaagaagactatttgcagacccatgggctggaggtagtgtgtccggaattggtaggctcttggtctcactgacttcaagaatgaagccgcagaccctcgccgtgagtgttacagttcttaaaggcagcgtgtccggagtttgttccttctgatgttcggctgtgttcggagtttcttccttctggtgggttcatggtctcgctgactcaggagtgaagctgcagaccttggcggtgagtgttacagctcaagccggcacatctggagttgtttgttcctcccggtgggttcgtggtctcggtgacttcaggagtgaagctgcaaatcttcgctgtgagtgttacagctcataaaagcagtgtggacccaaaaagtgggcagtagcaagatctattgcaaaaagcaaaacacattgcttccaaactgtggaaagggaccccagcgggttgccactgctggctcgcgcagcctgcttttattctcttatctggctccacccacaacctgcggattggtccattttacagagagccgattggtctgttttacagagagttgattggtccgttttgacagggtgctgattggtgcgtttacaatccctgagctagacacaaaagttatccacgtccccactagattagctagatacagagtgtcgactggtgtatttacaaaccctgagctaggcacagagtgctgattggtgtatttacaatcccttgagttagatacagagtgtcgattggtgcattcacaatcccttagctagacataaatgttctgcgagtccccaccagattaactagatacagagtgccgattggcgcattcacaaaccctgagctagacatagggtgctgattggtgtgtttacaaaccttgagctagatacagagtgttgattggtgtatttacaatcccttagctagacataaagattctccaagtccccatcagactcaggagcccagctggcttcacccagtggatctggcactggggctgcaggtggagctgtctgcaagtcccacgccatgcgggtgcactcctcagcccttgggtggtggatgggaccaggcgccgtggagcagggggtggcactcgtcggagaggctcaggcagtgcaggaggccacggtgggtgtaggggagacccaggcatggtgggatgcaggtcccaagccctgccccgaggagaggcagctaaggcccggctagaaatctagcacagcgcaggtgggccagcactgctgggggacccggcacaccctctgcagctgctggcccaggtgctaagcccctcactgcttggggtggcagggccagccggctgctccgagtgcgggcccgccaagcccacgcccacccggaactccagctggccctcaagctccatgcacagccccggttcccgctcgtgcctctctctccacaccttcccacaagctgagggagctggctccagcctcagccagcccagagaagggctcccacagtgcagcagtgggctgaagggctcctcaagcatggccagaatgggcaccgaggccaaggaggcaccgagagtgagcgagggctgtgagagctgccagcacgctgtcacctctcagtaggaaaaccataagagttcagcaacagaacattcgccatcccaggcccacagggaggagggaagaggacaaaacatggtccagaaggaaggagtcacgcagaaaaggccctctgaaaaagaccagtgacttccagacaagggcacagccagtgcaaggtgggcctacaagcagggagtccactctccaccttcccactccctctgatatccttccctggactctccactggctgaacccattgaagccaaacagcatgtcagtttcccagggaagaggatggggtggaggaaggtggagtagacttggagacatgaactagcacaggtcccttccagttttaacattctctggtagttgtgaggatagctcgacctcaactgaccttgggcatgccaagcctgaaactcctaggccattagaaatggatatgaaccaaagtatacaccaaggtcagcccctactccaccactgtagagaatattccagagtgtcgagatcatgcctctaggggaccttccaagctctagatatgttatttgatttttatctttttaaaagaggatacatgatttaccatgaatagaccatattttacattcccttctctgtgaagcttaagagttaaggcaccagctctgaaagcagacccatgctggtttgattccaggttctgactctgggtaacctgattaaattatctaagcctttccttatttgtaaaaggagggtaatagaacgtaccgcatggggttgttgtaaagattaaaagagatattcagcatgtaacacagggcctgactaataaatagtaacatttattattaatcttacattgaggatttatttgacaaaaatttcttggggagttgttaatggcttttatctgagttatcttccttttccttcattttgtctctgggggcctccttcacatgacttcctggggttcccaaaatgccagtaataatcatggattttagtgaagagacacaggaaatgatttatcaccttagacaagatgaaattaatagctttcattgggaagattgttcattttgaaaatatgaaacttacacattgaaaataaaattaaatctaaatgaaataaaaatcaatcatcacataatgctatttgaaagatgtaatttagaaaaaggaaacttggattattatcaaaaggctttattttggctggtgtcttttatgactacataatcctattttgaaaaaacttgggggcactttgctgttgtctatctataggtacactaagaaattacaaggataggtaaaaggcacgcttactgcaaaagagaatgcgaaaacagaaaatttcaagaatatagcaaacatcaggttttatatacccagctgaggagtaggagggaaataaataaaggagctactggtgcacacacacattcatggagtccatccacatttccagagcacattcttagtccctggcactgggctaggccttaggtgtgcaaatcctactagtcctccaaatagtgctcctacccttggagtatccaaagtctactggggaggcagactcatgaacaaccatccaaagaacatgatggagatgaacattgtgttataatctgaatacataaatatgggaacataaattcggggggtgggggaaatcactaaaggcctgctacatcagttagctttttctgtataacaaactactgcaaaaccttgcggcttaaaccacagccttttattcagcttgctcttctgtgagtcagctgggctgttccagtccaggcaggttcagatcatctcagttgggttttctctgtgtctgtggtcaggtgatagatctgctcatgtctggacaatctataataacttcattcattcacttgactggcgactggcagccaaggaaatagaatgagtaggccatgggtctctcattgtccaatgagggcttcttcacatggtagctagcagtcacagggtccccaaaagaagcaaaaggccaactccaatgaaccccccttttcacgtctctgcctgtgtcatgtttgctaagatcccattaggtaaagcaagttataaggccaatcctaaattctgtgtaggaaggggtgcaaagtcacccttgagaggggtgtgcatgtaggaacaggaagaattgggggcagtttttacagtctatcacaaggctgcatacaagtgatatcttgggacagggaatgttatcgtctcctaggaattttccaggaaaaatttgctattccctggaagaagaatcaagacaagaaccactgtggaaatgtaaaaatgcgtctgactcacccaagatgtagtaatgtgtatgttttgggaggttctggagataaggttagagttcatcttatgatttcccattctgtataggtatatttgaaatcactatagctatcatactatttccagtgtctagtcttgcctctagggcttggaaagtaacccaataagctaaaccatccccatgctggagatgttcatataatgagctatgcaggtaaaatcccattgtactgaccacccttacaggaagaccttaatgacagaacatcctgggaatgaaattggcagtgtcctcataaatcacataaagcagggctaagccttcaaagtcacagaacaaatggtcctggcagctatgatgaggtctccacttagggaagaaaaaaacacaacccaccaaggcagaactgggtcatcagtggtgcagcttctatgtctctctttcatattcctctgcctacctgttttataccaagacctgattaaacagtcaactattgcttgttttcttgtttcattcattcattcactcaaccactaatccaccaaacatttattgagcaccttccacatactaataggagctggaagaaaacacagataaataagatgccctgtcccaaaggacctcagcatttggtgtgcaagggacccagaaatataaacaattacaattcagcatgatgagagtagagaaggaagctcaggggactaagggagagcttgagagggacacctaacccagacctcagtgtcagacacagctttccaaaggctgtggcactttagctgaatctcaaagaatgtttaggaaataggcagacaagggtagagcactccaagcagaggaaacaacttgtactggggtatggaagcacaggagaacatatgacaggaagtacacaaggaaagggcaagaacaacttggatgctatctgaggtgtgatgatgcacccaaaccctccccattcgctaaaacattatataagacacaaattacgtatccttcccgaccgacctactgatcccacctcagcgtgaatgaattcaagccactgacttaccttgagcagcatctgaactcgattattggatacactttggcccccattgctgacatcaataaacacatagggtgctttggagggcaggatggcattccctgaagcctcatcaagccccaatacaggtttttcccaaaggtaaacttgatttatttattgcttttaggatgaaaacggagagtcagaaagaacatcagcaagccctcccattcaaataactccttaatcccagaaagctgccctaactgactggtggtataacctaagtccctggtacaggtcagtatcgaacaatattaccaatagtattaataacaatgctgcctgtcagtgggtgtttatatgagtcaagccattgactaaaccctttgtgaatatatattgttaattaaaatttttttaaaatttgagacagggtcttgctctgttgctcacgctggagtacagtggtatgacacacctcactgtagcctcgacctctggggcccaagcaatcctttcacctcagcctcctgagtggctaggacttacaggcgtgtaccaccacaccagaatttttttttttttttgtagagatggtgtcttgctatattgcccaggccagtcttgaactcctgagctggactaattctcccgccttggcttcccaaagtgctgtgatcacaggcatgagccaccatgttcagctgtgaatgtaatctcattaaatcctcacattaactctacagtgatatttctatcatcatgaggaatatggtttagagataagacataacaacttatgtaaggtcatagttagggagtcagagacaaattcagaagaacctgtatcctatcccctgtcttctactacaacagctttctatgcccttaaacctcagtcccaggtcttacccagtcctgtgagaaccttggtctaaacagctcccatctctggactttcctggccccagcttccctactatacccctcagttcattagagtcatttattcatttagaaatatttttgcatcctgactagtttgcacggcctgtagaagattaatcagacgtggtcttgagcctaaagtgtttctactctagtagaatattcattaatttatccatccattcattcaactaaaatgtgtttaagtatttaccatgtgccaagaactttttaagtattaggaagttgaagtgaataaggacctcaaagtttttgtgcatcctagtggaatataagacacttacataaacaatgatatggttgaatgtgttgcctaaaagttcatgtgttggaaacttaatccctctgccttcatgaatggattaatgtcactaccatgggagtgggctcattatctccagagtggctttgttataaagtgaactctctctctagctctctggctcttgccctctcaacatgctatgatgcagcaagaaggctgtcaccagatgttggcactaagctcttgaacttcccagcttccagaacactgtgctaaataaaattattttcttcataagctacccaatctgtggtattctgttataacaacagaaaatgactaacacaaacaattatcatcagactacagtgcggcacatctgggctggaatccaggtcctttgacttccaggtgagtgcctatcagcaaaacttcttggaagagttgcttctagctgccatctctcctttcctctcatcttctctttacctgactcttgctggcttccatctgactgcttcactaaaactactcaagatcaccaatgacttcaaggtcaccaatttgattatattccatctttgtcaaaacactttccccttaatttccatgacaggtgttcctcatatcgcactgactaaccatccctttttaagcattgctgggtccttctcttaacctccaaacattttatccctcaaagcttggtgtttaaaccccttttcctatctgctctctcccacaccattgcctgaagtatcatttacaatcacaaccaattttttacctctagtcctgacttctctctggaattctagactcatattcaaatgtctattgatataaaatttatcaatcaaaatagaactcttgatttttaccaccaattctactaccatcatgtcttggtaaacagtatcaccatctactgaattgcttgagccaaaagcacaagagtcatccttcatgcctgtctccctcagcgcctacatccagtccatcagcaaggcctgccgatacacctccaagacagatccggaatttctccagttgtctctgtctccactactccaacccagtccaagctacgattacctcttgccttgactaacgtagaagccttcccattggtctccaagttttcattctcaccctcctccatttcattctccacaaagtaaccacaatgaaccattaaaattaaaagccagaccatttcaccctatgtttcaaagtctccagtggttctgccgcacttagaataaagtccaaactctttacctggtctgaatcccaatataatttgcaacacttctctaatctcatctccttccaggttttccttttgtctctctcctccaatcacactggcccagggcctttctgccagctgctgcctttgcctagaaagttctttttcctgatcttcacacagctggctccttcatgtcatttacatctcagttacatgtcacctcctcagaaaggccctccatgatcacccactcttacacattgccctattttaattgtgcgtgatacttattactaacaaattaatgtgtgtgtgtgtgttttaacttatctgtttcttatctacctgtttattcttactagaatataagatcctagagagcaaaggtgttatttgccttgcttatgataaggaagactaaccaacatagattaggtagtcaataaatattaaaaaagcaaaaagataaatcctgtataactcacataataagaaaaggcaattttattatgctaaggagttgctaataaagggctatcacctttgtggcccagaaaagaagctcaattagtaggggcctgtggaactcagaaaactatcaaatgaaaaattgtaagacaatcctttcatcagtatgaaagaattttcaaagacttctactgaaaatagcagagacttttcaatccaaacatacagaatatacatttcccggaatataattctgaaatattcaggcaactggaccagattgattatggatggattggagcatgccttttaagtctccccatgtttgaccataaatattgatagcccctttttggtagatggttctgcctcatgttccagatgaaaaaaaaaccatttaaaaggaagaaagctatgtagctgcctctcttttagagaatggaatatgttataagcatgcccagaaaaacagaatactcagggatttgaatcagaacagaggccatgatgaaagtgataatacaaactggataaatgggtgaaataaagctccccaaacagatgcactagagatagtccccaatcccagatttactttaacacgcaacatcagaagagtgagcacttaggtttgatctaggagccatcattttgcaggggtccttaagaagtcttcaggcacaaaaaggctgttggaaaacagaccagagaataccagggtttttattgacagaagtgctaataaaacaacacaattgtttgcaaccagaagctaaatgactcatatctctttcaagaaaggtcctatcacacaggaattgactgtaaagcagtatctataacctaactttcaaaagctctaaattttctgacatgaatgaaatagtcttaatttaccctcaactagataacatgttaaggatgggaatgtgtctttatccacttttgtatcctcatagttcttaaatatctagtaggcaagcagtaacagtttgcttattaaataaatctcaccaccaccatcttctctaacttggtttgcatgcaatcatcttttcctctctcctctccatctctccatctgtctgtctctccatctgtttctctctctctctctcacacacacacacacacacacacacacacacacacacatctggcctctctgttagagctcactgcttagattctatcttaaatctgtgaaggactagatctgatagtccataataccttaattgtcatcgtaacccaaaatctaactgatggcagggagtgacagcagctttctcatctgtaaaatggggataataaaagtgcctggaatgacactggaaaggagtaaagccaagtgatcagataggctgcttcattctcctaccccaaacatgcagaaaacttagctgcagtatgcaatgcaagtgtcctcaacacccaacacttacagcagccaccgcaaccaagagaagggaatcctgtgtgacacaggcatggagtttgtcttgttctttcaactccttcaacttttaagaactgttcaaatttttcttagagacctgactcctctattcacaacaatatgttccttactagagaagcataatattaacacaacaacactactaataagtgtaacagctcacatttatcagcacaattggtgttagccaggcatgcaacaaaagacttcacctacaccaacccaattaactatcacaaacctatgaggaaggcattagtattacctatgtcatagatgactatcctgaaactcaaagaagttaaataatgtctacatggccacagaactacaaatgtcaaatttgggacctgaactcaggtctgttgactccaaggcctgggcagtattcatctttaacttgttcatccttatccccagcattaagtacagtccctgacactggtcaaagctttaagcctcaaatctaggcaccaacaattgcttagaagcaagcagtctaagagcacagaccatgaaacagaaaaagagccatggcttcaagtcccagactggtcacttattagttctgcaaccttaggcatatttgtcaacctctcggagcctcagctttctcatctgtaaaacagcgataataaaagtgccttcaataggacacttagtatcttgagtaatgcacagttaagactacttacaggtccacaatttcttaaccataaatctaaagcctgaaaagctctgaaatcagaccttgttcttaaaactggttgtattaatttctattggtactataacaagttcccacaaactcagtggcttaaaacaacaaaaattttttatcccgcagttctgtaggtcagaagtcaaatgtgggtccctggactaaaatcaaggtgtctacaggctgtgttcctttctggagactctagagaggattcatttcatcaccttttccgtcttttagaggcttctcccattctttggctcatggcccccttccattctgaaatacctctgatcctaagggttttagatgagactataaatttatattctaataattattattaacatcatcttcttctctgaaaggcaagagaaaatggtccatggtcgacatggttcataaatcatgttcacaaagccagtgcccccttgagccttggaagaccctgctggccgggcgtgatggctcacacctgtaatctcagcaatttgggaggccaaagttggctgatcacttgaagctaggagctcaagaccagcctggccatcatggtgaaaactcatctctactaaaaatacaaaaattagccaggcgtgatggtgcacgactgtaatcgcagctacttggaaggctgaggcagaagaatcatttgaacccaggagacagaggttgcagtgagccgagatcatgccacttcacttcagcctgggcatagagcaagactctgtctcaaagaaaaacaaaaacaaaaacaacaacaacaacaacaaaaaagatcctgttatggtttgaatgtatatgtccctcaaaaattcatatattggaacttgaacctcaatgtgatagtattaagaggcagacttttgggaggtgattaagtcatgaggttagagccctcatggatgggattagcaacctcataaaagggctggagtaaatttgctaggcccttttgccctctgttctttttgccacatgacgatgcagcaacaaggcaccatcttgcaagcagtctttaccagacatggaacttgactgtgccttgatcttggacttcccagcctctagaactgtgagaaacaaatttctgttgtttataaattacccagtcttgggtattttgttatagcagcatgaaggggtaagacagatctggagtcagacattcctcatggccaaacctgataccactcctttcttgctgtgtactcctaacctctatcagcctccctgtcctcatcacccaggagtaggggtgggggtgtgagtgtgcccacagagtggtcatggggattaaatgagatgaatcatgcatagcccttggcacccaacaatgggattgctactgtcagttcctatgctcctctacttgggtattgccttcatggctgacacccatggctttctttctgggatgtgtggccttcatcaaaaatgtgtttatttagtgaaaaaaaaaaaaggaccctgagattttcatttaattttgcctatgttctcacactgctccatagcacagcactgatgatactaaaaagctaactcctggatctaagctgctaagaccttcacatcactggcagctttgctaatgtcggtgttctgcagaacaggaagtaactcaccagcctactatgttctcatgaggccatcccttgggactgtcccactgcctctacactgcttctgttttcaccagacatctcctgatcctaacttggtttctcaagtaaacttctccactgccaccaagaggaatgtcttataggaagctgcagaataagaagtcaaggccacatgtgtggatttgagaatcagaggcaccattcccttttttcttccctttcttccctccttccctccttttttttccttccttcctacttccttccctcctttttttttcttttgttccttcttccttccctccctcccttccttccgcagtcaatccacaaagattaactgaacacctaccaagtacaaagtactatgccaacaggctggcaatacagtcttcaagataagcctgggtcatgctatgcagagtgtacagatgatcccataaatcatgactttattacagttaattttacaaaccattaattacaaattgaggtgagaattaggaagaaaaagtgcaaggtgttaaaagactgtttaagatagtcaggggattctagaaatgtgtcatgacctagtaatatctaatcaaggacctgcctgaagagtgataaaaattacccagctaaagagctagaagaatattccaggggagacatgaatagatgtgtgaagacccagtgtcaaggaactgaaagaagaccagaattgccaaaatacggggaggagaggcagtatggtacatgactggttagttggtggtaggtaggaagaaaggaaggaaaggtgggagaaaagaaagggggaaagaaggaaaggtggaagaaaagaaagggggaaagaaggaaaggagggaaagaattaaatgggaccaaatcaaatctggagcagaagctggcaagctccagtaagaccaaatctggtcccagtctgtttttgtatggcccccagctaagaatggtctttgtatttttaagtagttgaaaaaaatcaaagagaagaatgctattttatgacatgttaaaattatatcaaattcagttttctgtatccataaataaagctttattggaacacagccacacccacacatttgcatattatctatggctgctttcatgctacagtggcagagttgaggagttgcaacagagaccttacagtccacaagcttaaaatatttactgtctatacctttacagaaaaaaagtgtttgccaacccctgatttagtgagattggcagaggccagatcatataatattttaggtcacattaaagatttactatcttatcccaagaccaggagaacccaataaatagtttgaactggagaacagcatgacccagtagtgcccaaacctatctgcacattagactagggagcttcaaaaaatatggatgcatgagtcccacttccagatattatgaattaattagtcttggtatggccagtgctttggaattttgaggggattcctaggtgactctggtatgcagatgagtttgggaaccatggatataatcacatttttatgttttaaagatcagtctggccgggcgcagtggcttatgcctgtaatcccagcactttgggaggcagaggcaggcggatcatgaggtcaggagatcgagaccatcctggctaacacagtgaaaccccgcctctactaaaaatacaaaaaaaattagccgggcgtggtggtgggagcctgtagtcccagctactcgggaggctgaggcaggagaatggcatgaacccgggaggcgtagcttgcagtgagccgagattgtgccactgcactccagcctgggcaacagaatgagactccgtctcaaaaaaaaaaaaaaaaaaaaaaaaaaaaaaaaaaaaaagatcagtctggctcaggggttctcactctggctgcacattgggatcatctggaggatattttcaaatatactgatgtgacgcccaggcccatctggcatcaattaaataagaatctctagggggtctccccaagcactggtataaagttgcccaggtgattctaacatgcagccagggttgtgcaccccgcattaacaggggccaaggatgaagacccagagacccccaagaggctactgtgagtgcccaactgaaagatgataggggctgaagttgagttgctgggggtagggggctgtgtaggcacaatcaggaggacttggtgatcagtaagtgacagtggaaagctgaagtggaaagtttcaaaaacgatactcaaatgtctagcaaatcaactgggtgcaaactgatggcactttttgggatgggaaccttggacgaggaacaaggtgcggaagtaagagcactatttctgttctgatgtagtgttgaaaaggagggtgtcttcggagagttggccagaataaagctgtaagggactgcaatcaaatgataaagagccttgaatgctatcctaacaatatcctcctcatatagcaggcaatggctacaatgacgtagtgaaatacgtatgacctttggattcagacactgttccagtcacatacaatgtatgtgagcttcctcagcttcctcacctatagcatggcattaaaagtgttcatatatgtcttgttcatctttgaccagcagagtcactcaacgacagacactcgaaaaacaccctcacaaggatattgtaaagattctatgagataccatgtgtcaagtgtctagaaacctaagtagcacaaaacgcattcataaaatggtagtgttatccctgaagggtttccaaagaagcatgacccagtgacactctcacaatgaagttttagaaagtgtaggtggtgccccagtggtcaccgccctgcatctggagacttcctggcactgcacatgatggctggcctccaagaagaccaccgcctgcatgggatggccacccttggtgcccagaagccatgagctttccccctggacccttcactccgtgatcttctgcccaagaattttgtttccatggtacctcaccctctgttccaatgccacccaagattctgtggctgaccagcacttcagacacattgttctcttttgcctgttctcaaaatagaatcatatgccaaggtggaaaaaaaaagtgtatataaacatctgtgggaaggatgggtgacagggagaagaaatgtgtacaagttgagtatccctgatccaaaatgcttagaatcttttttatattttgaaatatgtgcatatacataataaaatatcttgaggatgggacctaagtctaaacacaaaattcatttatgttctatatttaccttgtacccaaaaatcaaaatatttatcagtgaaatgatatgaagtaatcttatacaatattctaaataattttgtgtgcccatcacatgaggtcaggtgtgaaattttctacctgtggcatcatgtcagtactcaaagattctaatcttggagcattttgggtttcagactttcagatcagggatgcccaatttgtactaggtttagcagttgagattaagttcagctgcatgtgataaacaacataatggtattagttcatcaattagtaagaagtcaaggttccagcaattctgtggagttgacagtcctccacgatccaggctacccttccagcatactgctcctctttaacaagcatgaccatttttgtccatcttgactaagtggccagagctctagccaccatcttcatattccaggcaagaagatggaggaaaggacagaaaagaggaagacggcacacaccaattttcttgaaggcagtttctgggaagctgaaacataatacttctactaacatctctcaagcccaaatttagtaacatggccacatctagctgtaagggaggctaagaaatgcagcctttattctgggcagccatattcccaggtcaaagcaggaattcccataactaaagggggaaggggaggacggagattggggtaggcaaccagcagtatctactgcaaggggtgaagggttattgacttgtgcttctcctatgctattccctcactcagaatgccttcctgctccctctctgtgagttcattcaaacactgattcactgcctctgtgttcctggcatctgctgctcctttgactggaatgttccatgtctccacttttattattttccttagatatatttacacacatagatataaataaatacacaatatttgaacaagctttgaacacaagttccatccatacaaactgtatgtccttgtcaagtcacttctaccctctgagcctcaagttcctcctacatcaagtggggatactgatgcccacctcacaatgttgtagaggggatcagtggagatttctgtatttgggagtggtctgtaagcaataaatcattaaacatctattagctattatcatttctaccctgaagcattacttcctgttagttaacatgagaggaaaaaaaaaagcagttggtggctaagtgttactacacaaaagaacagggcagaagacccatttcatctccttctcactttcccatagcaaagccagaagaagattccatcaattcttaaaatgtatctacaagcagaaaattaattttagagatgagcaaggataacttcctttgaagtgaaaggagtctggagaagccagaatgcaccctgccctgctgattgaagcagaattaaagccaaaagcagaactcagatcatcagagggaatgagtcatagtacctggcgaggaagcaaggcttcagccagataccaatcagagctaaatattacagctcttgcaaataaggcagatgagttcctgtaaccatgaacaacccaaaggtggcccctgccctcatacacaaagctaaaaactaatggttgctgacagcattaaaacaataactgtatctgctcagattaatcatatatctgacttaatccaaatatacctcaagagatgtatcaaatacatacttttgcccctttcattataaaataaaatacatatacaggaaagtgcctaaaatatacatggacactttaacaataattaagttaacccttgtgtaattaccactccagtcaagaaagaaaacactacaccaccttagaagcatgccgctctgatctcagttttctccatcccatctaaaagcaatcactctctctttgttctttttttttttttttttttggcaggatttgctcttgttgcccaagctggagtgcaatggcgcgatctcggctcaccgcaacctcggcctcccgggttcaagcgattctcctgcctcccgagtaactgggattacaggcatgcgccagcatacccagctaattttgtatttctagtagagacggagtttctccatgttggtcaggctggtctcgaactccagacctcaggtgatctgcccgcctcagccttccaaagtgctggcatgctggcattataggtgtaagccactgtgcctggcctctttgttcttatgatatatatttccttccttttctttataatattaccacttatgtacgtccctaaaaatatttttgtctatttaaaatttttatttgaatggaatcacatatgtatatactttatattttgctgcttctgctcagccttacatttgtaaccataaaatatttatcagtgaaatgatatgacatctgaaatttgatttaaaataattggatgaaggaagaattgcaaagtatattttgaataaatcgaccataagttgatcactgttgaagatggatgatggatacatcagactcattatagtatacttgactttaaaatatgtttcaaaatttatataacaaaaaatcatttaaattacttcatgagattcacttggttgctgggtgtagttagaatttgttcattttcattgctgtatagcaatacttctctaagtaagatcccaagaccagaagcatcagaatcacctgggaatttatgtgaactgtaaattcttagcccaaccccagacttttgaaatcagaaactcttggggtaaggtttctgatttggtaaggtctggggttaggcccaacaatctgtgttttaataagctctccaggtagttctgatgcacattcaagtttgataaacactcctaaatagcattctgttgtatgaatataccacaatttatttattcattctactactgacacacaggtgtattatttcaagttttaaggtttcaagtttgtggattctataaatattcttgtagaagacttttggtggacaagcatctttctgatatgtacctggtgataaaataacagggtcttagggtgtatgtatttttaacattacatgataacactaaactatttgcaacgtagttcaccaatttataatcccactagtaatgtatgtaaattccctttgctccatatccttcccaacacttggtagttttttgacattttaattgttgtcaatctagagggttaaacacttaaactttccaacttagaattaaaaaaaaaacacatattagagaacagaacttcagatgtaaaatcagtttcacaaatatattagttggtgagttttcatggagtaaacccgatgcaggaaagaatctggtacaatagagaaactgagaaaggtcaatgtgactggaatgtggcgaacaagacagaatgcagttcaagatgttgaggagtgaggcagggacaaaccaaggacctcctacatgtgctaaagagtgaattttattccaagtgaaatgaaaagaaaattaaaaattttaagcaggaaatttacataattatatttctatattagcatacatttaaaatatttcaggcacatagccacttctagccatgatggggttgtttgatacttcagaccaatgcttctgctgaaagccactttaaaagctggataaagcacaaatacacacacactcacacacgcatgcacgctatgatgcccgaaagcatcaagcagttgttgagacaaccaggacttcagggaacaaaatcctagagaagacagaagcacagggaggcaagccaatattgtgcagctgctctttcccttggggcacttgccaaaattgggtgaagggtaaggggctaaggatccaggtaaagagcctcagcagagagttgctaataaggggcaaaaacaccagaagagcacttggcagtctcttggagatagagaggcaaaagtcagaggcctaaaaggcaaagatgccagtgaaacctaagcccagcacctgttagttccctcaaaacatttgctgaattctgagactgcataaggcaggaggctaagaagccatgcttgatagtcttacagttttgaggaaagaacatttaaagttctgaactagccaggggtggaagtcattgggctaaaatcctaagaaggctacatcctagaaagaggcatctgccagtggcagagctctaacagaactaaaatacagcctatgttcagctcagtccctaattggattaaaataatcagttgtccaatatgcctgcctagcattttctctggaacaaaataacatcatctacagcatctacaatttttcatgcaatatgatgaatatacaatcaacatttgctaggcatgccaagacacagaccaaaaacccagagaaaaaaacagatcacacaaagaaaccacaagtgactcagatattggagtcaggaaacgaagagtcaaactatgattaatacactaaaaaatataacaagatgaagaaattagatgaaaaggtagagaatttcaccaaaaaaatcagaatcagtttaaaaagcttaaatggaatttctagaattgtaaaatactattatggaaattaactcaatagataaggttgaacaacagattagacatagtagaagagacaattaacaaattggaaggctggtcaaaattttttcaaaactcaagcacagatgtaaaacataaaatggaaaatatagaaaagagtaagaaatatgtgtgacagagtaaaaaggtctacaatacatatgtttgaagacatagagaagtaaagaatggaacagtagtagtgtttgacgagataacagcaaactgattaaagatatcaatacacaaattttaaaaatcattaggaaccccaaacagggttaacagtaaataaacgacaataacaacaaaaaaatcaataaagccagacctagagacatcacagaaaaactgataaaaattaaaggcaaagacaaaaccctaaaagtcagggtaaaaaagacacattaccttccatggagtgataataatgttggctaatggctgatttttcaacagaaatgatggcagtcagaagacaatggaacaatgttttaaagttctggggaaaaaaactagaaatataaaattccatactcagtgaaaatatcattcaaaaatgaagctgaggctgggtgcgttggctcacacctgcaatcccagcactttgggaggccaaggcgggcggatcatgaggtcaggagatcaagaccatcctggctaacaaggtgaaaccccgtctctactaaaaatacaaaaattagcagggcgtggtggcagacgcctgtactcccagctactctggaggctaaggcaggagaatggtgtgagtccaggaggcggagcttgcagtgagctgagatcacaccactgcactccagcctgggcgacagagtgagactccgtcccaaaaaaaaaaaaaaaaaaaaaaagaaggaagctgaaacaaagacattttcagacaagtaagaattgagaggatttgtcactagcaaaccctcagtaatatggtttggctgtgtccccaaccaaatctcaccttgaattgtaataatccccacatgtcaagggcagagccaggtggagataactgaatcatgggggtggtttcccccataccgttctcctggtagtgaataagtctcacaagatctgatggttttataaatgggagttcccgtgcacaagctctctcttgcctgctgccatgaaagacatgtcttgcttccccttcaccttccaccatgattgtgaggcctctccagccttgtggaactgtgagtcaattaaacctctttcctttataaattacccagtcttgggtacgtctttattagcagcatgagaacagactaatacattcagtaaaaaaataatgctgggccgggcatgatggcttatatctgtaatctcagcactttgggaggccagggtgggagaattacttgaggccgggagttcaagaccagcctgggcaacatagcgagactgtctctttatgtgaagtaaaaaaaaaaaagtttttaatttaaaaaaataataatgctaataggcatctaactgggcagaagaaaatgatctcagatgaaaatgtagtaatgcagaacaaaacaaagaacaatggaaaagataaacatgtaagcaaagaagaatgaatacggactgttacaacaataaaaataatatctaatgggttttaataatctgtagacctaaaatgaatgacaataataacataaaaggtgtgaggggatagataaaattaaaatgttccaaagtaccttattacctaggattgtatttccccaaaataaatttaaacatatccacaaatgacttgcacataaataaatgttcagagcagcactattagagatagccagaaactagaaaaaaactcaaatgtccatctacggtgaatggataagcaaattatggtatatttatacaacggaatactacttatcaataaaaatgaatgaaccactgataggctaaaaactacagatgactctcacagacattatgttgagaaatagaagccagattcaaaagagtacatactatacaattccatttatatgaagttctagccaagcaaaaccccaatgcatgatgctaatgtcaggacaatggttccctttgcaagcaatagaaactagaaaaggagaggaggggacctctgggaggttgccagtgttctatttcttaatatagttgtttacatggatgtggaaattcatcaagcttcatccttagaattgtgcacatacatatacttttctatatgaatttcaaaaagttttaacaaatatttcagtcatacaaaaagttatacaaaggataataagtctatatccaccaccgagattaagaaacaaaacattaccaatataggtgatatatatactactgattacaccaccacccaccccaccagagataaatcactgtcctgaatttggcgtcaaccactcccttgcactattttatacttttactctttctacaagcttccctaaatgatatgtaaaactatttttcatgttttaaaactatgcataaaaagtaatttgatttcttttttttttcttttttttttttttttaagacagtgcctcactctattgcccaggctagagtgcagtggtgtaatcttggctcgctgcagcctcaacctcctgggccaaagtgatcctcccacctcagcttcccaagtaattgagaacacaggcatttgccaccatgcctggcttttttgtttcttttcttttcttttttttttttccgtagagatgggagtctccctgtgttgcccaggctggtcttgaactccagggctccagcaatcctccagcctcagcctcccaaagtgctgggattacagttgtgagtcaccacatctggctggtaatttgatttctatttttaaaagatcattcttaaattagcacaagggaactttcttggatgacaagatattctatatcttgattagaacattagtcacataggtatatatatttgtcaacatacaaattgaatatttaagatctgtgcatgccattatatgtaaattatctcactttaaaaagtttctaaatagaccattcttgcttcttcttagggaatagctcggggctggacagaagtggaaccaggaaagccaattagaatattgcagtaaacctgatgagcatcaaagtcatctatctaaagcgcaaggaagaaaagacaacttatggatacaattctttgagcagcttaactgtgaagcagagccgtggctggaggaagaagtgaggccagaggccaaagaagggttttaaaagatagaaaaccaaacttgacacagtagaaaggaaaagctgaagaaagaccatcaataagctgggcctggtggctcacgcctgtaatcccagcattttgggaggccgaggtgggcggatcagttgatgtcatgagtttgccaacatggcaaaaccccgtgtctactaaaattcaaaaattagccgggtgtggtggcgtgcacctgtaatcctaggtatttgcaggggctcaggcacgagaatcacctgaacccaggaggcggagggtgcagtgagcagagatggcaccactgcactccagcctgggtaacagagtgagattctgtccccctccacctcactccccccaaaaaaacaacaaaacaataacaacaaaaaagaccatccatgaagaaacaataaaggaacaaagaccttgagaaggtggggagatggaatataaagtccaagtagtttggtatttgctggctcacaatgtctttttgctttttaactggaaagaagtaaaaagaagggtacacatgcaggacagatcagattgtttggtgggggaaagataaaagttctcatctgatggctgctactttttcaatgaatacaaatcattttctgaaaaagacgggatgggagctctgaagcctgtgaaaaacagtatggcattacattagaaaagcatcccggtgtgatggggagtggttaagaaaaatgaaaggttccattttagacaggctaaatgcccaacagatatccaaactctccaaatacacaaaagcctgtaatgagcacaaaagcaacaatattgtaattaatctttgattatgctgcacaaagcacagtgtaacctatattaggtactcaagagggaatgaacaagggaatgaagattttttttttacatattttcacagcacatttaatatcatctgtcatattctacaacggaattgcagaaaacatgcttttcagaaataatatattttccttttttctcatttttagttctcagtgttcttggaagaaaatcagtctgtgtcttccaattttatcaattcttcattttctctaaagaaatgatatgctgatcttctaaaataatttttaagcagaattcaccaatggggcaattctcataggtaaaaggagaatctatatgcctatgttaccacaatttgtgacaatcataagaatacagttaacaacaaaatcttaagctcttgccaagaaggattaatgtcttctcagtattcaggacatgcctgccgatgctaagtcacacatgcacgctgagtggagaatgcctttagctcatgtataggaatcacaaggtgatctcagccaaacctcaatgtagcccagaagaggagaaacactggctgtcttaggagacaaattagcacaaggtattatttatgtatcatttatcaactgtgaaattttaaaaaatggttataaatacagtacttgcagcataaaccgttatttgttttattacactaagttccatttaaaaggactccattcatgcaggatgctctgttttggttggctgagcagtcagatttctgtgcttataattcatgtatacacttactatgtgtattgagtgcactctcctaattccagttgccacagtcagactgtaaatacatatgttttgtcattcttaactactgtaattcagaacttcagctgccaaatttggtgctaatattctcacatatgcagttcatgctctgctcttaagtaattccttgtttgctgtcagcagcttctaccatgatatataaaatggtagaatcaatttaaagaaaaataacctaaattgttagctaaatggagctacaatgtgtttttcttcttgaaaatattcccttttctattatttcctttatttagtaattataaaccctggtcaagcaaaaaatacatacagcagaacattttaagtaccagcaaaccacaaacagcagtgttttcaagaagaaaaaaaggaaaatctcagtttcatgctagaccatcctttgaggcactgtcattttaagtgtggaggcatcaattatttcccctaggctgaaagatctacacatataaaggttctatagatccactaagaaaataagcaaccatttctctgtatcattaaacacaacaggatactagtcttgaaacaccggcaaaattctgagtgtgaatattaaggtctcatatttcagtttcaagtgaaatagagttgttttaggccaaagaggattgagaccatacttcaagttgtcaactgcataatatttcaagggtcaaagactagctccatttcaaaagcctgtaaccttacagcctgaagaaaccctgtgggtctcctagttcaatatgacacccaaggcaggaatttttcccctagcatccctgacagatggtcagcctctgtttcaattactccagtgggggagttctcaagagaaggttcccaagggctatgatgaaaggctagaaccagccattcagacctggaggaaggctccagtcagcaagctcgcaagatacagacagcattaccaaacattgaaaccagacttccacaagcaagaatgcgattccgaactgaccatcataaagatgcaatgtgtaagacatacaaaccccaattctagaaccatccaaggtccttttactggcctagggagtagctcccacaatggggtaagcaaggtggcttttctccgacttattattattattttttaatgactctttaaggctcacagcaaggcttgatcaagtcagggagcaccaaatcccttccttccaaaaaccaaggcaagggacccgctggtggaaatgctaaggcttaaaatactcttaactttggtcttaaattcgtcactacagtaaaccagaacatttccggtttttcttttaaagatgtacataggctatgccgtaaccgaagtttggttggtgtagggtggattggggggagcggtgttttaagcgcagcccttcatcccgccttgaagtctagcttgatcctcccaggaaaggcgagcgcgcggggctgagctgccagccggtccccagccggagcctgggacggggcggtccggcccttacctgtcaatgctgatcacgcacagggtcatgatcgaggccgtgcagcacatgacgtccatggcgatgaagacattacagaaaaagtgtccaaagatccacttgcccccgatgaggtcggtgacgctgacgaagggcatgaccgccacagccaccgagaggtcggccagcgccagggacacgatcaggtagttggagggctggcggagcttcttgacgaagcacacggagatcaccaccaggcagttgcccgcgatcgtcagcagcgtgatgagcgtcaggatggagccgatcacaactttctcgactctgccgtagttgatctgttccccacagccggaggcattgtccgggggcgcgtcccaggtgggcgccgggctggctgtcacctcgctcagcaggtgcggcgcccaggagcccgcgaccgggtcggcgccaccgtcggggctcaagtcgggcagcccgcgccccacttctggcagaaggaaagagcggaggtgcccgtagaggtccgggcggccgctgctgttaacgtccatcatcgcgccgccgtgtgccgctgcccatggagccggcgccccggccacgcgcctccggctgccggccccggggcttcacctcaccggttccgctccgcccggcccagccatggggcccgcgccgaccgctggggggcgcctggctctgtctcggagccccgcactccccggacccccggccgctgcgggtaacgcggcagcgcggcctcacggggactccctgcgggaggcgcttcggcccccgac

SEQ ID NO: 201 - DNA, 117096 bp, Homo sapiens; identical to SEQ ID NO: 200

SEQ ID NO: 202 - DNA, 117096 bp, Homo sapiens; identical to SEQ ID NO: 200

SEQ ID NO: 203 - DNA, 106138 bp, Homo sapiens
gcctgatttagcagatacgtttattcaacacagtgcatgattcaaagcatcggatattccacagccaacaaggtttcctattccctattacaaaataccggataccctgaatatagctcattcaaggtcctcgttcctttttccctatatctagaattaaacaggtttccccgtttagcgcacatttcacgttcgctgaaggctttggggagagggggaaacagagcttatgactgcccctctgaaccaaaggcacttaatgttaaaagataaagcacagtagagtcaccccacagacattcctatgtgttcaacggctgaacttcagcataccatcaccggccccatgtgggattcatcataacaacgtaaaagacactgatttccttggaaaaacaaagtgcagtacgaatataaaggagtcaccacacccctcttccgaaaataatacataagagaactcttactttacatgattagtatcactcaaggttcacacatggaaaaaatagctaaaaaataatctataataaattctcactatgaagtcacaatagaatctgataccctttttagaactggtgagttggagagacacccagaggtcatgctgtccatcccttcatttgataggggagggcacttgaggcccaggaaggtcaagcgtcggacctggggtctaacccctgtggcagagcctgcgtaggacgcgggcctcctgaagcctagctcagggttccctccactccccttcctctttaaagactctcaaaagtaaaatatggtgatgatctccaaagatgcaccacaccataaagcacatgcactgacccaggtcagcaatttggtctcacaaggcggttcctttggccattgggcaggtatgtaacccacctcagggtgggaattctttgcatgggatcgttcaaagttctgagaaaagcccaatgtaggtcagacacgactgctccttggactggggaagactttccttggttgtcagtccatagtgggcaggcggtcggctgcacagcggaatcccagattcgaagcagagctatcaggtgtgttctggctccgagcagcacagcgatacctgtaacaataagactgtgtagagagaaagagcaaggtaagtgctactgggactctcagctgaaggctctaacccatcagatgcatattgcaccggctgtagacagtgcttccccacaaccctgcctgtatggatacttaacatgtatgctttaaaaagggcagcacattcaagaactaaccacatattttccaacgtccttcaccttataaatgtaacacggatatagtacaaagatgttcagcattagatataacagcaaaaaagaaaaatgtaacaaccaatgattgcctaagtttaggcacatccatataatagaaaagtaagcagccattgaaagtcatgtctttacatagtatttaatgacacaggaagttttcatgataaaatgttaaatgaggccaggcgcactggctcacacctgtaatcccaacattttgggaggctgaaatgggagaactgtttgaggccaggagctcgaggccagcctgggcaacacagcaagatcccatctctacaaaaaattagctgagcatggtggtgtgcacttgtagtcacagctactctagaggttgaagtgggaagatctcttgagcctgggtgtttgaggctgcagtacaccatcactgagccactgtactaaagcctgggtgacagagcaagatcttgtgtccaaaaaaagaaaaaaaaacagttaaaatgaaaaaggcagaatataaaggtgtatatgtggtatgaccacagtgtagataactacatgtgccaagaagaaaagactggaagattccgaatgcaccacaatgtgcacagtagttatccctcaagcaatctgagtttcatgtttcctatatgaaacctattcagtattccaatacaataagaatatatattaatttttgaaattaaaccaagtaataagtgatagatggccactgaaaaaatactaagaacaacactaagacaccatttaatacctaaataatatttatgatattatttattatctaaatcatatttatgatatcatttaatgccagtagatcggcaaaaaattaaacaacaagtctaggaacatcaaacataggaaaggctgtgggacaacattgctttttaaaaatacattgctcttccatttctttgtatcctcttttatttcattgagcagtggtttgtagttctccttgaagaggtccttcacgtcccttgtaaggtggattcctaggtattttattctctttgaagtaattgtgaatgggagttcactcatgatttggctctctgtttgtctgttattggtgtataagattgcttgtgatttttgtacattgatttcgtatcctgagacgttgctgaagttgcttatcagcttaaggagactttgggctgacacaatggggttttctagatatacaatcatgtcatctgcaaacagggacaatttgacttcctcttttcctaattgaataccctttatttccttctcctgcctaatcgccctggccagaacttccaacactatgttgaataggagtggtgagagagggcatccctgtcttgtgccagttttcaaagggaatgcttccagtttttgcccattcagtgtgatattggctgtgggtctgtcatagatagctcttattattttgagatacatcccatcaatacctaatttattgagagtttttagcatgaagggttgttgaattgtgtcaaaggccttttctgcatctattgagataatcatgtggtttttgtctttggttctgtttatatgctggattacatttattcatttgcgtatattgaaccagacttgcatcccagggatgaagcccacttgatcatggtggataagctttttgatgtgctgctggattcggtttgccagtattttattgaggatttttgcatcaatgttcatcaaggatattggtctaaaattctctttcttggttgagtctctgcccggctttggtatcaggatgatgctggcctcatcaaatgagttagggaggattccctctttttctattgattggaatagtttcagaaggaatggtaccagttcctccttgtacctgtggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgggtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctggttcttttaattgtgatgttagggtatcaattttggatctttcctgctttctcttgtgggcatttagtgctataaatttccctctacacactgctttgaatgtgtcccagagattctggtatgttgtgtctttgttcttgttggtttcaaagaacatctttatttctgccttcatttcattatgtacccagtagtcatttttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactcaggatttgctttatgaatctgggtgcttctgtattgggtgcatatatatttaggatagttagctcttgttgttgaattgatccctttatcattatgtaatggccttctttgtctcttttgatctttgttggtttaaagtctgttttatcagagactaggattgcaacccctgcctttttttgttttccgtttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacaatttggcatgattttgcagtggctggtaccggttgttcctttccatatttagtgtttccttcaggagctcttttagggcaggcctggtagcaacaaaatctctcagcatttgcttgtctgtaaagtatcttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttcccttcgtgggtaacccgacctttctctctggctgcccttagcattttttccttcatttcaactttggtgaatctgataattatgtgtcttggagttgctcttctcgaggagtatctttgtggtgttctctgtatttcctgaatctgaatgttggcctgccttgttagattggggaagttctcctggataataacctgcagagtgtttccaacttggttccattctccccgtcactttcaggtacacccatcagacgtagatttggtcttttcacatagtcccatatttcttggaggctttgttcatttctttttattcttttttctctaaacttcccttctcgcttcatttcattcatttcatcttccatcactgataccctttcttccagttgattgcatcgactcctgaggcttttgtattcttcacgtagttctcgagccttggctttcagctccatcagctcctttatgcacttctctgtattggttattctagttatacattcgtctaaatttttttcaaagtttttaacttctttgcctttggtttgaatttcctcctgtagctcggagtagttcaatcgtctgaagccttcttctctcaactcgtcaaagtcattctccatccagctttgttccattgctggtgaggaactgcgttcctttggaggaggagaggcgctctgctttttaagagtttccagtttttctgctctgttttttccccatctttggggttttatctacttttggtgtttgatgatggtgatgtacagatgggtttttggtgtggacgtcctttctgtttgttagttttccttctaacagacaggaccctcagctgcaggtctgttggagtttgctagaggtccactccagaccctgtttgcctgggtgtcagcggcggtggctgcagaacagcagatttttgtgaaccgcgaatgctgctgtctgattgttcctctggaagttttgtctcagaggagtacccggccgtgtgaggtgtcagtctgcccctactgggggggtgcctcacagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctatctttttgtttgtctgtgccctgcccccagaggtggagcctacagaggcagccaggcctccttgagctgtggtgggctccacccatttcgagcttcccagctgcttaggttatactgcccaaggtaatttatagattcaatgccatccccatcaagctaccaatgactttcttcacagaattggaaaaaactactttaaagttcatatggaactaaaaaagagcccgcatcaccaagtcaatcctaagccaaaagaacaaagctggaggcatcacactacctgacttcaaactatactacaaggctacagtaaccaaaacaacatggtactggtaccaaaacagagatatagatcaatggaacagaacagagccctcagaaataacgccgcatgtctacaactgtctgatctttgacaaacctgacaaaaacaagcaatggggaaaggattccctatttaataaatggtgctgggaaacctggctagccatatgtagaaagctgaaactggatcccttccttacaccttatacaaaaattaattcaagatggattaaagacttaaacgttagacctaaagccataaaaactctagaagaaaacctaggcattaccattcaggacataggcatgggcaaggacttcatgtctaaaacaccaaaagtaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatttagaatctacaatgaagtctaacaaatttacaagaaaaaaacaaacaaccccatgaaaaagtgggcgaaggacatgaacagacacttctcagaagaagacatttgtgcagccaaaagacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaatagagacacttttgcactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactactcacaatagcaaagacttggaaccaacccaaatgtccaaccatgacagactggattaagaaaatgtggcacatatacaccatggaagagtatcacgactcatgtcttctttcccactgcccaatacacaagccctgcatgcacttgtacacttgcataaacataagagagcctaacgcacatatccctgactacctagcaggtattcagtgattaaccacagattacttcaaaagcctccacatgccaaaaataaccacgcttgaaactcttgtgccctaggattgttctccgatccaaaaaaacggagaataaaaataaactagtcatcctgtgtgccatgagcataaactctgagttggcccagtacagctcaagtccctgcaaactggttaaagaagtttcacaaagcaacatgtggaataactttagaatctgtgcagaagcgataatttggactcagggggaagataagttggcatgcaaaaggtttttttttttttttaaattattctcttttctctcagaaaagtaaaatgcttcttgtctttgtgaaaagtatctcaagttgacacagaaattctttagagcacttctactgtaaaaataaagacagtgctttgtcttctatagatagtgaaatgatagcaaccaattttctcattttccttgtggtcagtgaataatataacattagcaattctcaggtagacaaaaggaagatgaatttaaagtgtgcttgaaataattgataaattgatggcatctcctactatgtgtgatctgcatgcaatggaagctctcaaatgactagaggtgaccatgcaggaagacatagcaaaagcctcattccatgcagggcctactcgtcgggctgctgtgaaacaacagtgctttggtatttctagaatcaagttcctgtggataatccagggccccatgcagccaagcatgtgtagcaaactccacactgcaacaaagatcaggttcagggggagctacacagatgacatgtcattcttgtcccataaacgtacacgcttttttagaaggcaaaaattgatgtggatgagatttccatgatcatggcagtggtcctcggacctcagcatacataagaatggccaatacaggttgcttaaatccatgttcctaggccatacatccagaaactctgattcaggaagtctagtatggggcccaagaacctacttctaacaagcttctaggtgctgctgatgctacaggcccatgggccacactttgagtaacactagtttataggatttagaggggaagttgagaggatagcaaggccagagcctgatcatatcagggcatggtttaattattcactgaatatatgagagcttacaatatgccagatgctattttaggtatgacggatacaatcagaacaagacaaacaagatagctgttatcagggagctgacattcaaaagggaattgtcagacaataaataaaccgatacattcaagatggtttccaggagcagtcacctctgcaggaaggaaaatagggaaagaggactgagagtgactgggtggctactttcgatagggtggtggtctggaaaggcctctctgagaagatcacatgtgggctgagttgcccaaagatctggagcatgagaattccaggcaagagtaatgactggcacaaaggtggttaatgatgtctttggggtaactggcttcctcactaaaacaacaaaggtattagccagcttctaagcaggtcttagaaaccttgtgttcaactgcaggaagatggtaatagccctgccagcatctgaatgtggatatacatttgctacataaatgggaaagttaagaaatctctctggtgatagggcataggacttaggtttttgttgaatggcatatttctacctgtcacttatctcttaaattatatcagaaactattttaaaataagatgatattcatatgccacaaaacctagcatataaccactcaaatgaactgttgggatctgcccaaagcactgggttgaggattctacagctgcgacacaggatagtgaaaagacatatacaagagattattcccagggccatatctgaagaccccggtatatacagaataattccattcttgaaagacaaaaattaagtacacaaaaagtttgctggaatactatcaattgttttctttagaaagcatgatgatcttattttcattttgatctttactatgtattttctaaattttatgctatgaaaatgttttctttgaataatgaaaagtttaaaatcagtgcctctcccttccccaccaccaaaatttagttctttattagatcacagcaatccctgagactgtccattaaccaaaatgacaataaagaattaaaccctaaaaagcaagactcactacaaaagttagtgttgcgaggtcagggccatcacttgagaaaacagtcaattcacacatcattccatttcaaatgcactcattcactcagcaaacatttattaataagtcgtttattttaaattccaactaataaagcacataattaaagaggtaaatggcctcattataaatgtcctcattgctctttcttttttaccaactttatttttagcagcaaaagtggttcttaaggatgtgaggtctttaggtggctgaaaaatgggtcattctattaattaagaacagggaaagtgggaaggacctgttttagtcctatttcattaagatggctaattactgtgtgaaattgatctccatgtctgtgctaagaatgagatcctggacttgggaacaatccatttaagataatgacttaccagccttggggcttcaaagtaaaggggagcagcaatatggtttttatgagagggagactttttggtacaaagggcattttaaagataattgtaactcatgttaaacgaaatcattatagagaatgccacaacagaacagaggtctcaatttcccgtccgttgctcttgccactaacactagaccaactccttttgctcttcatcttggtaggatggtgaggatttccttaatgttgtaggctgagctaaagacccagagggattaatctaacaacatcaacaacaatgagtatttcttgagtacttactatgtgaactgtattactacgtattaattcacttaatcctctcagcaatcctatgagataggcatcattagtatctgcactgtatacatgaggaaaaattgaggcacacagatgttaatagtgtgcctaaggtcacatggtttataaatggtggatccaaggttctagcctattcaatctgattccaaagtctgcacccttaaccagatgacatgttgcctcatagtttttctttctgtgcccccatctccttattgaagctatactttggatagattttcaaaaaattatgaatgatcatcagaatttactttagccaggcaggccgggcatggtggctcatgtctgttatctcagcactttgggaggccaaggcgggaggatcacttaaggtcaggagttcgagaccagcctggccaatttggtgaaaccccatctctacacaaaaattagctgggcgtggtggcacaagcctgtaatcccggctactcaggaagctgaggcaggagaaatgcttgaacctgggaggcggacattgcagtgagcctagatcatgtcactgcactccagcctgggtcacagagtaagattctgtctcaaaaaaaagaatttactttagccaggcaaactggtgttggcccatgatcaaaaataagtcatcatctaaaaaagaaaattttttaaaaaatgaattataacattattctttctttttattgatttttttccttttattgattttcacctatgccatgaacattgcttttgcctgtctagttgggagtttattagttggttccttcttcaaaagagaagaggggaaataatctaattataataaagatgatgctgataggagcaactaacttttactgagcctttaccataagctaagcactgtaccaagaacttatatatgttggttcatttactcctcatcagaaccttataatgggtacaattatattatgttacaaatgtaaaaactgaggcttagaaagattaagtaatttgcccaaggtcacatacctggcaagaaacagatatagaactccaatccagatgtaattccctaatccacatctcaataatttagtaaaagctgttactcttcatctactggaaaggctaagcactctgaaaataattcacaaccgacactatgctattttcctaaccttacagatataaccagactgatgataaagaccaacctaataaacaattcatttgaccaagatcctggaagtgccatttttctatggaaaatcctgtggatcccactcagttctgtcaatctgctattctcctcttctaaaatgttatccccatcacatggaacctgactaaattaaaacaaatccttcaagtaagctaagaaaagataaaaatgcataatatagactttaaatcaaccactaagattataaaacatagagttacaactaataagcataaggagagaaaatggggtgataaaaagtatgtaatcgaaaagaagacaaacagagaacaacaacaggtgagacaaagagaaaaaaaatcaagatggcacatttcaacccaaccatattaaaaaccacattaaaaataaatggtctaaacacccaatgaaaggcagagattatgccaataaatacaataactcaaatgaaatggacaaattccttaaaagatacaaactactagaatgtactcaagaagaagcagataagctgtatagtcctacatctatttaaaaaattaggcctacagtaaaagaaaaaaaaaatgggcatactggctcacacctgtagtcccagccactcaggaggctgaggcaggacaattgcttgagttcagaaattcgaccctgtctctaaattaattaattaatagttaaaactctcggcccaaatgcattcaccaaggaatcctatcaaacatttcaataataacactaattctacataaactcttgcaaaaaaatttaaaataagttaatatttaacaactcaatctatgaagtcagcaataccctgaaaccaaaatcagataaagacattacaagaaaacacagaataaactagattcaaaaatactcataatttttgcaaatcaaatccaaaaatgtataaaaaagataatacatcatgactaagtggaatgatacatatcccaggaatgcaaggatagcttaatatttgaaaatcaatgtaattcaccatatgaacagatagaaaaagcaaaatcatattatcatctcaatagatgcagaaaaagctcccagcaaaatctacatccattgctgataaaaaactctaaaaaattagcaatggaaaaaaactttctcaagctgtaaagggcatgcatctatgaaaaagctattgctaatacatatccaattttgaaaaactgaatgtttattccctaagatcaagaatgaggtatgaaggtctactcttaccattcctattcaaccctatactgaaggttctagccaatgacatacagcaagaaaaagttataaaagggatctagattaaaaaggaagaactgtcgatattcacagatcatatgatcagctatgtagaaaatatgatacaatttacaaaaacattactagaactaataaatgagttttgcaaggttgcaagactcaagatgaacataaaaaatcagtaccatgtaagtgtacttaataaagtatgtaggagtttaaaagatatttttaaagaatctactgggaagcttataaaaatgtagattacaaataagctaaaagttataaaacatgaaagtagatacattcatacgcatggaattaggacagttaatgtcctttacttgcttaaaatgttttttacaagcttctgttaccccatttattcttgatgaaaaatcttctggtcctcaattacttagaaagtaaatggattctgaatttagaaaagtgccatatgccagagacataactggtgacaattaggattttgagatactactgtacaaagagagattcacctgttttccatggaagtctggtttcctggcaagaagatccaggtacatttgtagcaataacttcaaatagagaagcaatctgggattaaagactctgatgtatacgtgaacatgtaaatatattgggaagacctgggacaatgcttttaatttaaaattaaaactaggattttaggccgggcacagtggctgatgcctgtaatcccaacactttgggaagcaaaggcaggaagaatttcctgagcccaaatgttcaagaccagcctaggcaacatggcaagaccccatctctaaaaaaaatttaaaaattagccaagttacttaggaggctgagatgggaggatcgcttgagcccaggaggtcggggctgtagtgagctgtgattgtgccactgcacctcagtctgggtgaagagtgagactctgtctcaaaaaaaaaaaaaaaaaaaaaaaaagatttcatgaaaataaattggtctacatcttattaccaatgtaggtctaaagcatcaattgagctctgctctatgaacttcaacctgaatcactggattaaaaattctaagaaatacagaagatacacatacatacaaactcacatatatacataaaatctagagagatttgctttaggctagtgattcccgaacttggctgtatgttttcatcacctggagagctttaaaaaatgcaatgcccagctcacactgaagaaaaatcaaatcagaatgggggtgagtgaggagccagacatcagtattttatatagatcccagatgattacaatgtggaataaagtttgagaaccactgtttaagacaaaatttgataatgccatcattatcaaattagtaacttaatttggagccattataggtggttttaagtctctaaccacctggactgaataaattcctaggggaagctttgaggcaataacaatctgcaaaatgccatctctgcacagggatagaaagctggagttcaggagacgtgaaaaatatatgactcaaagaaaaaagggaagggatggtattctatttccaaattccttataaaggttatttaggaaacaccaagtcactctaactgatgaagaaagccagctcagacactaaaatcatagcccaaagagaagaaacactctctgggaatgatgcttatttcacaaggcacactttgtacctagaacacgggatgcttccatttcagtatatcacaatctgccctccatacataactctcacctgaatctcaacagaaaatccagaaatgtacaggattctcaaataaattaagggtgtgctttcagacttacatgctggaaaagttatatacacccacccctgtgcagttcgtgggacaacaaaggtctctcaaaggggcaagattcaatagatgaaatttggttgacaataggtcattcacaacctttgttacttgtgttacttttctccatgcttgtaaccaaatttgagatgactgtcctcctttttttctggtttcagtggggttaggtaggcatttgcagaagtgaatgagacatttggggctatcatttacaatggatccataaaactgctatcagaacaagaacggcaaaacagtttagtgacatgacttaccctatggcacatgtaggatccacctttcttcactcggtctttcccagaagggggacctttctacagatgaagaaaaaaggctatgttagaccagaaggcaaagctgccccttacacagtgggagagaatccactttgatccaaccagctctctcatggttgcctaaactctccacatgcatttccacccctaggctttgtatctgtattcgtgggctctcccaaatgctcacctccccaaatcctacccatcttctaaggcccacctcaagtttccactctttggtgaagtcttcgtaactacaggaagcaatcctgtctctaagtccctacagcatttcttgcctagatgactaataagctgcttggctgcacctcttaccatgtcatgatgcaaatttatcctgtgttataactggtttactcatctacactggcaagcctctttgaattgcatggtattttttgaaacaaaaatttttcttgagacagggtctccttctgtcacccaggctggagtgcagtgctgtgatcatagctcactacagccttgaccacctgggctcaagcaatcctccctcctcagcctcccaagtagctagaaccacaggcatgaaccaccatgcccagctaatttttaaaaattattatttgtagagacagggtctcgctatattgcccaggctggtcttgaactactgagctcaagtgaccctcctacctcagcctcccaaagtgctgggattacaggcatgcaacaccatgccaagccagaattatatgtttttataatcccgctgtgtaatacttaataaatagtttgctgattgaatgaaagagtttgcttgttagccttaaaaaaatttaggtgtgctttattaagatataattaatatacagtaaaattcatcctttttaagtgcacagttccagtgagttttgacaaacatatatagtcatgtaaccgctaccacaatcaagacatacaacatggtttatcttgaagaaaaaaaaaaagacacatatacgtactatgaaccaggcacagtttgagcactttacaaatattaactcaggtattctccatccaaccttggaggtaggttaagttactggtaaaataagtggcacagtcaggcagccttgctccagagtccatgctctgaggcactccactgcgctcccacttagagacaagaagtgtaggaaattaggcaatgcttaaaaggaggcaaggaagagcagcgtctaccactgtaataagaattaacatctacacagagccagtataatggcaagacttttttctaggaagggcttcagataaaagttcaaaggaaatgaaaatcctaaagcatcagttgccaagataaaagcctcaacatcaggtaaggcatacacagcatctgagaggtaccaataaataggctctaataagccagaaccgtatcaggggagtctatggggaaagggatttatctcctttttttgttcaaaaagacaattaatcacacacctgtctactatttgctccaaaaacgcaagaggccgggacaaccccactcctatcttagtttttccttctcctgtgacccaaaagcacccttacttaagtggcagaaattaaaagaatcacgttttctccaagcatggctaatgtactttcttgcaaatgtaaaccatgtgggcagaagtgcacattaccttctaagcatttccaggtacagatgctccttagcatgggattaggtcctgtcctgataaatccatcataagttgaaaatattattaagtcaaaaatgcatttaatactcctaacctacccaacatcacagcttagcctagcctaccttaaacatgttcagaacactcatgttagtctgtagttgggcaaatcatctaagaacacaaagcctattttataataaattgtggaatatatcatgtaaattgctgaatactgaactgaaagtggaaaacagaatggttgtatggatacttaaaccacagtttctaccaaaggcatatcacttttgcacaattgtaaactcaaaaaaaatcttaagtcaaaccattgtaagtaggggactgtctgtgcttagaaactatcacagacaaagccattggctattcctccttcaactgcagggctacaatatttccaaggccttaaatgcttaatgtcacattaataaacttttgttaattacaaacaggcacactgcaaacgtgaaaagctacgtgtcaaaataatggctggcagcagttttcttcccaggaatatctagaatctgacaaacactctgagtcagtttattactctataagacaattaccaagaattcactgtagcagcaatgaaagcatttataattgtggaactctcccatgtaatggccacactctcctacactgtttctcgcttaacaattcttgcattacactgctttaggtggttctctgcatgctctgttacaatgtatcaaattgtgattcaagtctctcccagtatctgctagcgtgcaatttagactcctcaagtagatctaggaacaagaaggagttgatttgccaatgggaaggcatgggaacaaaatagttgcctttcatcatcaacttcaatgaactaagtctgcaatcaataactacgacacttatcacagtgacgcaagtagtaatgacagtcatcccaggctgacacaactgtggcacctaacacagtcctcaatttaggtgactgctcagctgcttcttataaataaaactatttttgctagcaaacaacatgataattaactaaaactgtttgaaatgcttgccactttgccaaaaaacagaaaaattactaggagggtgtagtgggttgaagagtgttcccaaaattaatgctcattcacagccctagtgtctgacctgattcggaaataggaactttgcagacttgtaatttttgtaattaatataagatcatattggattagggcgggccctaaatccaatgactggtgtccttataagatgaggagaggatgcacagaggaacacagagaagtctatgtggtgatggaggcagggactggagtgaggcggctacaagccaaggaatgagaaggattcctggaagtcaccaggaaggatcttcccttagagactccagatggggtgtggcacagccagcaccttgatttcagactgctagcctccagaactgtgagaggataaatttctgttgtttcaagacactaagagtgggaggctgaggccaagagatggtcaagagatggaggtcaagagatcaaggtcaagagatggagcccaccctggccaatatggtgaaaccccatctcagctaaaaatacaaaaattaactggtcgtggtggcacacacctatagtcccagctacttgggaggctgaggcaggagaatcacttgaatccgcgaggcggaggttgcagtgagccgagatcgtgccaccgcactccagcctggcaacagagcgagcctccatctcaaaaaaaaaaaaaaaaaaaaaaaaagatactaagtgtggtaatttgctatgcagccctagcagattaatccagagagttggggaagaggggtatctccattcccatttgtgaaagaaaacattaataaatcaaaattaacagtgtctctcatgatcaagtttatgactgcaggctaaaacaacttaagtggctattggtggtggtgtttaaacacctcatctgtttgcctgtataccacagcaggaagagcggctgcagggccctaccacctccacctcctgtgctcaagagtcttggggatgcataagaatccacttggaattaacctagatatccatcagcagtggactggataaagaaaacgtggtacatatacaccatggaatactacacagccataaaaaagaatgactcatgtcctttgcagcaacatgaatggtgctgcaggccattattatcctatgtgaattaacgcaggaacagaaaaccaaataccgcatgttctcacttataaatgggagctaaacattggatatacatggagacaaagaagagaacaatagacactgggacctatttgggcaaggtggagggtgagagaaggatgcggactgaaaaactacatactgaatattatgctgattacctgggtgacaaaattatctacaccaaacccccacggcccacaatttacccatgtaacaaacctgcacatccatcctttgcacttaaaatgaaagttggaaagaaaaacaaagtctcagtggaaaaacatatggaacatagggactccgcctacaaccaggcaggaaccatcgtgaatcctgtctccaaaggtactactgcccgtaactgctctagtcccatagacacgaaaatatcaacatgtctccaatgcttgcatggtcgcaagaacagcaaaacacacaggtttctacataacagtcccaataatctcaaaaggccaaggtacagctaaagttctcgggaaaagtgatgaagaagcaacactcagcattagtgcagagaaatctacccctgtttaaaacacctgggagggcatgtaagtctttaaggatgagttgaatccactggagatgccacagaaccacgtatcagtgagactggcttgtttggaggaggaatgagtctgtaaggaagaggggtagccagcctgctcacggctaccaggacatttttcacagcacaacgactgcactctgtgtagtcaagagacatttccctttccctcgtcatgcccaatacattgacaaggaaagcaacagaagggatggagagtgtgacaaatttccatcactcagcaaacagtcaaaaggcaccactagcgacctggatgggactagagactattattctaagtgtagtaactcaggaatggaaaaccaaacatcatatgttctcactcataagtgggagctaagctacgaggatgcaaaggcataagaatgacacaatggactttggggactcggggaaagggtgggaagggggtgacggataaaaggctacaaatcgggtgcagtgtgcactgctcgggtgggggtgcaccaaaatctcacagatcaccactaaagaacttacccatgtaaccaaacaccacctgttccccaataaccaacggaaattaaaaaaattaaaacaaataataaacatgtcatttgacacaatccatagtaatgaaatgctaagcacccactacaaagaatgaggcacttctgtatgtgtacactttactatcactttttactaagaaaataacagcatcaagcatttattctgacttcctcacacaaactatgcctcaggaaaatagaagagttatgagtgaatgttctttatagaggaattccagataattaatgcagaaagagtaatagaatatcactatgtcaaaaatcttggccaggtgcaatggctcatgcctgtaatcccagcactttgggaggccagtatgggaagattgcttgagcccaggagttcaagaccggccttgggcaacatggtgaaacctcatctctacaaaaaatacaaaaattagccgggcgtggtggggcacgcctgtagtctcagctactcaagaggccgaggcaggagaaccatttgagcttgggaggcaaaggttgcagtgagcagtgactgcgccacagcactacagcctagacaacaggaatgagaaactctgtctcaggaaaacaaacaaacaaacaaaaaaaccttcctcaagaactgaatctaggcaatgagtatcaatggctgctaaaatcagtgagtgaaaggctaatgaagatcctcgtaacggatggttcagactgacaatgcctacttaaatactgatcaatcttattaacaaaaataatcttatcggtgtcacgataaaagccatgcatactatgcctcctgatatgatataaagaatatacacagccctatgaagtatttttaattactcttatacatacacacacacatacatgcacacacacacacacacacatcctacctaaagcctaaatataatcaagactttaaatctaaacaaagattgtaggaaatacaaggggtagaagaatatactaaaatgattccacgaagatgcaatgaacaaaacccaggccatgggaaattcttttaaaaatagatcatttgtggtgattcctcaatgatctagaaccagaaataccatttgacccagcaatcccattattgggtatgtacccaaaggattataaatcattctgctataaagacacatgcacacatatgtttattgtggcactgctcatgatagcaaagacttggaaccaacccaaacgcccaccaatgatggactggataaagaaaatgtggcacatatacaccatgggatactacgtagccataaaaaaggatgagctcatgtcctttgcagggacatggatgaagctggaaaccatcattctcaacaaactaacaatagaacagaaaaccaaacaccgcatgttctcactcacaggagggagttgaacaatgagaacacatggacacagggaggggaacatcacacactggggcctgtcagggggtcagagactaggggagggatagcattaggagaaatacctaatgtaggtgacgggttgatgggtgcagcacaccaccatggcacgtgtatacctaagtaacaaacctgcacattctgcacgtgtaccccagaacttaaaaagtataataaaaagaaaaaaaaaaagagatcagggccgggcgcagtggctcatgcctataatcccagcactttgggaggccaaggcagacggatcactggaggtcaggagctcaagaccatcctggccaacatggtgaaaccttgtctctattaaaaatacaaaaattagccagtcgtggtggtacacacctataattccagcttttagggatgctgaggcaggagaattgcttgaacccgggaggcggaggctgcagtgagccaagattgtgccactgcactccagcctgggcgacagagcaagattccaactcaaaaataaataaataaataaaaataaaaagagatcagacatcttttcaacaaataaatagcaagggaggaaaaagagagaagttataaattgagaggcttaaaatatcctctggtcgtggtggtggcacggggcaattctatatgccttgtggcagtttttgtcctggattatcttttgaaggatgtttgtgtaaccaacagtctcagaagatgacagaaggcaggtttgtttcctggccagaacaataatgtcaaaggttgggtatgtttattataaacctctttataagactggagtctcctaagctcaggattctccggctgtgacaaagacctactgtgtcatccttatgggatttgggagacaaggggaagcgatgtgaacatgaagtgcatgttgcctgctgtgctgtgactagaaaaatctgtaactctgacacagaaacttcatgtcttctgccagcatccatgacactgtagtggcctaactcatgagcttgcaaacagaataaaatttcagactcttcatagtcttgacaaagacatatcaacaaacaaaatgcatagtattactgtcatacatattacagttatatatgtgaaaaacttaacaacacagtgtgaccattattgctttaaacaatcttacgtttttaaaaggaatgaagtgaaaaaataaatgcagtcttttctacttacctatttaccatatttcctgcttgtcagttctgcctgtgtatctatctgaggtatcagctagttccagtccctttcagtctagaaaaactgcttagtatttcttagtatggcagatctgctagcagattcactgtctttgttaatctacaatgactttatttctccttcattttaaaatattaaacctttattatgggtaaccgttgattcacatgaagctgtaaaaggtaacagaggaattggtgtactctatatccagttttccccaatggcaacatcttccaaaactctgtactgtatctcaaccaggatgttgacactgacacagtcaagacacagaacatttccatcacaaggatcccttacgttgcccttttatagttacgaccacttccttcccaaccccaaccccttcttaacccctggaaaacactaaccccttcccactcctataattttgtcatttcaagaatgttatattaatataagtggaatcatacagtatgtaaacttttggaactggctttttttccactcagcataattctccggagattcatccaggttgctctgcataccaacaatctatcccttattactattgagtagtattccatggtgtggatgtatcggtttgtttaaatattcacccactgaaggacatttcggctgtttctagtttttttggctattacgaataaagatgctatgtacaggtttttgtatgaacataagttttcatccctttggaatcaatgccaaaggagggaatatagtggtcgaatgtttacttcattttcttttttcttttttctttttttttttgagagggtctctcgctctgtcgcccaggctggagcgcagtggagtaagcttgggtcattccaacctccacctcccaggttcaagcgattctcctgcctcagccacccgagtagctgggattacaggcacgcaccaccaggcccagctaatttctgtatttttagcacagacagggtttcaccatgttagccaggctggtctcgaactcctgacctcatgagatcagcctgcctttgcctcccaaagtgctaggattacaggagtgagccgctgtgcccagctgaatgtttaggttttaaagaaaacgtcaaattgttttccagaatggctgtactctgtcacacaaccaccagcaatggataaatgatccagtttctctgtatcctagccagtcactactttttaattttagccattctgatacgtgtgtagttgtatctccttatggttttaatttgtatttctccagtgctaatgacgttgagcatcttttcatgtgcttccatgccatctgtgtatcttcttctgtggtgtctcttcatgtcttctgcacgtgttctaattggattgttcggttttttactgctgagtgttgagttttttatgtattgtaaatatatgtggcttttgtcagatatatgggttgcgaatattttctcccactctgtagcctgcctttatatcctcttaacaggctctttcacagaaaagaagttctagtttttataaagtccagtttatttatttttccatatgtgggtgatcatgctttttggtgtcaagtctctacactctttgcctaggcctagatctcagattttctcctgtgtttttttctaaaggttttagagttttgcagtttaaattttaactctgtgattcatttggagtcaatttttatgtaaggtgtgagactaaggtagaggttcattttctgcccacggatgtccaattgttccagcaccatatgttgaaaagcctttctttccttcattaaattgctttggcaactttgtcaaaaatcagttgggcatcatatatgtgtgggcctatttctggattctctattttgttccactgatctataagcatatccctccaccaatatcaaacagtcttgattactgtagctaagtagtaagtcttcaaattgggtagattggttcctctcacattattatttttcaaaattgttttagcaattctagttcctttgcctttccatatatatttcagaataatcatgtcaatatctacaaaaaatcttgctgggattttgataggaattacattaaacaattgggggaagaactgatatctctactaggctgaattttccaattcatgagcattgtctcttcatttattcagatatttctttcattagtgttgcatagcttttagcacacatgtactaaacacattttattagatttacacataaacatttcatttggttttggtgactgtaaatgtattgtattttaaatttcaatgtccatgtgtttgttgttagtcttacaaaaataaacatgttcatcttgtgtcttataaactttataaactgaaatattagttttaagaagattttggtagattccttgggactttctctatgtaaacaaacactcatatatctgcaaatagggactgttttatttcttccttgctgatctgtatacctcttatttccatttcttaccttattctactggctagaaatcccagcactatgttgaataagagttctggaaacagacatagttacctttttcccaatattagtgggaaagcacttggtcttttaccattaagtataatggtaggtatacagtttctttgtagatgctctttactaagtttgagaaaatctttgtattcctattttcctgagaatttttgttataaatgagtgttgaagtttgttaaatgcttcttctgcactgatataatcatgtggtttttttttttcttcttttgcttcttattatggtagattacactgactgatttttaaatatttaaccagactgcactcctggaataaacctcaattatcatgttttaaaaaatacactgatgaattctatttgctaacattttgttaaggatttttgtgtctctatttatgagggatgttcacctgtagtaaccttctatttttttactgcttttggtttggggatcaaggcaatactagcttcgtaaaatgattagaaagtgttcccttcttttcattttctaaaacaaattgtgtagaattggtgttgattcttctttaaatgtctagtaaaattcttcaatgaatccatttgggcctggagatttgttttttgagaagttttaaaatttctaattctacttccttaatagttataggactattcaaattatctatttcatattgggtaaactgtggtatttggagttttttgaggaagtgttgtttctcgcctaagttgtcacatttatgggtatacagatgttcacagtattccctcattatccttttgatgtctacagagtttgcactgatatcttgtttcatttctcatattagtaatctgggtattctctttttgctttgtcagacttgctagaggtttgtcaattttataaatcttttcaaagacccagttcttcatttaactgatttttctctgtttttctgttgtctatttcattgatttctgtttttattatttccttacttttgcttgctttgggtttagttttctcctttttcttctgggtcaagctgaaacatattgattttagactttttctcttttctaatgcacacatgcagttctgcaaatttccctcttagcactgttttcactctatcccacaaattttgatatgtttcattttcattcagttcagtgcactgtttgattcaccttgggacttcccctgtgacctaaggattatttagaagcgtgtttcatagtttccatgtgtttggagattttcctattatatttctgttactgatttctagtttgattctattgtggttggagaacacattctgtatgtcttcaatttttaaaaatttgttgaggttcatctgatggcacaggatatggtctaacttggtatatgttccatgcataactgaaaaggggtattctgcagttatagggtagacagtgctagaaatctctatcagatcctttggttgatggtattgttgagttcttctatatccttgctgaacttctgtctaattgtactatcaattattgagaaaggagtggtaaggtccccaactaaaattgtggattagtctacttctcctttcaattttattactttttgcttcacatgtttcagctccattctctggggcatacacagtattactatgtcctcttgaaggattaaccattttatcattatatacgttcttcctcaactctggtaaatttctttgctttgaagtctgctttacatgatatgaatatagccactctgactttcctttgattaatgtttacataatatatattttcccatcattttgttgtcaacttgcttatatatcataatatttgaagtttcttgtacacagcatataattaggttgtttttttaatctactatgccaatctgtctttttaactgatatatttaagcaatgtacttttaatataattattggtatgtcaaagacttaagtctgtcattttattttttgttttctgtctgttctctatttttttgtctctgttttcctttttctgacttcctgtgggttacccaaacttttaaaaaagaattccatttttatgtaactattgtgcttttgagcatacctctttgtgtagcttttttagtggctgctaaaaggtgtatgcatattcataaacatatcactctacttgtgtgtgtacatatagtcataaatgtatcagtctactcatgtcattttaacagttccagtgaagcatcaaaaccgtaactctctttaaatccctttagcttctcttgtgtataatataatcatattaaatatttcctttaaatacatttagaaccatatcagacaatgttataatttgtttcaactgtcaaataaaatttagaaaactccacagaggaaggaaagcctattgtatatactcatatttgggcttaccatgttcttccttccagtccgatattcaaaagttccttctttaatcattttctttctgtttaagaacattcctttagccatccttttaggataggctggctagcaacaaattctctcagtctgcctttatctgagaatatcttgatttctccttattccaaaaagatacttcactggataaggattctgggttaacaatacttttctttcagcacttaaaaaacatcatgccatttcctctggccttcatggtcaccaatgggaaatccattgtcattcaaattgttttttttttttttccctataggtaaggtgtcattttttctggctgcttttaaaagttttgtctttagtgttcagaagtttaattataacggtgtcttcttgtagatttcttcagaattaccctcattggggtttgcttagctccttgaatctgtgggtttaagtctcttaccaaactggaggtgctttcagccattattttgtgaaggactcttctcatgctgtcttctttgttttctcctctgggattctcaatacgtaaatgtgagaacttttgttataatcacgtagatccttgtggctctcaacatttcttcatttactgttttctttccactgctcagactgggtaatttcttttgttctagttgacagttcactgatttttcccccctctgtgccctccattctgctgttgagcccatacactgagctttttagtttgatttttcaattttcagttctaaaatttgcatttggttcttcttatattttctatttctttgctgaagctttcaattttttcatttgtttcaagtgcgatcatagttgctcactgatttcttttttctcccatggtttctttaaaatctttgctgggtaagtctaacatctctgtcatctcagtgtgggcatctgctatctacttaaattcactttgatatcttcctggttcttgggatggcaagtgacttttcaacttaaacgtggacatgttcttattatgttaaaagactctggatcttattaacaccctgttttagctgtctttctctgataccaccctggcaggggaagagagaaggtgtgatcctgttactgccaggcagaatcagaagttcaggttccttgctcagcctctattaacgattcagaagggacccctcattactactagatgtgggtaggagttttggctccccacctggttgtatacagcaaggtaggggtaaccactttactaatagacaataagaaagacctggctaggccttctctggcacctaaatacagctgcatgagggtacaagcctagactccccactcagcctttgctggacagttttttctttggtgtttagaaagagtagagtggttactgtctaaaagctttctgtattgttagactgcccatttcctacttgctcctttggctagagagaacaggcttttgttgagacttcctttgtctacacctgttagcatttctgggttgcttgcttccctagctccaagtcagggatatatgcagcaaaaaggaaataaaagagacagggtctcactctgtcacccaggctggagtacagtggcacgatcttggctcactgcagcctcaacttcctgggcccaggggatctttccacctaagcctcctgagtatctgggactacaagcacataccatgatacctggctaatttttgtattttttatagagaccaggttttgtcatgttgcctaggctggtcttgaactcctgggctcaccataatgtcatttctaggactctgaggtcttcagccactctgctttaactttccatggtctgcttataattcttttatgtgcagtgtccagagttttagttgtatttagtaagaggaatagaaaaatgtacatctactccatctctccatctttctagaaccaggagtcaaacctccttcaccttcatttttgaaggattgttctcctggatatagaattcttagttgacaggtttgtttgttttcctttctactctttgattatgtcacaccatcatcctctggtctccactgtttctgatcagaaatcagctattaatcacattattgttgccctgtatgtgatgaactgttttcctcttgttattttcaagattttgtctttcaacagtgtcaatatgatttgtccaggtgtggttttttgtttttgtttttgtttttgtttttgcagtttatcctaattgaggttcactgagcttcttggatttatagataatcttcatcaaatttgggaaattttcagatttttctttcaaatttttgtcccttttgctcctctccatttgagattccctttacacatgtgttaaaattatgttggaacacatgatgttgttgcacagggctgtcttgatttttctctgaaattttttctgctttttaaatttttatgtatttattttgagacagggtctcactctgtcacccaggctggagtgtattgccatgatctggctcactgcagccttgacttcgtgggcccaggagatctttccacctaagcttcctgagtagctgggattacaggtgcataccatgatacctgactaatttttgtaatttttgtggatatagggttttgccatgttgcccaggctggtctcgaactcctgggctccagtgatctacctgccacagcctccaaaagtattgggattacaggcatgggccaccatgcccagccctctctgctcattggtttggataattcctttttcttttcttttcttttcttttttttttttttgagatagagtcttgctctgtcacacaggctggagtgcattggtgcaatcttggttcaccacagcctcaacctccctaggttcaggtgatcctgccacctcagcgtcccaagtagttaggactacagatgtgcaccaccatacctggctaattttttatttcttgtagagacatggtttctccatgttaccagggttggtctcaaactcccaggctcaagcgatccactcgcctcagcctcccaaagtgctaggattataggtgtgagccactgcacctgtcctggatactttctcttgatctaccttcaggatcactgaatctttcttctaccatttcttatctgctcttgtgttcaactagggaatttttcatttcagttagtagtatacttttcaattctagaaattctacttggttctttttttaaaatttctatttgattctctatttgttgactcacagttggcgtattttatagcaactattcaaatatactttagttctttaaatataatcataatagctatttttaagtctttgttaaatctagcatctgggcctacttgggagttagttttaacttaaatactcatcttctttagtatgggtcacactttcttgttagtctgcatgtttattacattttagctgaaaactagacatttaagattatacataatatgcataatttaagattacatatataatcttaaataatcttaaatgtttatatgttcagatatatatgtgtgtgtgtgtgtgtgtgtgtatatatatatatatatatatatatctacctatatatataaagagagaaagagagcgagagagagagcacatgtatatgtaacagcaactcttgattaccctattttcctgaaggtttttgttctgttttgttttgttttgttttggtaacttacctgaatataaactgtagaatctcattccccatggtctgtacccactgatgtctctgttcagattttttttttcaattccattgaggtcatatttgtgttgcatacttgaacagctgaccaataatttagacagaggctatctcagatactttgaacccactgggctttcacctttcatgaaccaaggtgtatggattgagaaatggcattcaaagtggcagtcatctcaagtctccctggctttcactttttgctgggctctcttgggtcttccctgcttatgtttagtttcccagaaagcctagaaaagcttatttcacacctttaatgtctctgttacttgcgcgatctccctgttaaatttctggctggtctaccacccatcacaactgctaccgtgggctagtcatgctgcaggatttcccaaaatattctaacgtgagtctgcttttttagctgacaaagccacaggctttcagtgcccccatcctccaccctgaatcaagtcaatctttggctgtaaggctttggttttcgccaccagtcctgaactgacagttacatttttattttagttttagagacagggtctccctgtgtcacccaggccacaatgcagtggtgcaatcatagctcaccatagcctcgacctcctggggtcaagtgatcctcccatctcagcctcctgaatagctgggactacaggcatatgccaccacactcgcctaatattttatttttttatagagacaacatctcactatattgaccaggctggtcttgaaatcctggcctcaagagatcatcccacctcagtctcccaaagcactggtattacagaagtgagccaccatgactggccttttatttatttatttatttattattattattatttttaataatagagtgtggcagaaagaggatatggaatcagttccaagcaagaacgccacatattctcacccattcttggccaaagctatagaagtttctcaagaatcaacacttctcaatttatcacctccctttggtggattttcagtttccagtggttgggtgtgtgttttttctttacaattttgttcagttttgtacttgttttctgtattagtgaatcacttgacctcttacattgcaattaccaaaataagaactcaaccaaatgtaattaggatcacaacaagaatggaatttcttaggatcctgattctcaacaagccaattacagaaaaatgttcatgagataattaaggacatgtaaatgctgactgagtatttgataatattaaggaattatttttaggttttttttgagatttgataataccattatagttttgtttttattattatttttttaaaagagtgtttagcttttacagtcacatactgaagtgctttttttgtgtgttttgagacagggtcttactctgttacccagggtagagtgcagtggcgtgatcatgactcactgcagcctcaatttcctggactcaagcaatcctaccacctcagcttcctgagtagctgggaccacagacacatgcaccattttaaatttttgggtaaagacggtgtttcactatgttgcccaggctggtctcaaagtcctgggctcaagtgatctgcccatctcgctctcccaaagtgttgggattataggcatgagccacagcacccagccacatactgaagttttctagggaaaaaagtacatagtatttggggttggttttaaagtaattcaaaggtgttagattaaactagattggataactgttaatgtcccagctttgtaatgtgtcaccttggctagactgaacctcatttcccagaattctcttccctttatgtttctcgttaggatgtgctacagaagacatttactaagcaacctagaagacagaagagtagcaatagccatagtgtttttattctcagaagactgatacaagggatccaggcaaggctgcagctgtttctcactgaccctatatcctcctttagtttctctgggtcctgggcaggtctgtatttagctctgtgatgaagagcactagcttctcctgtatgaaatccacatcatcaaagtatttttatcatcagagacacagcctctgcacatcttcctcctaaaagaagcctctttcaatcacctcaaccatctttcgagaaaggaactctttgttttcaaatattctagaatttaaaatgactgacgtctctgttaattaccataccatccatttgttgagagtatactaatccttatcatcgtatttcatcctcataatcaccctgtaaagcaggaagtatcattcttttcattttaaggatgaaaatactgaagctcagagagatgaaataaatggcatccccaagatcacacaggtagcaagcgagagaaccaggagtcaaagtccatcacactgtggcacctgcaggcttatctcacccccgtgcctaaccagatagagtatcttctaggttcagcagcatctctacccaaagtacatatttgtgaaaaatacagtcaaaataccaataatttgtatttttttttacctaatgtccaacgtgaaaaaatattttaagagtgagcagatgaaaccattacttcaaataaagctttttgaattatgtttaattttatttatctctggggacaaggaccaatgaagaagggactgcaattagcattagcctctcctgcatgagaggaaaaggtgacgcccaaagaaaggtcaaagaaagaaaactagagatcaaattggaaagaagagcgcagtaaaacacacgaatcaaattaacaacctccactgtattttctctgtaaaaccagcatgccattgtggtgattaccattttagtgaaatgaatgaaaacagtcatttcctccatgctacttgtttcacccacaccagattagaaacgaagagaatttttgaaattgtattacacttgcttataccacggtggctcctgattttccaataatataagtcactttcagaccccaaagtctatggtaaccgttcttgctcctggagtaatacatgaaatcaggtatttaaaataccagtctacttgtaaaataaatagcacataaataaacaatagcagctaatatttaccaagcacattacagttggatattgttttctatatttttagtcttccaaacaaatttttgatacagattctcttattggtatggcagacatataattgaccatccaaataaggatactttagagattgaaaggtggaactattaacacttgtgctaggcacagatataaaccaggaatgtttggacacccactcattggccttattttacagctaaagaactaaggaacagaaaagttgaatagtgtgcccaaggtcacgcagctagaaagcagaggagctgggctgaaggccaggatgtctggcttcagcatcatagtcggccattctgccatgtgccccttctgaactaactcatagactgtaacatttttcgaataaatcattcgactattctagtttcagacacacaaacctctctatagttcacgagttccacaaggccataaaagcacacaataaaaagtcttacaagagattgcaaatagaaagtgtctgcaaaataacctgcagagactccacaggatgagcccaggcaggaggcatcaccacgggacctaccgcacaggccaggtagttgggagaaccagtatctagtctgggctctatcctttcccttctggcctgagttccctcacttgtgctcctctagagaccttatagggtccttccccaccaaccatttgatgtgagctggtggacacatgtccaaatccttttatcttggagcttctccatcccaaattgtttcacttccttcaaggaacttcccatggtttcttgctgaggtgtgagataagcaactacaatcttctttgaggtgcctcattcgagggcctcaagttttacagcctctctccccactgagagacaggaaggagagagagtagaaaaaagagtgaggccccaggagaatgattaattctctgacctatataacagtagatacatatgctctgtttaagaagcatgaattattatagctgtgaaacacaaggctataaagcatctatgtgctgaaaaccagtcaacctaaacacagaagaagcaactattaagagaaaacacatatcacattagatttctgcaacaaagaagaaactttctcatcatctactggtagtggtagactgccagatggaatgcagtagactgctagatggaattagcctcctaataatgcaggtggttctttaacttcagaaagtgtaacacactaatatgcaacacaaaggaacatgcctgctctatccaatttcagatggattagatctaaattatagagaaatccgtttgttttatcctaagcaatgcatgttatacagcagcatcatcctaaatgcaaaggcaacttctaggtcaactaaaaccaaaccaccaccaacacagggtacagactacattcactgaaagatttgctccagaatcaatcacttatattgcttagaataactgtataaaactgtcagtcctgagtgcagggccgcatatggttctaagtattacttgaagtgagaaaagtagacacggtttagtctcactagggatctatcacattcttttattctcacaatcttctgtgttcttcagtgacaattcattagcaagttatgagagaataaagcaattagcttataccaaatggcattttcacttaaccattattttcagagaaccacttgaagacttccatgattttatttggacgttttgaaagtggataagtgctaagtgcccaattctgtatgttctgctgcttgattagatgccatgtttacttcctttactgagtataaagtggagactgtccatggaaagaagtgttatttataattgcatgctaccagatggcctatctcctttccacatccctaaaaaggtccaaaaaaatgtcttccatggattagatttcagagtaaggtataatttcatagcttgctagcttatttcatttgaattttcattacacgtaaaacataatactcataattaacatatatcaaatgtttactacatgacagcctctaccctagacattttctctgtagcatctccttgaaacctccaataatcccataaagggtattactatttcctcacttacagatgaggaagctgggtgaaaggttaactaacttgctccaggttattcagctagtaggtggctgagctatgacttaaatccaggtcccactccaaaactgcatgcttttaaccatcatgctatacttcctccttaattttatacttttatagcaataaatgtatatgtatgtaaacccaccgaggtgggtttgcttgctcttttaacatctgcaagctccttaagaaaagaggattgtgtctgttagattcccagaacccagcatacaaatctggcattcagtagcttgccagtaaattttgctgaatggacagaagtatacccttacataaaacttctacgtgtggatatgcatattcctatattaaaaaggcatccacacatccacatgaaaaaaatcacagcataatttggtaacaaaaaaagataacttaactatatattttctcttcttaataacctggttttatttccagatccttagagaaagaacaaatgagtcatactatgacatggggaagtcactaaaagtaagctataggaatgggaaatggcactatattactttacagctcattaacaagtcagacgtcagatacaaaaactagcttgccaaatcaataatttttaaaaataatttaatggaaataagaggttaggaaggtaagaaggacaagaaactgatttaaaatctcaagagatcaaaaaccataggaaaaattcactgcctcccacttgcttttggaagaagccactgtatgacatagcgattcccatctcttaaattatctttatatttataacaagtcttgagatgcctgatttaacatatgtggcttgtgacaaaatactactacaaggaaataagtagcttttcatgttttgtatttgaaataacatctggaatccagtaaacattaacaagtctggggatcagaagatctgggatttaatcttgactgcaaatcaagttcaaaatccgggccaaagtcaaaacctctagagctccacaccataaaaaatgagtccaagaccacatcttcttttttgcataatcaggaatattttgaggatatgagaacgagagggggcggagggatggggaaaacgcatgcgtgaacacttcgagctcttcaggggagaaaagtcccatacaaatgcaaagctttaagacattgactttactcctcactcctcgttttgttcaccccagaagcacagcagtctggagtaaagtcaggactatattatacagggatgcagggtctgaggcatatatcttcttttaacccgaaacacatttcaccctaaaaatctataaagctacagtggggaagggcttgggggccatctttaagttgacggagaccactcttcccccccaaaccatttgtgatgactcaggagtactgtgggaaaactctttatgaacatggactactctatgtgagaaaatgtaaagaagagaattattgagttggaatatatatgtttattaatctttgcttacagccaagagtgatgagacagagccctatctgaaaatattaagcagcaatcacaggctgagacagtgcgggaacatttagggttaactgtaattcactgccaagaaaaaacaatctgtccagggagagcccaggtcatgaaaaagatggaaaggaaggcccacggaagtggaagacaggatgccaactctggcagagtctggccctcaaaacagtgcgtaaatttcctttcttttcttttcttgtttttctttttttgagacagagtctcgctctgccatctagcctgaagtgcagtagcgcgatctcggctcactgtaacctctgcctcctaggttcaagtgattcttgtgccttagcctcccaagtagctgggactacaggcccgtgccaccacacccagctaatttttgtatgttttagtagggatggagtttcaccatgttagccaggctacgtgatccgcccacttcaccttcccaagatgctgggattacaggcgtgagccactgcacccagccgagagcctaaatttctgttctcgattcatacctcaaaccacaccaagacaagagataaaattcctcaagcaaccgacccaaactgggggccgaattctacctgaattcccagagtacccctcctctgcccagaaaagctgctcagacatggcctgccagctgtggatgcaactaagggagccaagaaagacaggctttcaagccctcaccctgaaatttccccatggcctttccaggtgaagaaaagtataggaaaggaataaacaatcttttgattgaaagaaatccaaaaaacccgggctttggttctggcttcctaagcatcagtggagcaaaagtgcctattaccatggaaatgataagaaaccaccattaggaattctgagattcaaattctctggaggcaaggactgcgtgatgtttatgtttgccactatcacacagcaggtgctcaaaaatgctattaaacaaatgaaagaaaaataacataatctggtctactaaacaacaagaggcaatgctgaaggggaaaggattttccaaagggagatgttccaaccaagaggcgcttagaaaccgtaatctgctctcatttaccaagtgcttgctgtgtggtgggcacagtgagttaacctctctttttaatcctcagaacagttcaatattgttgaatcttactattactccattttatagacaaggaaacagaagcaaaggatttcaccccctggccccaagatagcagagctgggatgtggacctagatggaaatcattttattttatttttattatactttaagttctagggtacatgtgcacaacgtgcagttttgttacatatgtatacatgtgccatgttggtgtgctgcatccattaacttgtcatttacattaggtatttctcctaatgctatccctcccccctccccccaccccacaacaggccctggtgtgtgatgttcctcacccggtgtccaagtgttctcattgttcaactcccacccatgagtgagaacatgaggtgtctggttttctgtccttgtgatagtttgctaagaatgatggtttccagcttcatccatgtccctacaaaggacatgaactcatcatttttcatggctgcacagtattccatggtgtatatgtgccacattttcttaatctagtttatcactgatggacatttgggttggttccaagtctttgctcttgtgaatagtgccacaataaacatacgtgtgcatatgtctttatagtagcatgatttataagcctttgggtatatacccagtaatgggatcgctgggtcaaatggtatttctagttctagatccttgaggaattgccacactgtcttccacaatggttgaactagtttacactcggtggaaatcattttaaaaacaccctcttaaccatgttactgtcagctgcagcctccatcactgcctactttccaagcaagcagcagacccaagggcagttccccggatttactgtacccgtgggaatggcttgctacatcctcagcacaacttacagatgaagcactaagcctacaagggtgacatgactcacctagggccccacgacattttaaagctaaatctcagatggaaacccaggcgactgacctcactttcatcacttaaccatggctctgttattcagcacagcagaaagaactttactgagaatgacaaataaccacactagcaaactctctgctcttttcttttaatggttctgtgataagcccaacccatcctgctgaactgctgccatcccaatcttatagcatatggctctcccttcccaggagcgtgatacactgtgaaaaggtaaccaataaaagcccctttcttgagcacactgaagtaaggaagacagtttacaagtcactctccaaagcccctagctggtaagcttaaggaaattcttgaaacagctctactgctccataagaagtaggaaaatatgttgcagaaaaacaagaagaaagaagtgcgcacacacacatgctcccctcactgcatttactttgggtatggaaaagtcatcacacttcagggctaagggcaagtggagggcagctatggctcagggcaccgattaggcatttacttaagaaactaaaagaagtggggaaagaaagaagaaaatcctttcaccacttaccctgaattcctcaaaaggctggaccctgtcttcttcatctttggatcccatggacctatcatagttacctcaccaattgctgccatcctttctaaaggtacctcctccaagaagccttcacagctccaactggtagagaacagaggtcaccaaggctctacctcaatcatatccataacaaatcttagcatagtgcatcttgattcatctgattggcactcaatctttcctcaacaaactaggagcttcttaacagcaagactggtgtttcacatacctgtatcccaagagtagatatagcccgatactacagtggatactcaggaaatgtaggctgactccagtgctacagggctttgccttgggccctgtcccattcatactatatcaatgactttaaaacaaccaaatctgttggtgataataaattggaagggaaagcgaccaccatcaaagacagcactgatagccagaatgatttctataagctgtctctcaaggttgaaacccataaacaaaataaaatctcatggagagttgagataggcattgcatgaagtttcaaaatgcacatacaaaacagaaaagattccaaatttttaaaatcattttgtaaaaaataactgcatgtaaaaaatagctacataaaaaaaatcgctgtgtaacaacatttggggagacctagcctgagatcaacacgggagaaaaatgcaagttttatttggctacaagcttaacgggaaccatcagtgagatactgttcttcattactactgcagctgctactcacagtaacagtaggcgtgcctgtagtaccagtaggatagcactgacagcaattaggatggaagctaccatgtatcccatgctatctgccaaacatggtgctaagtcccatactacactctctcacttccttacaactctatgaagtagaaatcttcatccccatttaagaagaaagtaaactgagtctctgagcagttaagtgacttgcacagggtcacacatctgggaagccacagttacagtgacaagattcaaacccagcctgattggcatccactaaccaaactcttaactgcggatgtaatctgagacctgatgagaaagaacgaataaaaaaaggatagctccactattatttgcatctatcagacaacatctagaatgctgtgtataattctgggtgtccatttataaaaaaggacattttcccccaattcatgttattcagaggaatgtaactgggttgccctgaattgcaaacccagttatcccaggtgcagcagaagaatgggaatgcttatctagaaacagaaagatgggtggggcaggggagacgcgacaactgttcttaggtatctgaagagcttgtctgtacaaggcagaaggaagatacattcttattctcagcaacagcagaatgagggccactgagttgacacttcaaggaggatttgagttggacagaggaaacttcagtgagaacatctgacaatgcagtaagttgccccaagtgttggagagttactgttcaccaagaagcttttagcaagaggctgcaggaccacagctgtcaggggtatcaaagaaggaattcccacagggggagaggttagaggaggtttccatttcccacctttcagatccactgaccctccaaactaaggaggccatggtacattttggtgttctgctctctttgctcaggaagaatcagtagttgtaacatgaggctctgagggtcattttgtcctgaagtggaaacaaacggtatttctaacattgtccaaatggtaactggaattagaattcgctcttttcaagcaagaagcatatgtctggataacgtgtttgaaatgtgtctgcaggatctaaatatctgaaccatacatttgagtttatttctatttctcaatagttctattttactggatgaagaaccttgcaactgatccacagtgaaaaattacaatgagtaaacattagtacttcctccagaagacattcatcttccactagggagaaggagataaaattattttcccaagcatagtcccaaaaggctgatattttgatcaccttgctttccccttggcacttactctgtataacttgtagctgtattaaatttattatcaggtgaacttcattatcactttcgtgctttttttcattttgaacattaggttagttctctatcaaactgatttattcatgtcctcagaatgtcctgattaaaaacatgtgagtgggccaggtgcagtggctcatgcctgtaatcctagtactttggaaggctgaggcgggtgaatcacctgatgtcaggagttcgagaccaacctgaccaacatggcgaaaccccgtctcgactgaaaatacaaaattagccaggcgtggtgacacatggcacatgcccgtaatcccagctacttgcgaggctgaggcaggagaatcgcttgaacccaggaggtggaggttgcagtgagctgagatagtgccattgcactccagtctgggcaacaagaacgaaactccgtctcaaaaactcaaaacaaaacaaaacaaaaaacacatgagtgaaggtcttatagcagcgaaaaattctcaatcaacttcctcccccagcccccagcacatactaggtactcaatgaatgcttgcttgaaatgatgaggctgttgatgggaccatcaatgggtatgaaagtcttaactaaggagaaagatgatatgatatttaccggtttttgccagactgagaaaatggcagtctcatcgcctgggcagaggaggatcaggaggcaagctaagtaacagtctcatgtttctgttgcacactgagacacagtggtgggaggccagaggatcacagggaaggggaacaatcaagtgtggagtttagaggatctaaaaaactactgtgagtccatgccctaagtcctatcatgcaatggcaaagaagtatctgagtggggtcaacaagtgtggcatctgcaagcatgagtatacatgctaatctctggccagagaactggtatgtgccccaaatgtacttaatgtgctatgtgtggataggcaagagctcagaggggtggcctctgcacaccacaggagacagacaaggagggcttatcccaggtcaattctattttttgtgtgtattttgtttgttttattttttgagactgggtctggctctgtcaccaaggctagagggcagtggtgtgatctcagctcactgcaacctctgcctcccaggctcaagccattctcccacctcaatctgccgggtagctgggactacaggcatgtgccaccatgcccagctaactttttgtgttttttgtaaagatgagattttgccatgttgcccaggctggtctcaaactcctgagctcaagcgatcctcccacctcagcctcccagagtgctgggattacaggcatgagccactgcacccagcatatccgaggtcaattccatacatcaaacaaccctgagaaacagaggacactttccaaaatgtgtctagagctatacaatctattagacaatcaaattccacattaacagaagcaaaacaaactgaatctctggctaaaatgtggtaagtagcagagattcattcagaggaggaatacattttggaaactttgatctgactgggctttgatgatccaggaagcataagcaaagttttcatggagagaatgagtatgtgataagccaacaaaaggtaagggtaagaggaatatcagcaatcactatttataaatattgttttctttccctctgcttctttttttcttttttccctgcctcgccccacaccgcccgccccatgcttctaaaggccagcgtttctcattaactcggctgatggaagtaagcaatattataattagatagccaaaacataatataaacaaaaacagtaaaataacaacattcctctgaaagtgatataaagtttgcacatacaatgacaaattaaatgtcacacaatttcatccagtataattatttctaatttgtagacaaggaaactgaagatatattctacatttagcagtagtcctttaatattaagtggcagagctgtaatccaagttactttggtttattccaaaattagagttcttttcctgacagccaagtgtgatggctcacacctgtaatcccagcacttcgggaggcggaggcaggtggatcaccagaggtcaggagttcaagaccagcctagccaacatggtaaagccccgtctctactaaaaatacaaaaaaattagctgggtgtggtagcacgggcacctgtaatcccagctattcgggaggctgaggctgaagaattgcctgtacctgggaggcggaggttgcagtgagccaagactgtgccactgcactccatcctgggtgacagagcaagcctccatctcaaataaaacaaaataaaacaaaaacaaaaggagagttctttctctgagaaaaagaagccacctaaatgcaattgtgtccctcacagagagggaaagatatcacagatcaccccatcctgtcacatcatcaactgaacaagtcagcatggtaccttggtactgaaagtgagtatgcagatgtgggaaattagaatgttatataacctctacatatttctttaactgaaagcactacatagcaccacagattaatatccgtctcagacttaggcaactgaaaagcaaataaccacaaactacattttcaaaaaccacattatgattgggttaagatacatcacagcactggccatttactaggttgtatctgtgaggaggggaatgaggccatctaaatgtggcacctccacaggacacacacatgggacacacacacacacacacacacacacacgttaacaccaagctgacctttttttcccatggccaaatacctcatcttctctcagatgtgtacaaagcacacatggctgtttccacaacctgcttttgccataaatgactgcccaataaaataaaaactaatgattaacttttgctccctggaaatcactgaaaaagaaaaatatatttcctgaatagcctttgcatacagggcactgactattcccaagctctctgaagaagctttaaaattatttgccattatgagttagtcacagaactaacataaatacataacacagaagaggtcagttcctgaattgaaatatttactaaccacgtggatattttggttgtaaacgttccctgaaaatgtctcttctaaccagcctctgcttatggaacacatggagtctggacagtcaccaaactcccccaattccatatatctggaattggtattattgtagggtcaataattatatacaggttctttgctaagcactagagatacacagtccattagggaagaaaagcaaataaattaagatctcaaagagaaataggacttaaccagaccagatgagaactaccacagctgtgaagaattgcagggctcaaatcctagagaggtgaaactgttttccttagagatctattgcctcaaatggcagatgtaaggctgagaagctgagcagaactttcaatagactcatggcctgaggatataaaaaattggagtttaaggccctccaaggtggaggatctatggtaaaacccctagacttttggttggcaccctgaagaactatacccagggggaactggaaatagactggccattacagggactgaagctctgcttcaaatcatctcaattcctgactagattaaagctaatctgaaatagaagtttctagaagcaaaggtaaatcctttccagagacacatcacactatctagatctcaacctccacaatttttcacataaaatgtctgctagtcagccaaaactaaccaggcatgtgagaaaacaagacatgactgaaagccaagaacaacagaaacagatcaacatggtggccagatattagagttatcagacaaacgtttaaaaatgatgactgaaaaacacagtgaaacagccctgcacactgaccagagcaccttaaataaaacatattgacgatatcaagcattgatgagaagaacagtttttgttctttttctttggctaaaagagaaagtaaacacagtaaactgttaacattatgtagtaggtacacagttatctattacactattttctgtactattctgaatttttgtaacacttcataattaactgtttaaaaaagaaaaaaaagatgtggctagagggatcagcaagggttaaattatgttagccttcagaagtcatgtgcaagaatttatacttaatcagccaggtgcagtgtcccacatctgtactcccagcactttaggaggccaaggtgtgaggattgcttgaggcgaggagttcgagaccagcctgtgtaacagagcaagaccccatctccacaaaaattaaaaataaaagtaacaagacctggcgtggtggctcacacctgtaatcccagaactttggggggacaaggcgggtagatcacctgaggtcaggtgtttgagaccagtctggccaaaatggcgaaaccccgtttctactaaaaatacaaaaattagctggggggcacctgtaatcccagctacttgggaggctgaggcatgagaatcgattgaacacgggaggcagaggctgcagtgagctgagatcacgccactgcactccagcctgagggatagagcgagactctctcaaaaaataaaaattaaaaaaaaagataaaagtaattaagtttttaaaaaatattttacactttattctttggataataagaaggcattaaaggattttaaacaggggagtgacctcatgtgacttgctctctatatagatcagtctagtcacaatgtggcaaagagagggaaggcagggagccctctgggaggctgctgcagtaacccagatgagggatgatcatggcttttctgctggcaatgaagaaaagctataaagacctgaattatggagtatgaattgtctaaggatttggggtttagttctcaaaactgttaaattatatcccagtcaaatgaggaagcaaaggaggccactgggacaaagagaaacctaaaatgagaacaatttcattagagcaagggcaacatccaggataaagcctgggattggtgaaaagaaaaatgtgaatttttctgtaaatccttagaagaaacacaagtagctctaaaactgaaagctaacaagcgctcagctccacaccagatggtcagatagatacattcacaacttgccagcattctaaggccttgtgcacccccttccaagcatgcagatgcttttatctgagatgaaaaaaattctatttctgattctgacagcaaatgccaagtcacatcttgccggtagagaatgacatctcccaaccacaaacccacctagaattttacaaccttattctcattttgaccactacttccaccagccccgctggaaagtaaaagaaactgaggagggatgacggcttctaaagaactcagcttttttatctgcagccctcaaaaagtagatctgttttctctagattattcatgagcagcccatgtgttattctgtgaagaaaaattaagcatatccaacaactttattcccgtattctgaaaaatgagcctcaggcagagtctatttcttcaattgctctgtaatcctatattgagaagatattgaagaattaattttctttatcattaccctttgagccttttcaaaaagttcaggtttaaaattaagcacatcaagtaaccagtctagctagtttggttataaatatacattcttggaactgacttatgaatgactactttgctagagatgggattttgcatgatattctcccccccaatctgttcacaccataaaaaatattcagagatgttctttttaaaggaagcactttccacacacatgtccatgtagtgtctcaatttgtatacattctgctggggtagcttggttttagaggcagggtagtatactatttgcattcaacatttttcacatgccagaataagtaaaacttggacaaacatggttgccttctgttcctaagttataaggtgcatcggtctgacatactaagaggttcaggaattaatcactaaatgacacaacttcctgcttcaacatttaaccagaaaacaccctttctctttctctccaaacaatgctgctgaatcaaaatttcaacccatcagaactcaggcaactagaggcatgataaataccacctagcagatcttaatagttcataataaaacagtaataaactttatagttatttatatatcatgcatgctttgatcaaatttacgagactgaatacaatttctaaagttataggcagatttcctcaaatagttatcaccatcacaatccaggaaaagataacatgctcacagacatttttacaaaatgctctgaggttgaaataagaaacatgcgcttaatgtgcctttagggaaatcccaagattaatttccagagtatgtaaatacccctcggaaacacatgacagcctggctgcagactgcccagaggacagatgccaccattccaagacacatgctctgtgaataatactcactgggttaagcgtttcttcaacagaatgatgaacagtccaccagtctgaagtccattcccatgcgttccccactatgttgtataagccataaccattgggagggaaggcatcaacctaaaaacaaagacaggaaaaatgctgtcaaactattcacctggtttaaaaaacatcttcagtgcagaaatgcagcaagagctttaatttcagagtatgaatgttgggttttattccaacagtcaaagtacaatttgaccaacataaagacaaagaaaggggcattttttttttggctttgagctcttagaggaattcagaaacctaaagagagttcatattaaatggtatgaaagtcagagaaattattcctaatagagttactaatattatcatcaatcaaaaatttgtgtcaaacattgggtgagtagggagaggatagatgatacttagactttcaaaatcattcacaggaaaatcccattggacccaatatgagtcttgtcatcacagctcagctttcctggccacacaatgtctttcagcactgagcgaccccaagtcagttagctctgtcctctccacaagtttctgccaactcatcatcttaccttaagcctcaaaacttaaggggatttctttttataaagaaaatgtgaatccattatcaagtgtattggtaatacagggttttcagtctctgaaacctgagtctgaggcaaacagtatgcattcttcagcagaaaattatacatttcaaaggcaggtcagacagtctgccacataatactgtcacaaacacaggaccaaagtgcagagtttttataaaaggggggagagcaggaggaaaaaaaaaaaaaaaaaactttaactgaacaataataaatgcagaatagttttgctggcttaatggcttaacatttttcccaacattttaaaatggaaattctcaaacataaagaaaaatttcatttttaaaatgaaaaaaatatatatgtatatcaagtaatccttgggggtttaaaaatctttttgtaaatccatgctttttccagactaaatgaagtagaatggaaggaatgaataaactaaaattcattccctgtggcttcagatggtttcacatctacccatgaatatggaagcatctgatgcttgggcaattcagagcactccaatcaaagtcacgaagctagtgtgaaaagaacttaatctggatgagttggaaagctgaaaattctcaccacactgcttccaaaatcagcaatcattatggaaacagcagtatttattcattgattcattcagtaattccatgcacagtgactaaagacagtgagggcttcaataacaaataatgaatgacctcaactagtttaatgagggagaaaaaaagaatatacccaaaactcaaaatccaactctgaaatgcagaatgggatgagtagggtaagagagggaaataaaatgtcagagaaactcgcaagagagagaagcttctggctgaaggcattctcctttacaaaagtagagttgtctgggcagatttcaaatagggctcagagttcaaaagagaacgaagaggccacaggcataaacaactttttcaacaatttggagatgatcaaaaagagcatggtagagtaatagctgggagaggtaggaaggaaaagaagaaattcagttatttcaggaatacaaggaaaggagccagaggagcaagtgcggttaaaagatgaaacaggccaggtgccgtggctcatgcctgtaatcctagcactttgggaggccaaggtgagcagatcacctggggtcaagagttcaagactagcctggccaacatggtcaaaccctgtctctactaaaaataccaaaaaaattagccaggcaggtgcatggtgcacgcctgtaatcccagctactcaggaggctgaggtaggagaattgctaaacccaggaggcagaggttgcagtgagccaagatggcaccactgcactccaggctgggtgacacagcgagattacgtctcaaacaaacaaacaaaaacagatgaaacaaacactggaggaaggaatcattttccagacttatagagcacaggtggaggtgctctcaaatcagtctgcctgaggtcctatgtgtgcatcaatactattttttttttagacagggtcttgctctgtcacccagactggagtacagtgatgcaatcacagctcactgcaacctcaacgtcccaggctcaagcgatcctctcagctcagcctcccgagtagctgggaccacaggtgtgcaccaccacaaccgactaatttttggaattttttgtagacatggggtctcctcatgttgcccaggctggtcttgaactcttaggctcaaacaaacctcttgtctcagccttccgaagtgctgggattataagcatgaggcaccagacccagtgacaccaacagttaacagctaacactaggcaagcaacttaacctatatgggtgctattttgtctgtaaaatgggaaaaataatagtacctactcaagggtttgggtatttttttctttacccaccttaaataatttgatgtttaagtgaagtagaatgtggaggtcaccacccctaaaattaccataggtgagtatgccactaaggaaaataaaaatgttaactgcctgctattaaaccaatctactaactaaagcttcctctcaggaacctcaaaagcaaacaaatgtatatgagaatactcctggcacattttcagatgaataagctgatatgcgttaaagccaaaattaatcattgtgtaacaagcagaatggcaaaatgtaaattctttagtctcactgtggtcaaaatagtttgctcagtataaaatcaggtctagctgggtgtggtggttcatgccagtaatcccagcactttgggaggctgaggaaaaaggatagcttgaggacaggagttcaagaccaatctgggaaacacaatgagacctcacctccacaaaaaaaaaatttttttttaagatagagtctcactctgtcacccaggctggagtgcagtggcctgatcttggctcactgcaatctctgcctcctgggttcaagcaattctcctgcctcagcctcctgagtagctgggattacaggtgcatgctgccacgcccggctaatttttctgtattttagtagagacggggtttcactgtgtttcccagtctggtctcaaaatcctgagctcaggcaatccacctgcctcagactcccaaagtgctgggattacaggcatgagccaccgcacctggccccaaacaaatttttaaattagctgggcatgatggtgtgcacctgtagtcccagctacttggaaggctggggtggaaaaatcacttgagcccaggaggctgaggttgcagtaagctgtgatcatgccactgcactccagcctgggcaacagagcaggaccctgtctcaaataaataaaatgagacctgaaataataaatacatgaaatatcaggtcagggagctatttccctgtagtccatctcattatcaaagttaaattcctgctccagttgaccagagcatgtggacacaaaagagcagcttaggtggacttgagatactacgtgtaaacgattgccataagatagagatctcattaagactcattctaaacacagatggcagctgtctctctctggctggcttgcttgctttctcctctagtcctgtttgtcaaattggttcctttaggactcccagtaaatgttctaatctgttttagtaacttccatggcaacttcttcaggtcaatttcccacacatatgctgaactttcagtcaaatattccaattctaaacatctgtagagtgtccttatttcatattgaacattgtattttttgaaaaggtacactgattttagaagagtaaatggctctatattccttggtagctcatgtaattaaatagaaaagaaactgtagctgcaagtgctgtcaaatatgcataactgtccaagaaaaccctgtcatggccttttgttaaaatgaacaggcacttatatcattcgtttggttcatcaaaaatgcttatcacaggccaggcgcagtggctcatgcctgtaatcccagcattttgggaggtcaaggcgggaggatcacctaccagcctggccaacatggcgaaatcctgtctctactaaaaatacaaaagttagtcagatattgtggtgcacagctataatcctagctactaaggaggctgaggcaggagaatcacttgaacccaggaggcggaggttggagtgagccacgatcacgccactgcactccagcctcggcaacagagtaagactccatctcaaaaaaaaaaaaaaaaaaacagacagaaaaataaaagaaatgattatcacggtcttgtccaaatgagggccacaaaagccatcacctgtgtctttggaatggagctcatttcaaatgagcatatgattatgccaacaaaagaatggtgagaaaggaactcttgtacacccataaaggaaaacatgccccaagtgttctggaaaataattcaaccatatatctgaaactcttaccaagaaaagttttctaacctttgactcaatcatttcactgctgggaatctatctttaaaaaatcatcaaagggccaggtgcggtggctcatgcctataatcccaacactttgggaggctgaggcgggaggatcgcctgaagtcaggagttcaagaccagcctggccaacatggtaaaaccctgtctctactaaaaatacaaaaattagccaggtgtggtggtgtgcacctgtagtcccagctactcgggaggttgaaatgggagaattggttgaacccaggagacagaggttgcagtgagccaagattacaccactgcactacagcctgagtgacagagtgagactccatctcaaaaataaataaataaataagtaaataaaatggctcaaggttgaagtgagtgctcttttgcccgccttctgccttctgccaggggaggacacagcattagtcccttctggtggatgcagccgacatcaatcatgctgctgccttggtcttagacttcccagcctccagaattgcaagaaataaatttctgttgtttacaaattatccagtctgtagtattttcttacagtagcacaaagggactaagactaagacatggctttatgagtatatgattatgccagcaaaagaacggtgagaaaagatttcttatacaccaatagaggaaaacatgccccaagcattctggaaaacagtttggccatatatctgaaactcttacccagaaagttttctagactttgaattatttcactgctgggaatctaatctatctttcaaaaatcatcaaagacgtaggttaatatttatgtacaagatgttcactgtagaaaaaaaaaacagaaataacctgtttccagtaaatacattggggtttatttatgacaggttatccagctgctgaaagacaatgtatttgtggcatactgctaatgacagatgaaacgtttctgatataggcaggaaaaaatagtaggattttaaatactgtatccagtcttacctaaatgcaatatgtaaaaaaatatgatacatatacaccagaaacacatatgctggcaaatacggtagttaagagcatgggctttggaaataaaccgacctggttcaaattccagctgtgccgctttccagctgtgtaaccttgagcaagttagttaacctctctgtgcctcagaatgctcacctggaaaatggggataatagtacctaccttacagagttgaatggacagtaaatgagacaattcatgcaaatgccttggcgcacaatgcccagcacattgcaagcactcaataactacacgccattattagcatcatcaacacagagaacaaatggggaagaaatgcaccaatatgctaacaggtattatttctgggtggtagaattccaggacagtttagctttctcctttatagtcttctcatttttccaaataatctacagtaagtattatggaatcagaaagggaaatccattatacaaaaagaaaatctgtttaattattagtatttgctacgtgcaacagtgaatgcatacacgaagggaacaccgtgtgagtcacaaagtgagcaatgcctttcaccccatgtctactgggagcctcagttctcagcagctgccaccctcctgcagaggtctcattactcacaggcgcagttccttggaagccatcctcaccagtgttggtcaccggaaactcgccctgccaaatgttggcataatgctggcctttgggctgcagtttgttgccccaggggaaaagtctgtcagaagagacacaggcatcagcctgtcaaacaggcacaggttttggatgaaagtcaagagaagggatgcaatgaaaaagagaacattgcttgcttgttctgagtgagccagttaaaatatatatataaataaataaagcttttaatcaggatttattttcaatttccttataacttctcatgtcacgtccacaacagcctcagtcttgcccaggtactcaggaggcctgaaataaatcacaaaactaaaagaaggacttatagaaagctgggagagtagacctcattttggacttatatggtagtgtgatcaggcaccaccacaccacacttttttataaagcctgggctattttaaggagcctttcctagaagatgtgaacccaacatgagttttctgtctcatggctctagaagcagagacataccgctgcttcaggagatgcctaaaataagaaaatgctaaaagcagggcagtctgccaagaagttctaagcagtgatatgtaactcaagggggttgaattgctaagacttgctttggggctggagggagcccacttggccagacacttggtttaggggtgataaaagatttgtgacccattctccagtgtcttctaagtaatttcgtggaaaaataagaaaaagaattattgtcgttattaactttctaaccaaagtaagttccatggagttttttgttgttgtttgtttgttcaaatgaccaacatattgtcaggcaaaatgagatcctctaaatacctattatgcaggcctcctcgacagctgtattcccactcagcttccgtgggcagccgcttccctgcccaagtgcagtaggcaaccgcatcattccaggacacatggagaactggatgatccggcctggggaagagcaaaagtagaatgaaaagtgacaccaatcagaacaagaagcaggagctggcttcagcaaagcgcccataatccccctcagttcaatctgtgacactgaggtcatcctggtccttaagtcaaaccccagccatgctacatctgtcatgctccaccaacggtttctgacaacccaggctcccaaatgggttacagttccactgggaactagactcaaaacatttcttcactttgtaggctcggattcccacagaatgtcattggtatggcagatgcggagatactccagctgctaggagggccagcaggagctttcagctcctttggggttcagcagagctgacagccatctcagagaaaccagtgactaaccaaccacagcaggggcatacagagccagccatttcagcctacagtggctcaacctatgggccatatacaccctagaggcccctgtgttgggtggagcttggttggacctgcattgtggctttgacttctccctctgcccagtcctgctctggcccctgctttctacaggtgtggggccctaacattctgcatcctaaactctgtttcagcctctgtttccagagaacccaacctgtgacccttggctttcaattctgtgtctttctacttttcctctacaagaggccggtctttttttcctgagggtataaagggtgtggaagtttggggaaaaaaaactgagaaaaaggggatagactcattcacccagcactagatggctttggctgaattccctgctcacttttttaaaagtgggctacaaattcctagtccattccttatacacctttgaattccccacagtaattacaccaggcctttcatttattctttcaacaaacatctactgagtacctatcatgtgccagtcactgtttccagcacagacaacagaggtactcttctcagaagatccatcggtgttgactgcatggataacatacattccccttttgggttttccttcctcccttagcattttcctctgttactaaattcaggaaagcagatattaactgggagctaagaagccaagtccacctgagaaacccaggaatcctatgactttccacctcgaagcctaattgcagcacagcggcttccaattgaggctttgaaagatgtttgacatttgtcaaggggctatatccctaaagctgaacttcctatactcgcagctccccgacaataagggcaataaccaggaatgttgttaaaaatagagacttaaaaactgcatctgaaaaattaggttaggagagcaggtttcttgggctgctgagatgctgagtcctaacccaaaccttgctcaatctccagggtttaaagtgttactctatttttgcttgagataattatttccttgccaccctggagacttgctgaccgacttggctctctgtggttttccagttagatggtggcttcaaagaattccaatctggaactcaagatcatgtgaatcctatacccaaggcctgggcttccacagtggcaacctgggaggacacaattacttatccataagacagacgtcttcttcctcatagacccgctaataatggaaacagaatgtaaagattaaacatgtcatgaggtttggaataggcctctcaaaaggagcagggaaactgggaagaggcaactctttgacaagccaaatgaggagagaaagaggccactaattaagagctttcttatgagcaaggtgcagtgtttgggtctttacatacgttatttcccaccatcttattttcctaccaatcaattacagtttgtcattcttatcattttatagatgaagatgcccactgagttcttttgcaagagcaaagggtacctattttgcaatggaacttgtcaactggggaaagagggaccagcctcacctgtgcagaatagtagagtcaggcccttctgggtgtctccagttagcgcctttcacaggtaaccaccagggagcagctgcaacctcaaagcaacccagaacaggctgatgttagctactaacatcaactctagaaaaatatcaactcagtacatgcagcaaaaatctcaatgtcttcaacttccatttggattaccaaacaaatacatttgccagaataccaaaataaagacttatatgtaaataaatctttaacaaaaaaagtattacttcatatcataaagcctcacagcaaacaaatacatatgtatttaaatggtgtatatctataagaattttttttttttttttgagatggagtctcgctctgtcgcccaggctggagtgcaggggttgcaatcttggctcactgcaacctccgcctcccaggttcaaccgattctcctgcctcagcttcccgagtagctgggactacaggcacgtgccagcaagcccagcgaattttttgtatttttactagagacagggtttcactctgttagccaggatggtctcgatctcctgaccttgtgatccgcccgcctcggcctcccaaagtgctgggattacaggagtgagccaccacacccggcctctgtaagaatttttaaaaagtgcatggctagccaatcctctataatctctaacaagtgagacaggtagtgctgctcctatttaaaagatgaggaaacagagttaaccctacaattaaatgtgaggctaaaggtcaaccatggtggtcagagatcaagctgaagcacagaagaaaaaatggggtgtattttcaaaagaccccgattcaacttccaacccaacattagctgggtgaccctgggcaagttcactacttgtctggaccctcctagtccttgtctgtgaaatgggagcacacccacctgcctcacctaactcagaatacagaggtcaagtgaggtaagattggaaaatgctcagcaaacagtaactagaaccttaactcctactttatggttctgttaaccaaaataacaacagtcaggagtcctcatttagtgagtggtttagttaggaacacaggctttggagccagtcaaaatgagatttgaatcatggctctgctgttcacggtgtgaccctaggcaacttatttaacctctttccccaagcctgttttctcatgtggggatacagatagtaacagcacctatatcttgggttattacaaggaggaaatataatacgcatacaggacttatgactatgcccttagcaactgaggttaatgactcagcaagcactcagtaaagggaaccagtctcactatggccccatgacactcagtcacaaggagagccacaaaaactaatcattgttgctaatactagctaaagaacagatgttgcaaatgattctttttgagacagggtctcaccctgtcccctaggctggagaacagtggcacggtcatggctcactgcagccttgacctcctcagctcaagtgatcctcccgcctcaccatcccaagtacctgggaccacaggtgtgcgccacaatgcccagctaaattttttgtatttttttgtagagatggggttttgccatgttgcccaggctggtcttgaactactgggctccagtgatccctgcccaacttggcctcccaaggtgctgggattacaggtgtaagctactgcacctggcctgcaaatgattcttctaatacaaatacaaatacaaaagaaagtgactcaaggttatccccacaacaatgttactctttgattgttttcatccttttgagcttgtctgagtagaagttaagggagaatatgtccctgctaacaattacagcaatcactgaaaacaccaagccccattcttgttcattctcttttcacatcaacacaatcagaacattcatgatatctcaatcacaatttgatgggaaaacccaatttttaaaatatttcaacaaaagaaggcattaggtccttaaatgacactatagcaaggtgttttattttacagagaacaggggagtgaagaggcatggcttctttctatttcatttgtggcgctgtagaagttcctctgggggctgttctcactgactgggctgtgcaggtttaggtgcccatgacaggtaattcattcagtgtcaagggaggagctgcagtgaaagctcaggtcagcccacacttgtgtttcaggaggatcctcagatcattcttccaactctaccctgtccccaacactaagcaccaccaccagaaggttctagttcttaaattaaaaaataaaaataaaaaagcttaaaagaatgacaaaatatagcaatatgttaacctccatgaatgacttttcttctcatacccttttgtgtcttaaaatatttcatcattagtgatttaaaaaaaaaaaaaaacatgatttgtttgtccattctactactaatgggtatttgggtagtttccagtttggggctattatgaatagtactgcttctatcaatattcttaaaagagtttgtggcttttggcaaatatatgtacgcatttctgccgacagtacatggtggagtggaacagctgagtcctagaatacacatgtgcacagctttagtagaggcaaacacaagccttaaacaggagaaggcccctgccatttcctaccctcttttcttcctttttttttttaaaaaaaattatgtatttattttttaactttttatttccataggtttctgaggaacaggtggtatttggttacatgtgtaagtgctttggtggtgatttgtgagattttggtgcacccatctcctaagcagtatacactgaacccaatttgtagtcttttatcacttcccctgagtccccaaagtccgttgtgccattcttatgcctttgcatcctcatagcttagctcccacttataagtgagaacatatgttgtttggttttccattcctgagttacttcacttagaataatggaaagagcgtggagattccctaaggaactaaaagtagaactaccacttgatccagcaatcccactactgggtatctacccagaggaagtcattacatgaaaaagatacttgcacacacatgtttatagcagcataattcacaattgcaaaaatgtggaaccaacccaaatgcccaccaatcaacaagtgaataaagaaactgtgatacacacacacacacacacacacacacacacacacacaatggaatactactcagccataaaagaatgaattaacggcattcacagcaacctggatgggattggagcctacccctttttcaaaggggagctttccctcaagtcagtttatgtatagaagtccctagggcttctctctagtgacctctcagcccatactcttctactctccttttcctctcaattcaatctggttacaaatgtttattgagcaccgactgtatggctagcactgaacctgattcttggaggggatctacaagtcccaggaatcctcagagtatgactgaagacaattggtatattaaatagttttaaaagtatttattttacatataataattgatatagtttatatatttatccccactcaaatctcatgttgaaatattaatataatccccaatattggaggtggcgcctggtgggaggtctttggatcactggggcagaacccttatgaattgcttgggccgtccccttggtgatgagtgagctctcactgtgtcacaggagatctggtcaaaagtgtatggcgcctccctccacctcactctcttgctcctgctttcaccatgtgaagcgcctgctcccacttcgtcttctgccatgatcgaaaggcctgaggcctccccaaaagctgataccagagctacgtttcctgtatagcctgcaaaaccatgagccaaacagacctctttctttatgaactacccagcctcaggtatttctttatagcaattgcaggaacagcttaatacaaaaattaattcctcagttgcaataattggcatagaaaatgtgcaattagtcatctcattttccttgataaatgtctctaaaattcaaattgatgggtccagatatcaccctacacatattagtactatagtttttttatctccttccacccgctaccccaccctctgctatacacacacctactcactcacactttctctcattctagacacccgcttttcttttttcccagcaactattctttctgaaatctttcatgctaccctagcaacccaaaacacactacttacttaacgtcatggagctatatgatgatcaccaatctcaatgaggtgcacggtaagatggaaaaaacacgtgaacacactgtggccaaagcatgagaaagaggacaccacgacaacactatccttgaccaaaggccgcaacctagtgttttggtccaaaatagtaagacctgaagcaagtatgcaaagatatatgtatagtaaatctagacataatatagtttctaacttaaaattacaaaataacccaactgtccttggtgtccatgaaaaaaggaatactatacggctagttatcaaaatacactctgacatggaaatatgaaaataatatactgtcataaaggtaacctatagaatacacatttgattccgtttctataaaatgtatgcataacaatgtttgttagtatcatcaggaaaaaaatgtctggaagaatatacataaacttaacataagcgaaggatcaggagagtactattagacatttttagaatgagtgtatgtcactatcacaggttttctcaacctcagcactgctgctattttaggccaaataccttgttatgggagactgtcttatgtattgcaggatgtttagcagtgtctctgacctctacccaccagatgccagttgcatccttcttctcccatgccaactgcggcagacaaaaatgtctccagacattgctaaatgtcctctgaggagagcaaattatctactgtattatgataattagggaaaaaaagattactcttcttaaatattaatacacagtttatagtagcatagtggtaagagtatctgaccctggagtcaagctgcctaagcttgaacaacagtatcaccttttacaagctacaagatcttcagctgcttatttaaccccttcaggcctcagcttactcatctgcaaagtggggataaaataatactatctacttcctggggatgttataaggattaaatttaaaaatacatgtaaagtgcttagaaaagtacctggtacagagtattagctgtcattattactactattcatttatgttattacatgttacaatattctcttagagctttcagagaacatatattctaattagtgaaaatctacccccatatctgttcagcttgagccccctccacccaccagttcacccttttcagagtactgatcaactgagaaaagtgaccaagagctaaggggtgaaggaagtattggaacatgtgtcacttccaaagacttctcaagaagatgtaccatcttccatcacagtcatgatgtgagaaccatctacacataaactaacccactctctaaagcaagcagcaccatgagggtagggcaaggggagtgtattagtccattctcatgctgctaataaagacatacctgaaactgggtaatttataaaggaaagaagtttaattgtctcacattccacatgactgtggaggtctcacaatcatggcgtggtggaaggtaaaggggcagcaaaggcacgccttacatggcagcaggcaagagggcaagagagcatgtgcaggggaactcccttttataaaaccatcaccatgtgatctcagagatcacatcagatctcatgagacttcactctcacaagaacagtgtgggaaaaacccagccccatgattcaatcacctaccaccgggtccctcccatgacacgtaaagattatgggagctacaattcattcaagatgagatttagttggggacacagccaaaccatatcagggagggtgtgaggggtaaacagaatacaggaggtatccacattcctcaacctccaaacttcagaaagcttgggcccctgtaagggaaccaaactacacacttgtctgtctgtaagacagatcataagtcaccactgtgatggtcagatgcagagtcagaaaccattttcccatttcacacatgaagaaggagagacaagtaatcaaagtcaccccacaactgaggactgacgaaatcagaggtagggccttattcatcctgcgcaagtttcccttggaatgtcaaatattttctggtcaaatttagggcaaatcccatccaaactcactagacgttttccttttccaagtgtcactgtttctaaacatttcaaataacttgttcttgaactcctgattctgtcttgaaaataagtgctattctactaggtttaggaacttaacaaaacaaacaacttttaagagtcatatattaggcatttcatcaaggctatactgcagattgtgacatctataattccttttaacaggaatagtgttcaggtgtgttgtttacagagcagaagcagcagcatgagtggactggcatctatgataaacctcaacctaaaaagagacaattttttttggatgtggttgtccacctacacattctctgctcaactgagacaatttccagagttacagcactcccttatatccagaggaaaaaggactttaacatgacctatttctagtcaaccatctccatagcaactgtctagggtttaagttgaaacagctgtatgagccagccagtgaccaattacaatgtaaataggacccacgtgagttttgaggtccccttgagaaatggacttcagagagcaaagacatgtttcccacctctccctggggacataaccagacttgtagtagcagcttaaagaaaaggaaacaagacagcaaaggtgcctttattcttgccagaggtggcaaattatgcttcttatacacacacagcccagaataaaatcagcacaggaaaaagaaagctctgtataattatgcatactcaagtgtaaagatgtcaagtgcacaactttacaactgctctcttaaaaattaaatgcatttagacaagcaaatttaaaagatggacgtttcttgaaacgtagtataaacatgacagctacccctataaaaacaacccgggagaatttttcaactggcatcagtgaacaatgagaaattacagatctgctcaaattcatgaagtataaataaaaccagaggagaatttagcaactgaaggaattaaatggagtaaagagcacacagtaaaaatatttcctcagtacccaacacaagtatggaaagctaagaatgaggcttgaataaaggctaaaaacaaattcatcatgaaagtaggtagtcaagtctgacagcttacttcaaattaaatcctaaatcaggtaccctgatgacttaatagactgcatgggagagaaaaatgcctgctttttcaaacagggtaaaaatatttatgaaacttcaggcagacttgaacttttcaatactttttggttcagttcttagtgaaatccctcatgctataatacattgcattcccaaggcacacaatcagtaatcagtacactcaaaacatttcatgtccttaagaaaggagtggaaattctaggcagaatttctaggcactattgagaatgtgcaaaaaatggcccaaggaatctatggactcaaagaagccttaaaagtgatctagtttactcattttcagttaagatctgcataattatcagggcagggggaactgatttggggcttgtaaaaaaaattaacaaaaatgagagaaatatttcttattatttaaaaacaatttttactcattttcatcaaataagtaactgtaaattggtataacctatcttgaaagcaatgtgacaatattcagaatcatttatttcataccatttgaacgaatacatcatagtcattaaaaattatatgctgaaaaaataaaatttgaataaatgtctgccctttactgaaagtgaaaaaagccagttacaaaaatgtttgtacaaattcaattaaaaatacatcaatatatagagacacccacccacatacccacatatcccaagaaaatattagcagaacatatatttaaatgtttgtgatgattatttctgggtggtgagattatgggtatatctaatgttcttcttgtgcctttttttttctggagagagggtcttgctctgtcacccaggttggagtgcagtggcactatcatagctcactgtaaccttgaactcctgagctcaagcaatcctcccacctcagccttacaagtagttaagactacaggcacatgccaccacacttggctaattttttcaatttttgtacagatggagtctcgctacattgcctaggctggtcttgaactcctgtcctcaagcaatcctcccaactcagcctcccaaagtgctgggattacaggcatgagccacctctctaggccctgttccatttttaatgtctgaaacgtctacagcgaacatattttttattcatattttcattttagttttagttttttcttttaatggagctaagacttaattttacattgaaaaaacaaaagcaatatcaaattaatgttcattaaaaattacttatattcatcattccattacaaattttatttttatattcatcttccagcttcatcagtaagcatacacatttttacagtttttccaaattttatattgaatgttttcattgattttattgaatatttttctatgttttatctgaacttcataacgatcactttcagtggctaccaatatttttgtcttgtcaatacactataatttccggtctcctaacattgaaccattcaggttatgttcaagtttgtctgttgttgtttttttgctattatagataacactacagtgaacatgttcaaacaccttcatgtacattttttgcttctgctaaatttccacaagtagcatcactgtaacctgagagcgtgtctttatagcccttgctaaaaatcatttacaaaaatcctcaatattattagatggtacggttagtttccctctggaaagacatctgcgtgtacacccaagatgaaggtatttatttcaactctgtaagaaggctccacttaggttccttacattgctagtagcttacttatagatctttacaggtcttttccagtgtctaaaacagggaaattacagaaagttggaatgccatctgattgcttctatgttattttttcacgccttacaagctctcaagcttctgagaagagaggtcaaagagaagacagaacatagaaaaggcattttaagaacaggaaattctcccacacacgttgtcttggaggtaaacaacaatataaataatctcatttattatttgtaaaagacaggaaaaagagcatcctcaagggacaggggctcttgttgcaaaggcagcacagggtcacagcctgagatgatctacttcctacttatattaacagtaagagacatacacatgcagatgaccatataacatcatggctctgttgctggcccttcaaacgacaggctggtactgtaccagccaatctcagcccacagccacaagaacacagaacaaattctgaacattctgcagagctaattcctcaggctgccagcctggcacatctcatctcaccgggcagcagaacactgcaccagtggcaaggtggtgactgctgattctcctgctggtggaggcaaactatgcagggaacatttgcatacttttaaaggattttaaaagtatgcttttaaaggactttaaaggtgggaaggatctgagaagatatctactgaaattccctcattttataaatgggaaaataggccctgaaaagcggcagatagtggcagagccaggaaaataacccacggctgcagggttacaattcagaactttttccactattcaagcacttcccaacagctgtttcctgacagttttccataagatggtagtaggtacggagaataaaaggttcccaccatcaaaggagtcacagtagttaggaaagcactgggttactcaaagttaaactaatttttaattgcaggacttctgagaatcttatcaagtgtatggtaagtcttgagtaacgggacagatagtaggcacttgagccaagtggctaattctgggtgccaattttggctctcctattacatcactagccatgtaatgttggttggacaagtgactttcctctctgagcctcagtttcctcaatcagtaaaattagtatactatgaaaatttctcatataggctcgctaggaggatataccataacaagcactcaacatgtagttaggtatatgtgggtaatggcacatgactacgaatctatagaataggttcatgatgctatctacgcattccgcaaatacttggtgagcatcttctctatgccactcctgtgctagcccccggggatacagaaccaaagtacatcattgagaagggaagacaaacaagcagatgatttcaagcctgttctaagtactgtggccaagagaagctcaatgagctatgggagccaaaggtggggcacccaatcaaagtcaggggggtgatgccctgacagtgcttcctgcgggaggtaagaaggaggagcaagtaaggcagggcaggagtgggaagggcattccacacaggaggccacctgtattacaggtgtacttgaactaatccagaaaacttgggcatcaacattttttgttaaataaaatgtaccaaagatcttcagaaccttagatctggaaggatgccaaaaagttacttgattttaacctgtacctaaaagcatcccctctatagtgtctctaggatgaacagaaataaggtaggatgaataccattccctatttgacaagggaagtccagatttatacctgttgatagtgggaggaggcagacaaatgcctaggcaaatagagatgggtcaatggtgaaaccccacctccaagtggaagacagtttaaagcctgaaagccaagctttaagtcaaagccacagaccggattgagaacctgccttcccatttggcacactttcctctgattgatccccatccttcactaattttacatatacctaccctttcctaattggttttctacactgccatgcccacctttgagtggtgtctttgctttagcctttctttgcatacacacaaaccaatcagcatgcattcccctattctgagcccataaaagccctgcactcagccacactgagagagaaaccacccaactgtgggaatgggggaccacccccatgtcccctctccactgagagctgttgcgtcgctcaataaaatttttctccgccctcctcactctttgattgtcagcatatcctcattcttcttggatgtgagacaagagcttgggacccactgaatattggagcagaaaaggctgtaacatcatggccctctgcccttcaccggcacagagcagccaccccacatgacagaaatggtggtgaggccaagctagccctgaagtcacagaccaaggtggggcaagggcattgctagcaaggtatctccggctggcaaaagtgattgagaaaagtcctaagtcagtattatccaagcataattaagagcatcccatttcgctgtcaaaagtgtcttgatttggacaataaattatgaagtcagtctatgaatagatggtcccacagtctcagcttgaacaatttgggtgacagatatcacttcctggtaggcagtccctgtcatgttcagatcattctaacagagttcccaatctatagctaaactgaaatctgtctcctggagaccttccctctgctgtccctttctaggttcccagggatcagatggaatagatcaagttctttttccatcatctttcagacatttgtagaataatcataactcattcacctcttagtctttaggttcagtaatttattcaacctttcccaggaactccaatctcaaattaagggcatcaccatctccccaaaacccaggagtcatactagattcctgtcttttcttttctctctatgctttcagaggtacttccaaatatcagatcacttcttagcttctctcttcctaccacctggttcctcagacccatcatctctcaccaggactatcacaaaaccccatacagaaccagagtggtctctttaaaatgttaattagatccaatggcttctaactgtgtttcagatgaaaaccaaacacctttgaggcctacaaagctctatgtaatccaaccctgcctacttctccaacctaaccctgaccctacatcacagtcccccttgttcctcaatccctccctactggtcatgctagccttgctcattgtttagatttcagctcagatgtcatcacctcagagagaccatcaccaatcctataaataaaagacccaagagcacaactgcattatactctaatcattttctatccattattctgttttatttgaatcgcagtccgtcatcacagtcagttataaatttacctgtttagagtctgttccttattagaattataacctccatgagaataaggatttagatctagttatctgttgtatctatggcacttaaaacacaacctagcccctagtacatactggataaacattatttttcatgaaaaaagtcctctgttccttaggtttgcatgatttccaaaccccaccccacccctgggtgaccctcttccgcataaacatcaattttaaatagtctttcagtgggatatccttttgtgccacttcgtgggccattgttgcctcatctataagattttttgccagataattctgaaagtttcatccattccaaattcttatttttgcataagtttctcttaaagctagacatccctcagcatgactctctactcaacagtttacctttgttttcccacagaggccgacgatacagagtccaatattcgaggggcagggaacatcagaatcattgttacctcttaatctaagttaggcctcaaaagaaccaagacatgaaaagaaatttaaggtcacattaaacaggtatttcaaatctgcacctctgggaccccagcatgcctcacacacactcattcagatcaggtgtcttggagcaggttagaaaaaaatattgtgtgccctgttatcctattatattaggttctcaccttccagggttatcatgttttgcttcctgagcttatgccacacactggctcctaagtcaagtgaacaactactcttttcaaaaaaagacacaaaagacagtgttaccttcttatctcatctagtcagccagccctggcctgcccttcccgaataactcagttaccgtgaacccaccttcaccctgttgacggggccagtgttctctccccaaggaaaagctgactttacaacatgaaatgggtcataccaggtctgagccctgctgctttcaaaaactaaatgctcccatagatgatattcaaatggcattctttcacattttggcatagtacctggaagacagtgggacatctagagttgtatgctgaacacacagaccacatcttaagccagaaagcaaattgtcacagaaggaattagactcacttccatcactagaagtcaaagaacacaccccactgatggataacagacctcaagaaggcatgaatacaaatgacaggtcaagagatatgtcaccatacatatccagaacaagtgaaagcaggggttcgaaggaaggacattctgatacatactacaacatggatgaaccttgaggacgtgatgctgagtgaagtaagtcaggcacaaaaggacaaggattccacttacgtgaggtacttagaataggagaattcacagaggctcaaagtacaatggaggtcaccagaggctgaagagttattgtttaatgagcatacagcttctgtttataatgatgaaaaagttctggaaatgcataatgttgatggttgtataacactgttaatgtacttagtgccactgaattttatgcttaaaaatggttaaaatggtaaattttatgttatgtatagtgtaccatacacacacatacaaagtatgttattagtatattcctccagccaaggcttctaagataatctaagaggatttatttcatagtaaatttcacaatttggtattccacaatagtaaatcttttcaaaacatcattgtagcttggcagaatgctatatgaggcattaccaaatcttataaatgcgcaacagtaaaggaaatttaacttaattttcaattatatcaagcaaagagatagtccactggaagaaactagaacaatgtcatttactaaaaggccttctatgtgctaggtactgtaccaggtggtactgtatacattacttgatttggtctttgtaacagctctatggggtagcattattataagagattgattaaaacaagtaaaatactagtgaataaaaaactacaatgttgtgctggcatgaaaaaaatgaatgaacagagttgcagaatgatcacgagctttaggtgagacaaaacttacagtctgttcctaaccaggttgattttgctggaaaaaaaaattccctagagaattgtaacaagccccagagacccgatactggagggaaaagaatatgaacagatgccaaccccaagatgacccagaagttggaattatcaaagactttattttttaaattttcttgagacacactttcactctgttgcccaggttggagtgcagtggcgtgatctcagctcactgcaacctccgccacccaggttcaagtgattcttatgtctcagcctcccaagtagctgggattacaggctgcaccaccacacccggctgatttttgtatttttagtagagatggggtttcaccacgttagccaggctggtcttgaactcctaacctcaggtgatccgcccacctcggccgcccaaagtgctgggactacaggcttgagccaccgggcccagacaaagactttaaaggagctattacaatcatcggctatgaagcaaaggtgaatggtctcgaatggaaagataagagctctcagagaaaatagggaacctgaagacatatcaacagaaggtacacaatctgaagaacacagagaaaagactactttaaaataatgaacaagcctaaggaacctctgggatactatcaaaaggtctaacatttatgcactggagtcccaaaaagagaggagagattggtgtttaaaaaaagtgaaataatatctgaaaaaatcccaaatatgattaaaaacataaatggacacatacaagaatctcaagaaaccccaaataggataatccctaagaaaacatgtccaaatgcatcatcatcaaactgttgaagataaaaaattttttaaacttgaaggaagacataaaataatgccacaatacatgtaagagaagtgtttgaaatgactgtcatcagcaatcatgtagaccagaaaagattgtgaatcaacatttgtaaagtgatgaaagaaaggacctgccagctcagaaaattcccttcaggaatgaaggtgaaataaaaacatcagatgaagaaaaactaagagaattcattaccataaggcttactctaaaaaaagtactacaggaagttttattttaggctgaagagaaatgataccagaaggaaacatggaactttaggaatgaaggaagagcaacagaaatggtttggataaatataacagactatttttcttctttaaaatatgtacgaggcggggtgcagtgatgcacatcgataatcccagcagtttgggaggccaaggtgggaggatcacttgaggccaggagtttgagaccagcctgggcaacatggcgaaaccccatctctatttttaaaaagtaaataaataaattaaattaaatatgtatgagtattgcaagaaaaacagcagaacatagtctaggttttttccaatgtatgtacatgtaatatatgacaactctaacacaggggatggggtagtagagtctatatggttataggacacatttacttaaagtgttaaaatgttaacactataatgtcagttgttatgtacgtatattatattgtaatccttagagctaccactaaaaataatactaaagatatagcccaatagacaacagaattacaatggaatactgaatacatatagacatagatatagatataaacaaaaacattcaaaagtgaggttaagagacattggaagatggagtgaggaggtctagccaacatctaattggagtttcagaggaaaataagtgagaatagagaaagggcaatattcaaaaaaataatggttaagagtagagcagagttgttaattaaaaaaaaaaaaacttcccaatgtatgggttaaagaagaaattataatggacattagaaaatatttagcaataagcaattgcaaaactattaactgtagctccacaaacacttgcagaactcatgaaggagattaacatgctacagatcctggaaacccagtgaaactcaagcaggataaatacaagaaatcaacacctagaataataaagacaggagataaccttaaaatcagccagagctgcatcacctaaaaaaaaaaaaatacaaaaaacaaaaaacaaaaaaaacccaactgactaatgactgacttcttaaaggcaataataaataccagaagacagtgaaataatgcctttagtgtgccaaagaaaataacttccaacctaaaatttttacttagtgaaagtatctttcaaaaatgaggtacttaaagatatttcaaataacaagaaagtttactaccaacggatatcctttaggcagaagagaaattgatctcagacagaatccctgagacgcagaaaggaatggagagtacagatattagtaattataggagtaaagaaatactgactacataaaaaagtattaaccatgtctaattagtggaggaagaaaacaaattagaatgaaagagtggacaccagtaatacgtaagttggataacgatgactagagtaaggtcatgggattattcaacagaaaagttaatggaataataaatgttaaactttatactcaagtattaaaattgattaactactaaatgaggagatataaagtatatgacttctaagaagacaagcacagttggaataagaaaaataaaacacaggccagaaattgaggaaaaagaagagacaaaaacagaataagcagaaggcaaagaataagatggtagaattaaatccaaaaatgtcaatagccacaataaatataaaagaactaaagtcttaactgaaagacaaagaatgcattactttcaaatgcagctatatattatttacaatgatatacccaaaaacataaagatacaaattaaaagtgaaaagaaggctgggcacggtggctcacacctgtaatctcagcactttgggaggctgaggtagggggatcacttgagttcaggagttcgagatcagcctggccatcatggtgaaaccccatttctactaaaaatacaaaaattagctgggcgtggtggtgcactcctgtaattctagctacttgggagactgaggcaggagaatctcttaaaccctggaggcagagattgcagtgagctgagatcgtgccactgcgctccagcctgggcaacagggcaagactgtctcaaaacacaaaaataaaataaaaaaataaaatgaaagtgaaaaaaagaaaaagtatatattagacaaatactaaccaaaagaaagcttgtacacctatatagtagataccagacaaaatagactttaagataaaaatcattatcaaagtaaaagagaatctctatataataaaatgttcaattcaatggtaagacatgcttttcttactattttaattatttcattttataaatagcataaaaacttttttctcataaaaatatttcaatattaatttcaatagctataagagcaaaaaaaaaaaaagatctcatagaaatacatagattaaaaagaaagatgcacctcattaatgacaaagattctctccttgactaaactctaatgaggctcctctgaactctcctttcaactaggccctgagttttgggcttccaagctcatctctgcattgtccagctgcaccaagaatcctgctaagtcagtttgcctaccctcaaatgtgtgatcacccttgatatctgatcaaactcctcatccttcccagtcccccaggtgatgtctgatcacactgacctgccttcagcaagaatcctgttaggccagttgagccagaacccctacttacctctgatgtttcctcttagtaatttttcatctgaggaagacatacttccaaacttacatacgcttagtaacatagctttaatatatataaagcaaaacttgacagaatcactaagagaaattatcaaatctatcatcttaaatggagattttaacaacactctcagcaattactaagatcaagcagaagggaaaaattagtaaggatatagaaaatttgcacagcaaaattaacaacttcctataatggatatgtatagaatattgcacccaattaatataaaaaattatttgcaaatacacgatttatttatgaaagttgacccctggtaggtgctaaagacagccccaacacatttcagggaccaatatcataagggccacattctctgattacagcctcattgagttagatctcaggaccaaatgatagcaaaatagctgcacgctaaaaagtaaaaatcttataaactatgtgttaaagaagaaatgataatggacattagaaaacatttagaaataaacaattacaaaactactataacacttgtggaactaaagtggtcacttagacatatgcagactaaaatgtttacattagcaaagaagactcaacaattttaaactatgtattaaacttaagaagtcaaaaaaagaatagcaaagaagttaagtgaggccgggtgtggtggctcaacgcctgtaatgccagcactttaggaggctgaggcaggcggatcgcttgaactcaggagtttgggaacagcctgggcaacacagcaaaactccatctctacaaaaaaatacaaaaattagccgggtgtggtgggcgcactcctatagtcccagctactcgagaggcagaggtgggaggatggcttgagcccaggaggtcaaggatgctgtgagcagagattacaccactgaactccagcctgggtgacagagccaaaccctgtctcaaaaaaaaaaagttaagtggcttttcccaaaatcatttgataaatggcagagctgagattcaaaaccaaatctctctcactcaaaggctatcttttccttatgacttttccaaataaacaagtgggtttgggcaagaaaagtcttagtggtctcataagagaaaaaaaaatctttcttaaatttctttttattttttaatttttattttttttttaatattagagatgagctttcagtatgtctcaaactggtctcaaactcctggcctcaagcaatcctccgacgtcaacctcccaaagggctggcagaagccactgcacccagccaagaaaaaaaactcttaaagcagaattgaagttttcaagatggtgttgcttaaactactagaaaactaaaagttcaaacattcaaaatgatgctgagcaggctgggcatggtggctcatgcttgtaatcccagcactttgggaggccgaggcgggtggatcacgtgaggtcagaaattcgagaccagcctagccaacatggtgaaaccccgtctctactaaaaatacaaaaaaattagctgggcttggtggcgggagcctataatcccagctacttgggaggctgaggcaggagaatcacttgaacccaggaggcagaggttggttgcagtgagctgagatcatcacaccactgcactccagcctgggcaacaagagcgagactctgtctcaaaaaaaaaaaaaaaaaaaaagatactgagctatttatctgacttacatgtgttttgagttattttaatttacttttcctatgtactgaaacttgcccttctgaatactttctggcttagtttacattgaagttaacttagtaaagcttttctaaaaattattttggggagtgtgaccttagaattccgctggacctcaaggcatttctcattacaacccacacacattcaggtaactggatcgcatccttattaacagttctctttctagtttagagttgtcgtgcagttgtgattaaataacagcgggtcagactgcattattctttgccttctgtcccagtccagtgtcatccaaataacaaagcacccagcaccacttgggcaggatatgactgcctagaaattagtttttactgcagggggaaaaaagatgcttggtaattctcatccttcaatgaaagtgactttcagttgaaagaacttaaaatagcctactcctctcatttgtcaaggatacttagtcaggaatttgtttccttaaactgttgatccagaaagtgccaagctacaaatgaagagagaatccttgttcctcaagctcccaccaacagcaactgttttctacccagcctatggctatcccttgtgtcaaagttttacgagtcatattaataacacaattatgaaatcaaaacagtctttatcttaaatactggaagtatatcttaaatactatcctttttttcaagaaaggagggttatctatagcaagggtccccaacccctggaccacaaaccagtactggtctgtggcctattgggaaccgggccaaacagcaggaggtgagtggcaggcgagcaagcaaagcttcatctgtatttacagcccgctcctcgttgtttgcgttaccacctgagctctgcctcctgtcagatcagtagcggcattagatcctcataggagtgtgaatcctgttgtgaagagctcatgtgagggatctgggttgctggctccttgtaagaatctaatgcctgatgatctctcactgtctcccatcacccccagatgggactgcatagttgcaagaaaacaagctctgggctcccactgattctacattatggtgagttgtatcattatttcattatatattgcaatgtaataataatataaataaagtacacaataaatataatttgcttcaaacatcccaaaaccatcccctcccctgccccacatccgaggaaaaactgtcttccacaaaaccagtcccttgtgccaaaaaggttggggactgctgatctgtagtataatatccccccaaaaaacaaacactgctacaatagcaaaacttgccttaatcccttctgggacttaatatctataccttttaagattcttgtctcaaattaaacgtccaaataataatcatgagtaattcatgattaattcatgattattacttcgataataatactctgttttaaaccattaaattcaccagtttaagatatttttacacacaaactctgaaagctagctcaatgttttacctcaaaactacataaaaagaaaactagctgagatggcaacagcatcagcaaagcttttgaatctcgcctctctacgtataaaaccagacagaacaactagagagcaatacccaaaacccaggaacaatgtgcacagcaaatccatgtgacaaagtatcctcaccaaacccagaacgcaaacaggtgaagaaaaaccgccaacggccatacaacctgcatggtgtctgtggctgggcagtggttgggcaggagaaagaaaagaaagcaacaggaaatcagacctgtgaaaaggaaaatcccaaaagagccaacaggcattactggaaagcatggagggacagtttgacaacagtagctcacactggaaggaattttgcccactccaataaggagtaggtttaaggggcccatggtaagaacgtgtgaaggcactcaaacagttgtgcaccatgaactcttttttttttttttttgagacggagtctcgctctgtcgcccaggctggagtgcggtggcgcgatctcggctcactgcaagctccgcctcccgggttcacgccattctcctgcctcagcctcccgagtagctgggactacaggcgcccaacaccacgcccggctaattttttttttgtatttttagtagagacggggtttcaccgttttagccgggatggtctcgatctcctgacctcgtgatccgcccgcctcggcctccccaccatgaactcttgaaactgacctgccagggttcccttccagaatagagcctcacaccaaggagaaatctcaagagacaaaaccaaactcctgaaatagagggacaagagagaaaaaggaaaaaaaaaaaaaagagagagaaaaaggaaagagaagtagtggaggaggggaagaaatccaggacatctcagaagacaggaggccatcgtttaaacactatgttgagaacaactaagagggagttcagtgaagttacaaagctaccctgaaccatgtctctttctaaaagttcagaaaaactgagttcaaatgcaaatgagcaacagaaaagactcaagctcaaatgcaatccaaatttctataagaagtaagagaagaagcagcagaacaacatccttatgaataacaaatgcagtcaggaagaaatgctcaaaaaaaaaaaaaaatcacaacatggtgttttaaaatgaggtaggccgggcatggtggctcatgtctgtaatcctagcactttgggaggccaaggcagatggatcacctgaactcaggagatcgagaccagtctgagcaacatgacaaaaccctgtctctgttaaaaaatacaaaacattagccgggcgtggtggcgggcccctgtaatcccagctactcaggaggatggggcaggagaattgcttgagcccagtaggtggagggtacagtgagccaagattgcacaccgcactctagccttggtgacagagccagactctgtctcaaaaaataaaaatttaaaaaatgaggtaaatggcatgaagaaaatgatgcaagagagaacaaaataaatcagaatccacaaactcagatgaggtagagaagtcaagtagcaactagaaataaaataaaaagtcatttcagaaataaacagataattaaaagacacagaagacaaaagagaagaaaaaattaaaataaaaagaagaggccaggcatggtggctgatgcacgtaatatcagcactttgggaggctgaggtggaaggattgcttgagcccaggagtttgagaccagcctgggcaaaatagtgagacatcatctctactaaaaatcaaaacaattagccaggtgtggtggcatgtgcctgttgtccccactacttgggtggctgaggtgggagcatcacttcagcccaggaagtcaaggctgcagtgagccaagatcgtgccactgcactccagccagtgtgacacagcaagaccccttctcaaaaaaagaaaaagaaaaaagagagagaaaaaaatgattaaaaagaaagtgataaacactgaaaatgggtaaaaagaattatgtaaagaaagatataagaagttcctaaagaataaaacaaaaggacacacaaaatagtaaaaagtataacagaaaaatttcctgaagtttaaaaaaaaattgtgaaactagatattgaaagcttctaccccatacctgagaatactgacccaatgacaaacaccaacacacagtctagtgaaatcactggatactaaagaacaagaaaaaggaaaatcgttgggtattcaggcaaaaacaactaattttcaagggaaaaaaatcagattaccatcaggcttttcaatagcaatgctttattccaaaagaaaaaaaataaagtatgtgagctactcaagaaaaataaatgtgaaccaaagatttcatatccagaaaagttgactttaaagtataaagagcactaacaaactgttatcaacgggcaaaaactcagggcatattgttcccatggccacttcctgaagaatctagttgagaatgagcttgatcaattcaaatgactagagagacatgatcacagagagtattaaacatgtatagtcacttgtagaactgagattagttgagagctaaaatggaaagagtactctctataatggacatatgtttcaataatacagaaatagtacagtattttaaaactaggggagaaacaggaaaagcatatataaatgtttgggagttttaaaaacctattctcagtaattacactggggatggtagcattagtattattgagaccactgtgtatgtaacctgggataaaataaatgcgtgattatagactagtctatcatcccctgtgtccttgaaaaccagtattcctgctgtggaagaaaggagatagatgtaatacagaacaggttaaactaaaaatcacaaaatggaagtatcagtgtatactcattttggcattttatctcagtctgtccactgcagaggcctagaaacaatgaccaacctaatagcaatgagcatacccagggcctagacagggtcctcgaaatactgttttctactacaagatactagagcttcttaaagaaatggctttaaggatgaggggtaggggagggagcagatcttggcctcacaaaaagcaaagctatgaagccatgaagccatgaaggactactaggactgaagcactgctaggactcaggacagttgcttaaagctggggatgggaatcggtaatgaccacaaatgggcatgtggtttcttttagggctgatagatatgttctaaaattagattgtaatgatatagataaatttttgatacaaccccaaaataagtgagttgtatcaatggtcagctttctagttgtgaaactggactatataaaaaatatggaattatacacttagtatggtaaaacctatggtatgtaaattacatctcaataaagctgttggaaaaaaagatatgcccaaaccttcaaaagggatcatggtttcagtgtaaaataaaatatggcttgtttttgttttgttttgttttctccccagagacagggtctcactctgtcacccagcctggagtacaatggtgccatcacagctcactgaaacctcgaactcctgggctcaagtgatcctcccacctcagtctcctaagtagctaggactatgaacacatgctaccatacctggctaattttttgtattttttgtagagatggggtctctctctctctctcttgcccaggctggtcttgaactcctggcctcaggtgaacatcctgcttcggcttcccaaagtgctgggattgtgggcatgagccaccatgcctggccataaaatatatttaaatccatgagttcatgaagacttttttaaatccagtgattacacaaatctacatttgtggcaaaattgtacagaactaaatatatacacagacacacaaatgaataatataaaactggtgaaatcagacaaaaacaagtgggtcatatgaatgctcaattttccagctgtgaaaccgtactatagttatataagatggtaccattggaggaaactgggtgaaaggtacaccagatctctctgtattatttcttacactgcatgagaacatataattatcttaagatgaaatatttaatcaaaaaatactctaattggtcacctttgaagaacagtagggaaccaattcattatcttaaaagctagtaaagaatcaagcatttatcctatctgtcctgtatgacctgcaacaatggttaagaaatagtagatgatggaactatctctttatgaaagtatctccattaataaatgaaaaagattagattatcaccatctaatatggtttggctgagtccccatccaaatctcatcttgaattatagctccaataatcccacctgtcatgggagggactcagtgggaggtaactgaatcatgggagcaggttttcctgtgctgttgccatgatagtaaataagtctcacgagatctgatggttttataaagggcagctcccctgcacaaactctcttccctgccaccacgtaaaacgtgcatttgttcctccttcaccttcagccatgattatgaggcctctccagtcatgtggaactgtgagtccattaaacctctttttctttataaattacccaatcttgggcatgtctttattagcagcacgagaagagactaatacaccatcttatgatagcccccaatggattaatggattaggtactaagcatcaacagccgctaacattataaaaagaagaagcaccagacatcaggtgcctcatggggaaagaacccaccaattatctgatgtcttactgtagggttcaaacctgagtctgatcacacctggggatccagctaccaacttgcaggaaatacagaggacagagagaacagatgaactgcaccatgacagggcattcagcaaaatccagactgcaggaaagtctccaggctaaatgtcctagattcttcaatagataaatcattgtaggaaaaactagggggtaaggggaagcaacacaatgaaagggaaacctgtagaagagtcttaaaagacacaaatttcctttaaattagcaagattaaactttgcatgtacacctgggtaataatattataaagaaatgcaaagaagtgtctactttgagaagcagggtactggctactttagggacagagaggggtgatgattaggatgtggcacctggatggggctgctggggtaggcagaaaaattctaattctggacctgggtaatgcttacaggtacgttcaccttaggataactcagtaagctgtacatttgtgttgtgtgattttctgtatttgtcttattttaccaaaaaaagatttttttaaaaaaaaaggagaatttatctcgcttttataacctgtcataaatagaatgcaacacttaaaataattacatgaaaataaaccatattattaactagctgtggtagcctgaggacacttccaaggcctcttctatgttaaaaggagagtaaaagtgtagtcaagtactaaggatatgctagcactcaaacttgcaagattcaggtctttctttctaacttaatcaagtcttgaaagacacctaaaaggaaagtgctttctcactatgtgattcagtgagattggaggcttgccaatctaccacccaaaatcatctcccctactgctcaaatttacctcgtaggccaactcacatcttactcttctggagacactgggttacaaaaaaaaaaaggtctggtgcagtgaatgaaggtaagtcagaccttatgaggaggatgaaaaaacaaaaacttagctctccctgatcattgacacatttatgttacttgttcagccctttctaaataagcttaaaaggtttgcttttccattatcagcagttaagcaagtgaccaacactacaacccagtgagagctgcctgtcctcatcctagtcacaagcacacacactttactatgtactcaacaggcaccttcacagcctagcaatgacccacctctgtcttcatacctaatgtgtttggaggttctcaagtgacaagaggccctgtatctgaaaaggcaaattacaaaaataagcgcaaacgcccaccctcacctgaactcagtatcttaaaataaggcacatgtcccaagctgctggctaatcaacaccagcctcaactgacctcaaagccctttaaaaaaaaaagtagggcggaggggaatatcagattacatattagacttataaacttgtaaggagcaaagaaagctgtgaaattcgaatggagctcaatcacatttttcaaacatttatctaaaacacatattaaaaagtggctcaattcacctatatatgatctgaaagcaagtcttgttttacctcaccgtttcccccacatttttctatattaaagagaaagcaaacataagccaggacagtttcgtttttcttgcactgcactgctgctcacgagaggacagagtgaggcccacccacagagatgaagcgcagacaggagctaaaaggtaacttgcattaaaaaggaagatgagggctggattccttcgtcttcaatgcctctagcttcatcagcctccctggagtgggcagacccccgtttccttccctctctcaccatctcctatcccttctgcattctctaccctctttgttttgtgaaccctcaacttcccagcttaccctcactccttcccttgttcttatattttcaagagacatgtaagcaagcaaatactccaacatacacaaacctgctaaaatgtctggaacaagaatcccaagttccactcatcacaaagctgcttgtgaaaatctactccaccgtttgtttccatgtctgagaaaaacacacctcatctgcattccctggatcctccatatgggagggtacacccctgcatgtaaagaaccagttcaccacctccatttttcatgaacattcagaacaaagggctcctttcttgagtgctactctgatcccatgaattcaaaaatgtttaaggaagctctatctccacaccagcacctgaggagatggagacttttagaatagaattttaaaatgttctcattgagccctccattctagaaatggctataagtaaatgaaactcggaagtgtctggagcctactgagctctacctagcaacactgtgtgttccttggcacacaagacagaaactcaaggcagacccatcacttcctcagataccatcttgtcccattttccttaagataaggtgtcctggtccatgggcctattatttggggtcaatcctcagcaggagaatggttaggtgttacagggagaggaaggtgacacatgtggtttggatttttcacccaaacccttttcaatgagccttagagaaatacaggagcctgttgaaacattacttactgcctgttgaatattggtcttcacttgctcactcaacatgccttcaaagacaaaggagtcgccaaacttctcagcctataaggaaggtaggaaataaaaatccagaaaaggttgtagtaatgtgttgcatgtgtgcccttttctctccacactattaaagtgattcctcttgtccaattgaacttgagtctttcttatgacttcccagaggactcagaaatgacctaaaagtctctggcttcctcttaaattaatgtcacttacagagaccattttcgtttaagactcacttagctgataagaatgcagactgaacaagattagcttttgagaacgtgactgttcttgaaggaaatacatttccccaagtatcacaaatgactctgggaaatagtattctgtacgtgtgagattacataatcaatctttgtcctttgtcctgaatctagctaaacgaattaaatagcactgtttgctcacattctgacacattctagttccactaaggggtcaaatgtgcttataaatctcaactggccaattcaagcatcaaatggaaatctgtattttaatgattttatttaacattagtgtctcaattcttcatccacctgattatttttgttgcatgtaaccctattctgaaaattaggtcgtttgtcccttggtaaccatgactctcctcctacatttgtcagtgttcttattcatctcctaaaatatgtgggctcttgtttcagccactgaaacactgctgctccccagagctctgcccttggctctctgcaattctactacaccagtggctctcaggctttgtgcagttgagattatgtaatcagctggttaaaactacatattgctgctccccaacaccagagattctcattctgggggtctagggtgaggtcaaggagtctgtgtgtgtaaatagcacacagctagttgttctaatacaagtagttcaagagatgcactttgagatacactgatcgattcttgttgatggacaactttcaatctcatcaaattaactatagccagtactccaaatgactctcaaatctctacctctagtgctgtcctgttcttactagatgaaattaactgagtactggatccttatattgcagatcttacaagcatctccaactccttttccggagtggaggctgccatcttttcttcacccctaatcttcttcctgcattcccttgtgacactgccatgactaactacctaagccatttagttattcaacaaacatgtatcaaacacctaccatgtgctcagtttggggctaaattaggggatataaggtcaatatcagatagccatggcccctatccttattgtgcttaagtgtgggagcacagaaaaaaatcaagccaaacaacgaatggaagacaataattataactttactacaccttgtaaggtagagtgtcatgaaaaactttcttgagaaagtgacatttaagctgagatgactcaagaatgagaaggagccaaccatgcagaagggggataagcaagaggactgcgaattccaagcagagagaaaatacgggccaagttcttgaggtgggaaagaatgttgagttttcaaggaatagaaacaaaaccagcagggctagaacatagtatacaagaggagcatgatataaagtaaagctggagagatgggaaaagagtgccattaaaaaaacagagcattttgtccaaggcagttcttggtcctttttgagctccttggcagtatggtgaagcttaagaacccccttctcagaataaaatgtttaaatgcataaaataaaatcaataaaaaaataaaataaaataaatagtattatgaagaaaagtcattatatcaaaatattaataaacaaaccagtgctatagtattaaatatgctcttcattaatatattaaataagatctagtggcaggtctcataattatcatatttcaaagtggggatgaatgcaaacaatatttcaagatctctgcaacaacaaaaatatgattaaaaatgtctgtgatttctactggtaacaaagttagaggtactgctactactgctgtggtttgctgtttgcatcataattgaagaaaatactacattgtggctcgagggtagtaaataaccagatatattaggttgctgcaaaagtaatcgcggtctttgccattaaaagtaatgacaaaaaccgtaattacttttgtaccaacttataacttttccctatccatgtttttagatgccccaaattctgcttattctatctaatcttcatggagaaccctggttctgtagaagtcttctaacttaagtaaactattgaggaacctgagctgagagtatctctgtgaaaccaaaaggaaaaggacttctgcttattacgaatgtgtacaaaaacggtttttttgtttttgtttttgagacagagtcttgctcttcttcctggagggcagtggccggatctcggctcactgcaagctccgcctcccgggttcatgctattctcctgcctcagcctcccaagtagctgggactacgggtgcccgccaccatgcccggctaattttttgtacttttagtagagacggggtttcaccgtgttagccaggatggtctcgatcgcctgacctcgtgatccacccacctcagcctcccaacgtgctgagattacaggcgtgagccaccgcgcctggcccaaaaaaggtttctaaccactttatatatttgagaaaattccaaagaaatgtgacaatgcaaaaccaaatctgaaagttgttttactttaaacattcactctcaaattattcatttaataataatttacaaaaagacatttggggtcttaaaaaaaaaaaagaatagggaccccacgaactgaagacaagagtaaaggtttttcgtgagagaaaactggaaagcatataaaataagtatatttcagaaactgacataaacattcatagactagaaagctttcctcttcctattcccatttaggaaagcatccactatcagaaccttgctttgtgattcagtgaccaccagatgatgtctggaactgctatagcacagcatgtgtgagttgtcaaggtgttggaataaagacacgaaaatgaaaagctgcacttctgcatttatcacttaaaaaatatgaaatgcttctggaaaaaaacaaactgcaacttactgagaagaaaagtggtcttactttacatgccatctgttatctcaaaaagccttagtggacagtggtattctctgacacattaagcattaacacaatatagcataatagttatagcacatgttctgaggtcaaactggccaggctggaatcccagctctaccaccaactagctgtgtgatgtggggcaaataacttttcttatcctcagtatgccacctgaaaaataacctgcctcatggggttgctgtgagaaattaagatgaaatatatacaataaaatgcttcacacagttctgccacagaatgcagtaaaaatggtcagtcaatcttagctgctattaaagcattcttaaaagttctggaaaagaacaagttctccctcctttccccaatcccattacctctgtcaaatagccagttgagttcacaaacttctcaaattcagtattactgacttcataggcatccatgtaaaaggcatcaatagtaactctcctcgcaggtgcttccccatcctgctttatctgaggatcatctgtgcccattgtaaatactccagcagggatggggaccatctacaatgaaaggtgaaacacaggaagtcatgcatcacagccaaggtgtacctgtgtaggggtaaagttcctagcacccaggaagcacgcaagtttgtaaatcttcaccacagtaataactgtaaaattcggaaaaatctctctataccccaaagaaggtgaatcacgagtctcaaaaagaagtgaaaattctttaagaaggtaatctccttaatcaaaccactacttgatacaaatctgtacctgcactggaaacaggtctggaataacagtcaccaagccgctaacggctagaatgcagaggtagcgagaatatcccacttttcttttttttttgagacaggttctcactcttttgcccaggctggggtgcagtggcatgatcagggctcactacagcattgacttcccagactcaagcgattcccccaactcagtctctcaaacagctggagtacagacatgtgccaccatgcccaactaatttttttttttttttttgagacggagtcttgctctgtcgccccaggctggagtacagtggcacaatcacggctcactgcaacctccacctcccgggtccaagtgattctcctgcctcagcctcctgagtagctgggattacaggcgcccaccaccatgcccggctaatttttgtatttttagcagagacaggttttcaccaagttggccaggctggtcttgaactcctgacctcaggtgatccacccgcctcggcctcccaaagtgctaggattacaggtgtgagccactgcgcccggccaagctgattttttttttaagtgatgaggtctcactatgttgccaaggttggtctgcaactcctgcgctcaagtgatcctcccacctcggccttccaaactgctgggattatgagccattgtgcccagccccacttttttctttatacattttttattcgcatatgcttttgtttcttttgaattatttttaaaagcacatgtaaaaatgcaatctataatatctttaaataaccactgcatgaattttggcctccaacaatcatgaaaaaggcttacctcactaaaatagaaagttttaaagtttactaaggggctgtttgtataattccttataaaaaccctaattgcaactactttgttcctatctaccttcccacatgaactctaaactccaagaagacagcaattggggctgccttattcacagctctattcccaacactgagcacaggatctgaggatgacactgaaaattttcagttaaaaaatgcaggtccatgctcaacatcatgagtcattagggaaatgcaaatcaaaactataatgaggttccacttcatgatcactagcatggctataacaaaaaagacacaacaacaagtgctgatgaggatgtgaagaaattggaaccctcacatattgctggtaggaatgtaaaatagttcagctgctttggaaaacagtctggcagtttctcaaaaagctaaacgaagagttatatgaccctgcagttctcctaggtatatacccaagagaaataaaaacatatgtccatgtaaaaacttgtacaaaaacattcatagcagcattattcataatagccaaaaagcagaaacaatccaaatgtatatcagctgatgaataagtaaacaaaatttggtatatctataaaatggaataatattcagacataaataagtattggttcatgctacaacatgcgtgaaccttgaaaatactatattaagtgaaagaatccaatcacaaagggccacatattgtatgaatctattcatatgaaatgtccagaataggcaaatccaaagagacacaaagtagattagtggttgccagaggctagggggaggcaggaatggggaatgattgctaatgggcatagagtttcttcttgagatgatgaagtattctggaattaggcagtgatagttgtaacacctcataactatattaaaaaccactgaattgtacatgttgaaagagtgtattgcattctatatgaattctatctcaacttttttcaaaaaccacaggccttcaaccataccatctgtcagaaatacactctttacagacacaatgtcttattttcaaatcatttgagtgagccaattaatagactcctcagcagcttaggaattgtcaagttcctcatctataaacaagggttcaatatcacagaataaaacggatcataagaaactacttataaacaattatatatctacaaatttgataaccttgaaaaaaatgaataaattcctagaaacatacagcctacccagactgaatcaagaaaaagtagaaaatctgaacagactgataacaaataaggaaactgaataaataattttaaaaattggccaggtgcagtggctcacacctgtaatcctagcactttgggaggccgaggcaggtggatcacctgaggtcaagaatttcaggccagcctggccaacacggtgaaaccccgtctctactaaaaatacaaaaaattagccgggtgttgtggcacacgcctgtaatcccagccacttgggaggctgaggcaggagaatcactggaacccaggaggtggaggttgcagtgagctgagattgcaccactgtactccagcctgggcgacacagcaagactccgtttcaaataataataataataataataattttccatcaagaaaagcccagaaccagatggcttcatggcagaattctaatttaaagaagaactaataccaatccttctcaaattcttccataaaattgaagaagaggaaacacttccaaactcattttatgataccagcattacactgacaccaaagccagacaagaatactactagaagaaaaaaaaatacaggccaatatccctaatgaacatagatgcaaacattctaacaaaatactagcaaagtgaattcaacagcacattaaagggatcatataccaaaattaagtggggtttatccctaggatcaaaggatgattcaacatatgcaaactacaaatgtgatataccatgttagcagaatgaaggacaaaaccaaatgttcacctcaatatatgcaaaggcattgataaaattcaacatcttttcatgagaaaaactcttgacaagttaggcattgaaggaatgtaccttaacatgagtcatatatgaaaagcccacagctaacattatactcaatggggaaaaatggaaacctttgcctgttagattcagaacaagccaaggatgcatactcttgccacttctattccatgtaataccggacatactagacagagcaattaggcaagagaaagaaagaaacagcatccaagctggaaacaaagacgttatgttgtccctgactgtagatgccatgtttttctttgtttttttttttttttgagacggagtcttactctgttgcccaggctggagtgcagtagcacgatctcggctcactgcaaactctgcctcctgggctcatgccattctcctgcctcagcctcctgagtagctgggagtacaggcacccgccaccacaccaggctaatatatatatatatatacgtgtatatatatatatgtgtgtgtatatatatatatacgtgtatatatatatgtgtgtatatatatatacgtatatatatacatatatatacgtgtgtatatatacacacatatatacgtgtgtgtgtatatatacacatatatacgtgtgtgtgtatatatacgtgtatatatatacgtgtgtgtgtatatatacgtgtatatatatacgtgtgtgtatatatatgtgtgtgtatatctatatgtgtgtgtatatatatgtgtgtgtatatctatatacgtgtgtgtgtatatatatacgtgtgtgtacatatatacgtgtgtgtatatatatacgtgtgtgtatatatatatacgtgtgtgtatatatatacgtgtgtgtacatatatatacgtgtgtgtgtatatatatatacgtgtgtgtatatatatatatatacgtgtgtgtatatatatatattttttttgttttgttttgttttttttagtagagacagggtttcaccatgttagccaggatggtctcaatctcctgacctcaggtgatccacccacctcagcctcccaaagtgctgggattacaggcatgagttaccacacccagccagcatttctttatactaatgacaaactatctgaaaaagatattaagaaattaatcccaggccaggattcaatgtaatttctatcaaatgtaattcctatcaaatgtaattcctatcaaaattctaatgtcatttttcaaggaaatagaaaaaaaaatcctaaaatttgtacagcacaacaaaagaccccaaagagcgaaagcaattttgagcaaaaagaacaaaggtggagtaccacactatctgacttcaaaatatactacaaacctaatcaaatggcatggtactggcataaaagctaacacaaaaaccaatggaacaggatagagagtccagaaataaactcatgcatttaccatcatctgattttcaacaaaggcaccaagaacacacaatggagaaaggacaatctttcaataaacggtattaggaaaactgaatatccacatgtagaagaatgaaattagacccttatctcacagcatatacaaaaatcaactcaaactgtattaaagacttaaatgtacagtctgaaactgtaaaactactagaagaaaacattgggaaaagaagctccatgacacaggcctggcaaagatttcttggacttgaccccaaaagcacaggcaacaaaagcaaaaataaacaaataggattgtatcaaaccaaaaggcttctgtatggcaaaggaaacaacagagtgaagagatatcccagaatgagtgaaaatctttgcaaaccatgcatcttatatggagttaatattcaaaatatataaggaattcaaatcaatagcaagaaaacaaagaactcaatttaaaaatgggcaaaggacccgaatagacattgctcaaaagacatacaaatggccaacagatataagaaaaaatgctcttcacaactaattaccaggaaaatgcaaattaaaaccacaatgggctatctcctcacacctgttagaatagctatcatcaaaaagatgaaagataacaagtgttggagaagatgtagagaaaaaggaactctactgcagttggtgagaatgtaaattaatacagtgattatggaaaacaatatggaggttcctcagaaatctgcaaacagaattaccatatgatccagctatcccacttctgggtatatggccaaaggaaataaaaccagtatgctgaaaaaatatctacactcccaaattcatggcagcattattcacaatagctaagatacagaagcaacctagatgtcccttatcatataaatggataaagaaaatgtttatatatacatatatatataaatgtcagaatactttttagccttaaaaagaaaactcggccaggtgcggaggctcacgcctgtaatcccagcactttgggaggccgaggcaaggggatcatgaggtcaggagatcaagaccatcctggctaacacggtgaaatcccgtctccactaaaaatacaaaaacttagccaggcgttggtggcgggcgcctgtagtcccagctactccggaggctgaggcaggagaatggcgtgaacctgggaggcggagcttgcagcgagccgagatggagccactgcactccagcctgggcaacagagctagattccgtctcaagagaaaaaaaaagaagaaaactctgtcatttatgacagcatggatgaacctagtggacagtatgctatgtgaaatgagccaagcacaaaatgacaaatgccttgatgatctcactcatatgtgaaatctaaaaaagttgaactaattgaagtagaatggtggttatcagaggctgggggagaggggaagatggggaaaggaaagatgttgatcagacggtacaaaatttcagttagatagaagaaattagctttagtgatgtattgcacagagtggtgactataataagtaatgcattatatatttcgcaattattaaaaaatagattttaaatgtttccaccacacaaaaaatataagtatgtgagctgatggatttgttaattagcttgatttactcattccacaatgtaaacatatatcaaaacatcacgttgtaccccacaaattattataaaattatttgtcaattaaaaataaaattttaaaaaacaagggctcaaattagaaaggggaaaaaaaagaagtcaaggagagatggactagttggaaaaaaagagagtcacttagcaatacgggcagaagcattagaaaaataacatcagaagaaacagaaattaggaatccacagtcattgattctactttccatttctactggctttccttgctggtggctgctttgattctatgcgtgtacttcccaataaaaatggtgctgttttcatttatgataaattagtaataaatgtgtttttatttgtctaatgtattactactatcccaagaaatcaaccttgactactcacatcccctactcccaatattacacaggccacctagtctcactagatttcctaaatatgtatctctctaatctctccctcttttctacccccagataactgcagaacccttgtaattggtgttcctgtcttcagtctcctttcacatccccacctgcttccaagtcatctatcttccattcaataattcattcaacaaatatttaagcccctactaatccttctgaaaatgttagtctactgtacccaatgcaattttccaactgaaaagggctggaaacaatctaaatgtccatcaatagcaggctcattttaagtaaattgtgggccttcaataaaatggaaaattaagcagccataggaaagaaaaaagaagagggggataaaaaaggatgcttttgatatattgatatggaaagatctcaccatgatgagctacaagaacaaagcaaggtgcacaaatgctaagtatggtatgctgtcattagcgtgaaagtaggttgagggatacaggtacactatttttgtatttacttatatttgcagaacatagctctgaggaaatatataagaaatgcatgcagtggttgtctgaggggaaagttactgggtaaatgagaaattgttcactatatactcttctatatgtttttaaatttttaaaccacgtaaatatactacctgttttaaaaaataaagtgtcaatctgaccatactactttcctacttaaaactgtcaggaattcctatcgcctttcagaataacatatataaacatcagagctcatctctcacactctctcttgccctgtctttcacccgcatttccataaaccactttgtctcttggtaaatattgtcatggttcaaggatcagctcctccaggaggcctttcctgcctgcatatccctctagctcatgtgccctcacacacacagtgtgtgtgtgtgtgtgtgtgtgtgagagtgtgtgtgtgtatatatatacatatatatatatatatattttttaagagatggagtcccactctgtcaccccacgctggagtgcagaggcgtgatcacagctcacagcacccttgatcgtctggtctcaagcaactctcccacctcagcctctacgcagctggcactacaggtgaacaccaacacaccctgctaatttttttttttagtagacacgaggtcttgttatgttgcccaggctagtctccaacttctgagttcaagtgatactcctgcttcagcctcccaaagtgctgggcttacaggcatgagccaccgcatcccacccaaagtatcttaattctgtgttttcatcttccctagaacctaggctctttgaggaccagaaatgaatcttttatttctatatccccactgcctagcatggtgcatggtccacagcagacacaaaaatctttaccaattgaatgaggtcatgactgtaatgaggaatttatcatttgaattatgcataattataaaaatgctatttaatttataacagttctagacatgcataacatgtcaacatcacagtgaaacctgtctaacagatgtaggtcaaggaccgaactaggttgtccattattctcactatactctaagtgctgggacacaagataacccagtcctaaaaggagaaatcaacattttaagcagctctacaaagaagtagaaaaattgaagacatcagacaaaagtttcaagagcagtcttaaaatgattaagaggctctaataagagatttcataaaagacttaaagaaaaagctttcctgtggcaaatacttcctgttaggagaacagttgctcatccctcagctcaaaggaccacaggaagctgtgcccattgtacctaatgaacttttacaattatctaacttttctcatcttcttctccctcaaggtgagtaccaacaatgctaatgcaatcatgacttccatgtgaacttccggccgagttttttttttttccttctttcattaaccatcagagatagccagtgctgaataagccaagtttccattctggagactatagataaaaatagcctggatcactctgagtggatcataatttctcatttatactaatgaaataaagttttctgtcctacaaatgtcaaatgtcattcaagtgaaaaccagagaaccaagtgtctcactctgtaggatccaaagccacataaaaaggaccattttagtcaactcttcactgaaggttcaaattcaaacaatccatatctcctccaatctgaaggtgagataaccccttccctgccacaccacagcttctgccactgccactcaagccagaagcataagtgaagtaaagaatgactctattattcattggaataacagaaccatatgtgggctacacacttaggccatgtgcagtgggcactgctattttggtccatccggcacccaatccctctacttcttgtaaaatactgaagttcctttccaaaaccatttcttaagctttctaagtggcccaggggtactggatgactctatcctacttcccaacccccaccaagcctggccaaccatagcattcttttgaccacggagatgtaattagggataggcccaagacccaatcaaagttcatctttgaacttttgctggagctaccaggaaagaactttttctcttctagttatcttatcagtaggagaagggacattacctgacaatggagccgactatgcagaagagccaagagatagccaaagagaaaggccttggagatgctgcctgaggccctgtatccaggtgtgtctggggccatatttactcttgaacttcccaactaggggagctataaatgtcccttccagttttttcctgcttaagccagtcttgtctttttttcacttgctaccgtaagatttttgtcttgtacacaaaaatagaatcagctcatacgtaacttttttgtgtaacttctccttttccttctttcctctcctcaaccttaacattaaaagctaaaggctcttgttctgagtcccctctaataaaaaataaaataaaataagctaaaggttcatgagaaagctgggtgaataagagaagcatgctctctggatctgtccacaaactcctgccttatctatctatacagggcttatttatctataccattctgtcaccctcctgcctctacagacagacactaatcatagatgaaatgacattcaaagtttcttgcagttctgagctatatgattcctttaagcctcagttgcctcatctgtaaagtgggagatgatctctctcacaggattcttaggaggatgaatacagcaaaagaatactttacaaatgtttcttgaaaaagtatgtgaccttctctattcccaaggcagtttctcaatactgtatccaccaaaaaaggaaacacaggtcattcaagaaattattacagaatgcctaaaatgtataaggcacgtgggggatatagagattaaaacatctaaaaatgcttccaatgtagaatatcagacaactacaaaactagcactacattagggctgggcgcggtggctcacgcctgtaatcccagcactttgggaggcagaggcaggtggatcacgaagtcaaaagatcgagacaatcctggccaacgtggtaaaaccccgtctctactaaaaatacaaaaattggccaggcgtggtggcaggtgcctgtagtcccagctacttgggaggctgaggcaggagaatcatttgaacccagtaggcagaggttgcaatgagccgagattgcaccactgcactccagcctgggtgacagagcgagactccgtctcaaaaacaaaacaaaacaaaacaaaaaaacactagcaccatattgaagaaaatatacaagttgtcatcaaacaacaacaaaataagctatgggaactgagaggatagaaaaactacttctttgtaggaggtggaaaggtttcatggaagagacggcattcgattgtgcctcattgcccagggaagcattaccagtcagaaacctcctcagacaggaaatcaagactgactttatccatatgtacagacatgccacctacaatcttagcatcccatgatcctaaatgcctttcaaataactcttctaaaagataaaagcagactaaaacattttgcttccttgttacaaaatcataacccacgcagaaaactattaggataattttctcaatgagaatcatatttttataaccagagggaatacacattaaatttttaaacatctatattgtttcccagacaattctaatcgccataactttctagtgaaactgaaaatttcttgagggcaaagcccagtgttatttctctgtgcccctcaccttgccacacacactcattgtatgaatacacaaaaacaaaaaaagactcatctaaaaagtgttacattaaaaagtgtgaacatgtcactcccagatcttaaatcacttatgtttcccagcacacaccacgcatttccacaatgtgccatgtgttgatactattctccttcttggaatgtccttgaatctggaattccattcccagctccgaaaaatatttcctccaaggcctagctcaaatgtggcctttttttttttgaggcactactcgacttgtccatgaagaattaattctttcttcctctccaggtactctggacatatccctcctatagtattctcactatagaaaaatgatacttatgtgtgtgtctgtgtgtgtttgtgtgtgtgtgtgtgtgtgagagagagagaaacacctaccagagtgtaaatgccatgtgggtagtgtatgggtctttttctgtatgcccagcacataggatgaatcttacataacaagtgttatatagtaatgtgccaaataaacatttgtttaattaaaccaaataaacagaaaacaaagaggggaaaaaaggcagaaacaccactatgctcatttacttctcctgaaatattggagttcctgaatttagaataaatggtaaagtgtcagaattagaccaaagtcatctgcacatgaactaaaacatttgaaaccaaggaaaatagagagattaagaacagcctcctatgacgtcattgtcttgataacaagactgcttcagtttcagtcattaagttcagcccttgaaggcttgaaggtatattctcatcaaccactaatttgttaataaattgagatgcccctaagcattgtagaaagcagactataagaactggccaaagatggcccatatagcatccagtcaagacacaaaaccactctatagggatgaaaaatgtacatcttgtaaatgtaatccaaaagattctaacatccacatcccattctggaacccagaggaaaatagaatgtttaaaaatgaaaaatgttcaatgcttgccagaggaatctagataaaattttgagacagaccaatgtatatatgcaaatgagatggctgccctattaaaaaatagataaacagatgtaaggatttctccttagaaagagggacagactggcttggcgcggtggctcacgtttgtaatcccagcacgctgggaggccaaggcaagcggatcacaaggtcaggagattgagaccatccgggccaacatggtgaaaccccatctctattaaaaatacaaaaattagctgggtatggtggcgtgtgcctgtaatcccagctacttgggaggctgaggcaggaaggagaatcattcgaacccaggaggtggagattgcagtgagcggagatcgcgccactgcactccagcctggtgacagagcgagactccgtctaaaaaaaaaaaaaagaaaagaaaaaagaaagagagattgattatcaattaccaggcaagttagagaggaattaatatcaagtatggccaatacacactaaaacagtaatcaggagtcttcaacacacaaaagataaacagtactgcaggacatgctctaagggtaacaggaaaaaaagtaaaggccaaaaattatacaggatggaaaaacaatgagaagcccaggtatcaacctcctacactctacacctgagagactaaatcatggtcctgaccccatcaccctcacagtccagttggggagagacatcagcagaaaaacatctttaataattgttatgtcagaataaacacataactactgaggcaggatacggaaatattgaaggggagagaaagaggagatcaggtaaaacctactgtggatgttacctctcacctaagtcctaaatattggtcaggattaacccaaaggaaagaaaaatggaatgggaaaaggatagtgtctgctaagtaaacaagaaggagcactagtttaggagtcagaagacctgacctttagacccataagttgtttcgacaacacatcaatatgcaaaataccgggcagacagattgaagtaacagttatttctttctttctttttttttttcgagacggagtctcgccctgtcgcccaggctggagtgcagtggcaagatctcggctcactgcaacctccgcctcccgggttccagcaattctcctgcctcagcctcccgagtagctgggattacaggcgcccgccaccacgcccggctaatttttgtatttttagtagagacggggtttcgccatgttggccaggctggtctcgaactcctgacctcgtgatccgcgcgcttcggcctcccaaagtgctgggattacaggcatgtgagccaccgcgcccggccagtaagttatttatatatcccggcacctaacacatacaggcgctaagcaagacagataaataatagcaataaaacaactacagtttgcttagcccttcctaagtgctaaagtgctaagaatagcaggataaacaattcaagcccttgtcctcaagcagagtgtactcgaggagactacagataagtatacaacaaccctggtgaagatactgagacccaggatcctaatttattccgttaataagagaggaaatggtgatttaaaccataatttgattgccttaaaattatgagatcctcattaagagaacaggttggagggagaaagaaatagggggtaaagaagtaacaataaccctcaaaccaaactccctaatggtcaattaaatggagtcttccggtgaggcacggagaaggaactcctcatacgggaacagcaggtgctcgatttggggtgtggttataacctttacttcccttcctactagtgccttgctttgcctactccaaccccgtccaggaaccgagcagcccccacccgcctcggaggaatcgatggagcacctttgagtgcgcgagttgccgctctccgggtacggggcccggagcgttagcctcccgcgagtatcggtgagcggctgccgaactgccatgggcgccaggccgctggggcgtgccgcagccgcaagaacccgcaagggaccccgcgcccgcaccggtcccggcctcctggctccctgccgctccacacagcagcgagagcagcagcagcaagaggacgagacccagctcagggcaacgtccacacaccagccctagtgcgggcgcagccatgttgtcccgcgggccatgtgacccggttggtcacgtg

SEQ ID NO: 204 - DNA, 106138 bp, Homo sapiens; identical to SEQ ID NO: 203

SEQ ID NO: 205 - DNA, 106138 bp, Homo sapiens; identical to SEQ ID NO: 203

SEQ ID NO: 206 - DNA, 615706 bp, Homo sapiens
atggtggctaattttttcaagagcttgattttaccttacattcataagctttgcaaaggaatgtttacaaagaaattgggaaatacaaacaaaaacaaagagtatcgtcagcagaaaaaggatcaagacttccccactgctggccagaccaaatcccccaaattttcttacacttttaaaagcactgtaaagaagattgcaaagtgttcatccactcacaacttatccactgaggaagacgaggccagtaaagagttttccctctcaccaacattcagttaccgagtagctattgccaatggcctacaaaagaatgctaaagtaaccaacagtgataatgaggatctgcttcaagagctctcttcaatcgagagttcctactcagaatcattaaatgaactaaggagtagcacagaaaaccaggcacaatcaacacacacaatgccagttagacgcaacagaaagagttcaagcagccttgcaccctctgagggcagctctgacggggagcgtactctacatggcttaaaactgggagctttacgaaaactgagaaaatggaaaaagagtcaagaatgtgtctcctcagactcagagttaagcaccatgaaaaaatcctggggaataagaagtaagtctttggacagaactgtccgaaacccaaagacaaatgccctggagccagggttcagttcctctggctgcattagccaaacacatgatgtcatggaaatgatctttaaggaacttcagggaataagtcagattgaaacagaactttctgaactacgagggcacgtcaatgctctcaagcactccatcgatgagatctccagcagtgtggaggttgtacaaagtgaaattgagcagttgcgcacagggtttgtccagtctcggagggaaactagagacatccatgattatattaagcacttaggtcatatgggtagcaaggcaagcctgagatttttaaatgtgactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccaaaaatcaagaagaacaattggcagtcacctgatgacagtgatgaagatcttgaatctgacctcaatagaaacagttacgctgtgctttccaagtcagagcttctaacaaagggaagtacttccaagccaagctcaaaatcacacagtgctagatccaagaataaaactgctaatagcagcagaatttcaaataaatcagattatgataaaatctcctcacagttgccagaatcagatatcttggaaaagcaaaccacaacccattatgcagatgcaacacctctctggcactcacagagtgattttttcactgctaaacttagtcgttctgaatcagatttttccaaattgtgtcagtcttactcagaagatttttcagaaaatcagtttttcactagaactaatggaagctctctcctgtcatcttcggaccgggagctatggcagaggaaacaggaaggaacagcgaccctgtatgacagtcccaaggaccagcatttgaatggaggtgttcagggtatccaagggcagactgaaactgaaaacacagaaactgtggatagtggaatgagtaatggcatggtgtgtgcatctggagaccggagtcattacagtgattctcagctctctttacatgaggatctttctccatggaaggaatggaatcaaggagctgatttaggcttggattcatccacccaggaaggttttgattatgaaacaaacagtctttttgaccaacagcttgatgtttacaataaagacctagaatacttgggaaagtgccacagtgatcttcaagatgactcagagagctacgacttaactcaagatgacaattcttctccatgccctggcttggataatgaaccacaaggccagtgggttggccaatatgattcttatcagggagctaattctaatgagctataccaaaatcaaaaccagttgtccatgatgtatcgaagtcaaagtgaattgcaaagtgatgattcagaggatgccccacccaaatcatggcatagtcgattaagcattgacctttctgataagactttcagcttcccaaaatttggatctacactgcagagggctaaatcagccttggaagtagtatggaacaaaagcacacagagtctgagtgggtatgaggacagtggctcttcattaatggggagatttcggacattatctcaatcaactgcaaatgagtcaagtaccacacttgactctgatgtctacacggagccctattactataaagcagaggatgaggaagattatactgaaccagtggctgacaatgaaacagattatgttgaagtcatggaacaagtccttgctaaactagaaaacaggactagtattactgaaacagatgaacaaatgcaagcatatgatcacctttcatatgaaacaccttatgaaaccccacaagatgagggttatgatggtccagcagatgatatggttagtgaagaggggttagaacccttaaatgaaacatcagctgagatggaaataagagaagatgaaaaccaaaacattcctgaacagccagtggagatcacaaagccaaagagaattcgtccttctttcaaagaagcagctttaagggcctataaaaagcaaatggcagagttggaagagaagatcttggctggaggtattcatgtttaaatgctacattgtgagctaattgtgttttaacattgggtagcacttctttagagcatgctctgtgtttacttgggtgaaagagtttacttgcaatgactttccatgctttactctgaggagcattttgttttactcaggcagctctcctaagaagttgggcttgatgatttaaaatcaaagaatatgttaaatgggtcatattggaatgagcccaaacttaacccaacacattgtggatcagatttctctgctaaatttaggcacaaaccccatttaacatcaactaactttgtggcatcagttgtcaaacaaaagttgagtgaaaccaaaggttaagccaacagcctggcatctatttcttggttccattaagtttacagggatggagaaaaaggtgtaatcttaaaaaaaaatgtgaaaagatggactctgagacttaaccactcattttcctatccattcaacaatttaggggttgcccataggaaaagttgtgtgtgcacaggacagtcccatggaagaccatggactcccttacaacctactggcacagtcagggagagcaatagagccaaggccctaggtcatgtctgagtggtcacaagctattctttgagaagagatcagtaaggggatagagttgagtggttaccttcttaagaataaagtcccttctccaccatggaaatgagaagagtaccttaactaactattttaattgctttcttgtgggaacaactttggattatatacttttggaaagtgatagttatatgtaaatgtaagagtttgtttactttctatttctcaacccaacttcctccgcacttattccactcccttaccatttattttagttgcatgctaattacttacatttttggaatagtctgttactatctaaatttaaatgaattgcatattattattatgttccctgatcatgggattgtcatcattaattaagctattactctacataatacttcataaaggtgtatatgaccaagtgttacttgctattatcaaataacataataatatctgcagccagtagctggttatatcttctctgtcttgaccaaagctgtgatcaaactcccctaaatgagccattttgtggttgatgtgagtagattattgaataatcagaaatctttactgctaaactatttgaatttctaagacaactgaaataactagggtttgccactctaaaaatctatctttataaaacaacacagtttatgtaatttatttaggaatgatataagtcaaagggatcttgaatgcactggctgttgcaacattttgtgtttttgttttttttgcagggatgggtagttctcaactatatttaaaactgatttaagagtgaaaagtagtcaaatgttatgcaaatgtaatgcatatggtaataatatctatcttatattggagtgatttttgagagtcggatatccttgttactgaaattcatttgctatttcttgggatacaggccagcagtttgacaatgtattttatttgctgttgattcagagtttactcaaaggcaaatgaagactaagaagtgcatgagcatgtgtgtgtgtgtgtgtgtgtgtgtgtgtggtttgtatatatctgttgtgacataatagagaaatgttttaatggcagttggttaatgtagttgcttgaaatgttaggcaatatcataaataggacaagatgatacatttcagaaaaatggatcttcttcaacttctaaaaattccaaattagcaagcctctgcaaagcagattgttactgatggtgacccttcagccagctaacaaacttagtcatccagtgagtggcacttaaccttggaatacacacatgctcttggttatctatagccacctggttaagaataaaaccacggataaaacaatcctgtgccatttacctgcatatgaggcctggctatagaggactcagacccctccatcctcttggagcttggcttcttattatcctgtgagccaactttgaatggaatctgttggatatcatctgtcctagaggaaatcagcacacacatctttaagatggtctctggttgctgaaaggtaccagattgactacccaggaagctgcggtagcctagattttaaaggctatctctgctccccttggcagcagtcaggcagttttccccatcctgtgccacccatatgcctctgaaggaaggacagccaaagaaggacattttccaggcccctttcctgctcagagcatcccaaagaggtgccaattgtcatgatggtttctgttcccatggccatctgcttactgggctttgggaagatgccaacatattttttctctccatggctacgtagttatcacgaggtagcagtgctgtcttttctccataagtaaccttagccagattggagtgcagagctcttgctgtcaaactgtgggatgctgtctctctgacacagctttatggaattataagctcacacatttgaattatttatttcaactgttgtcttcaggatccagaggaccagaaaactccaatgtttatagatgtggatatttgatgataatgtttcagagaactttccaccttaaacagcattccagtaggaagagaccttagagtgtgtgtagccagaagcttccccatgagtcaaattcttccattgttgctggcccctgctgagttggcaccatttgtgcagctgtcttgattcctacaccatgatggtgactctctgatcccccaccttcagccttgtaccacctatcaactggaattaactatttattgtctcctcaaaattcccatgtacttgcctcttatcacactgactctcatatttatgtgcatttctcattttctattccagaatagtctagaggcaagttgtctttttttttaatcctttaacttgtactgtgcctagaccagtgttttatacccatatggcattgagttaatatgtgttggataaatgcctgaatcaagagaggtgggatactaaataaaaaaacacaaactttaaagtcaaatccaaattcaaactgtggcttttaatcgctaagactatgactttatctcctgagaactcagaagaatagacataaaagcttattactcagaattactatatattaggccctttccaggctgtttacctgtttttcattcttttacttcttataacaccactattaattttattttattattatcccattttacaggtgaggaagcagatgctgaaaacttacctagcttaatgtcattcagctaataagtggtggatccagaattacatggattgttactttggctatttagagcagcagtatgcttattcacttcaaaggttgtttttattcaagttttaagttggaaaaactgataagagatgaagaacagagtcagccactaggtttagttcaactcagagatattcacgagaaaccagtatgaatatgaaaggcactaagtttctgggactctcaggttttgatgtgaaatagttcattctcagtgtttctacttcaaatccctggttcattttataaatcaagatttgtagagtgcaataaatactgtactataacagctgcttgaaggatgttgtatttgcagtctgatacactttacctgaaatcagaacctgacgtcagtttgaagtattaatagttttcctagcagaagaccaaaaatcttgttctgaaagagactgtgatatcggaaattagcatacttcctagtttttacatcatgtatatattctgttttctgaatggttataaaactgtcagaatatgttgacttccaagtaaggatataaaactgaaggtattaaaatttcctaaggtagatactttgttagactagtggttcctaatctggctggttgttagaatcatctggaaagcttttgtagtagttgttcctgggatgttattttaaaatgaccaattattagcatattttcacagattattgtgacttggtggtcctacaacggggccaggcatatgcctttaaattacacgagttactgatgtaatatatgccctttaataaaacaacagcaacaaccacacacacaattaaaaacataataaaacaaaatctaaaatgaaaagtaaaaaagctcacctgtggacagtccaggtcaggaggatgcagtctggctattcagatgctcccttgacggttctgagggatgtgatcatcagaacacatttgaagagcactactaaaagctatgtagcaaatatacctgctcacacggcgttcttaatttccccctttttaaacttgaaagagataaaatcagtctaaggaaaaatattaataatttttttctttttttcttttttttttttttgagatgaagtctcattctgtcacccagactggagtgcagtggcacgatctcagctcactgcaacctcctcctcctgggttcaagcgattctcctgcctcagcctcccgagtagctgagactacaggcatgcaccaccacgcccagctaattttttttttttttttttttttaattagagatggagtttcaccatattatccaggctggtctcgaactcctgacctcgtgatctgcctgccttggcctcccaaagtgttgggattacaggcgtgaaccaccacacccggccgatttttcttaacttaaaaacaaaagatgttttgtcaacctttcagagttaagtagattattacattttgtgaaaaggctttagtaatatctacatatgaaaatagagcaataaagatgtattccttaaaaggtatgtatgaatttaaaattttagaaatcatctgtatcaaaagtcctaggggattttcctgtagaaaccatttagtgcataattttgcctacaaataaattcctatccttccacattttatctgacaacttggggctttttttttgtttgtttttggtaaatcttccttcaagcatagcaatactggtaatagtagaaggcaacttatttgcaaaatgttccataaaaatgcagtgcataacaataaccttttgtctagtattttttgcttctaatacactagaattatctataaagtgattctcttgtttttttaattgacatttttatttgacagtaacatttttaatcgacaataacaattgtgtatatttatgcggtataatgtaatgttttgagttacatatacattgtagaaagattcaaagaagctaattaacatatccatcaccttacatattttttttttagtgagaacatgacaaatctattctttcagtaattttgagatatacaatgttattattgactgtggtcaccataccgtgcagtagatcactaacatttattcctccagtctagctcaaactttttaccctttgatcaacatcttcccttttcccacctcactctctaccccaacccttagcctcaggtaatcacctttctaaaatctgtttctctgagattgactttgttagattccacatataattgagatcatacaatacttttcttcctgtgcctgacttatttcacttagcataatgtccttcagttacatccgtgttgtcacaattacagattcctttctttttaaagaccgtgtagtgttccattgtgtgtacatctacttttttatccattcatccactggtagacacttaggttgctttcatatcttggctattgtgaatattgctgaagtaaacatggaagtgcagctatctctttgaaatatcagtctcaattcctttggatatgcagccctgagatgcgtaatgacacttcagttgatgatggactgcatatatgacagtctgtatacatgatggtggtcccaaaagattataatactgtatttttactgtaccttttctatctttgaatatgtttagaaacacaaacctttaccagtgtgttacaattgtctacagtaatcactatagtaacatgctctatatgttaaattgtaaatgtttatgtatctaaacatatctagcagcaataggctataccatatagcttaggtgtatagtaggtgataccatttacgtttgtctaaggtacagtctatgatggtcaagcaatgacaaaatcacctaatgactcatttctcagaacatatccttgttgttaagcaacacatgactgaatatgaagaagtgggattggtagatcatattttctagtaattatatttttagttttgaaggaacctccatagtattttctgaaatggccgtgctaatatacgttcctaccaacaatgtacaagaatttccttttctctacattctcaccaacacttgttattattcatctttttgatcgtcattgaaacaggtgtgaggtgatatcacactgtggttttttggctgtttcttttttttttaagcaacaggttctctgtcacccaggctggagtaccttgacgatcatggctcactgcagcctcaaacttcagggatcaagagattctcctgcctcagcttccagagtagctgggattacaagcaaaagccaccccagcccagcctctttgtggttttaatttgcatttccctgagatactgagcattgtttgatatatcttccatttacatctatccttttgataaacgtctgctcaggttctttgcctattttaaaaccaggttacttattttcttgctattgacttgtttgggttccttatgtattttggacattagccccttatcaaatatatggtttgcaaataatattttcttccaattcatggatcgtctcatctttctgtaaattgtttccttggctatgcagaagctttttacttcgatgtaattccatttgcctattttgcttttgctgtctgtgctttcggagtcaaaggagacctttgaggagtgaagtggccaagggcccctagaagcagtagagaaccagctagggacactacttcttgctagagataaagcctaaaagatccaacagtaaaattcatctaggaggcaagactagaacccaacgaatacatgtgtttgtaaattggttcagaggggagaaagataatatgtataaggagattagtcccaactggagccaaagtgtttaagtgtattctggtgtgagatggaactaagagaaagggaaagaaaccaataggtatgctattctatcagactcagttctaggcattttaatttcatacttgtcaccatagctttgggaagaaggtactgttagcctcatcttacaagtgagatgactgagtctcagaggagcaaaacaaggaaggcccaacatcatatagcgaattaagggtgttggttgactcctattgtgccttgcccagaatccaaagtcgatgctctttccctgacatcctgttgccaatgcaggccagtcttgtcatgaaagattatggcttatgtttttaagcatctgtgtaagttgtacatttaaagtcagccaattttgtgttagcaaatgtagttacatactgagctctcttaataaaaggtgagtgataatagtttgtgctaagagatagtatcatatttttaggaagttttgtaagtctggggaggtgatgctagtcacttgaaaagattttattaggggtgaagaagttaagtgccaataagattagtttttgagaattacaaaatttttatagaaggtaagaaattcaaaaggatatacaaagacccatgaacaggaacaacaaaaatgttgcagagttcataaacacagttaagttatgttataactattaaatggctcccaaactataagactggaatacctgtatttgcagggaagctaaaggcatggtgcattttttgaggaaaatattaactgacgatgaaagatggcagtttccaggttgtactaggaatgttgttgcaaagtgtacaatgcaaaatactgtatctcagagattcaagaaatgatgttatgtcaaaacctcagatgaatagtttttatttgcttgtttctgctcatgtcatcattcatgttatttcttcaagctcagagacatatttttatagaaattataaatcatttttgagattgctgtgtggaataagataaactctgaactctggtgtaagatagcaaaggatagcctaatcaattatgatgaattatgtgagaatggggtagatggaatagctacatccagtggggcaatttaggctctggcataaaactcaggaacaagagaggagaccgactccagtgcagcagagaaaacctgccacctggagagtacacgtcagaccacagatgatggcttctaaagcatttaggactctaactctggatatcacttggataggctctcaacatcccagaatgagaactattaagagaaatacaaatcctaggagggattgaggtactagagaggttatcaagagaattacctagttacctaaactaagacccaaggtgagaaatgagtatctgaaacaggtaaaagctttattgttcagaaggtatccaaggactgagcccaatttgcaagcaaaatgttttgatgctgagtccaagggagatggactcaaatagaactgtttcctgcactaaagatagtagcttaggttgcctccataggctgtaaaactggacagagctaaatgcattgattgagttctacaccatggctcatttcagcctattgtatgcttctgttaaaaaaatatgctatgaatgccgggcgcggtggctcacgtctgtaatcccagcactttgggaggccgaggcgggcggatcacgaggtcaggatatcgagaccatcctggctacacggtgaaaccccgtctctaaaaacacaaaaaaattagccgggcgtggtcccgggcgcctgtagacccagctactctggaggctgaagcaggagaatggcgtgaacccgggaggcggcgcttgcagtgagccgagatggcaccactgcacttcagcctgggcgtcagagagaaactccgtctcaaaaaataaaaaataaaaaataataaaaaaatgctatggaattttgctaaccacttcattcatcaaacttgatttactgactctcagctacttccaaatattaaataaaccatctgaagataaaagtgattaataattggcagattcaaacaactgtgaaataagaagaaatgatccataggcaatgccaaaaggtcccaagatatattgagcaatgtcactttatttagaataagtatgtctctccctcatccctccaagcatcttcactgccctcaacatatccttcattttctccctaactcaaccatgatgacttcaaaaaggatgctttttattttggagtatgaaatttgttatgcgtgtatgtgttttatatagcattggcacacacaaacacatactttctttagttttcttaagaaccctagaaggtgtggagcttaatactgggtaacatttattaattcctttcttatgtgccagatactattctaaatacttcactaaatcatatcttcacaataaccctatgaaatgggtattatatttgacttcattttatggatgtgaaacagaaatactgtaacctatctaagaggagggggaagaaaacccagaagtagcaaatccagtatttgtactttggcgtttatcttccacattctgtgtgcttaattaagcattaccccatgcagcctagtttaggattccagaaattaagtgtcggtgttcaactatataagatgagaaactgaggtggtaaatattgatttacccgacagcaccaatttgtcagtagaactgcaattacaagctattttcccaaatcataagccagcactcaaacgatcagatctttctcccattttacatgatgatattacaggcaacatgattattcaggtgtcatttctgtataatttgtgataaaagaaattgttgaccgcatataatcatggcaacaagaaatgacagcttgaatataatcttcttatttcccagagatgtaggttaagcttcccctgcccttttaatgccttttctgatgctgacagtgtcttgtggaaagcccgtggttttagatttacatttctgttctttagtgattacagttaaggcacacatactggtgttcctatacacatacataaaatgataatttacttaatgtttaagaaagcattttactatctgagagaaatggataggaaattctcgagctgatcaacatgccctttgcattttctagaaacaaaatgcaaatgggatattttaaaaagtcacctatcatatatattgaatcctcataaaacgttaatggagtagactatggctgaagtcctcaagtctctattccctgaagatagttaccggtcattaatgtaggttgtaaatgtagcatatgatgagatcaggtgacaggcccaggatttctgaatcctcctctggtattctttgcacaataacatgctcttagctacttgtgcacgtttatgcttctttcttctagaagttagaacacctggcctgtaatacaaactttgggactgcgtcaagggtatttctctactgattgctaaagttagtggttctcaggttgcagtaaaatcatctggagtcatttattaaagacatagattccttcatccagtctccagctgattttgctgtagggaaacccatggatcacattaagaaatacttaatagttgataattaatatatcatcccaagtactcctttcactcttttttgagtgatttgattagttccattggctacagttatcatctgtatcctgatgattccaaatcagtgtctttggtctaattttcctctgtcaaacctagactgttatatatatttattctttcagtcattaattcatgcattggttcattcttcaataaatctttaatttcctggctgggcgtctgggatatagcagtgacaaatcatatttggtctttgtcttcagtgaagtgggtgagaggaatttaattttaaaaattacacaaatatattgtttccaactttgataatggctgtagaagaaaatccaaagtgttaagagagcacattacagcttagaggttacagaaggcttccctaaggaaatggtatttgatctgagatttgaagaatgaatacattgagccaggctaagagaaaggaaaagatcccctcaggcagaggaaatagcatgagccacgttctataggcaggaaatggtatgatgtgtttgaggaattgagaaaaaaaaagaaaaaaaaaaaacaggaaaagcatgtaagagaaatctggtgcaataatcagaggccaccttttctgtgtcttttgaatttttcggagattttatttttactcctagacactatggaaagccatggaagaagagtaagataatgagttgtaggagttatgtcaaacaagatatcctgttgaactctcctcttttgttttgtttttgagacagagtctcgctctgtcgcccagggtggagtgcagtggcaggatctcggctcactgcaacctccacccctccggattcaagtgattttcctgcctcagcttcccaagtagctgggattacaggcatgtgccaccacgcctggctaatttttgtgttttttagtacagatggggttttatcatgttggccaggctggacttgaactcctgacttcaaatgatctgcctgcctctgcctccccaagtgctgggatcacagacgtaagccacagtgcctggcctctccctgggttttctgtctcaacagatggcaccaccatcctctgtttgcttaagacagggttgtcctccttagcagtttatttgacacactgtagtgaaaatttgcacatttcctttttttttttttttctggcttttcagcatctgaattcctttcttattggtgtctccttactagtaggtaagcccttagaaggaagtagtgctctgtgtgctaccacaaagctgaagggaatagaagcgccttcttcccacccctatcagccatgccttgagcacatgtcaaacttggctaactggaaatgcctgcccagaactttgaattgggaggaagtggtaggagatagggataagtagacattgtacattaacactgtacataaactaataaatccaggttaatagttgcagctgcccatggtttaagtaccagtagtggtgaacttactgtagtgagtgttggctgggatctatgtcatcttgactcctatatctcaagctaagtttttcagactttcagttgatttcataatgtacacaatgaactattttctccttttattagcaaaagtgaattttcctatgtggggtacattcatcacctcaaactcagttattgaataaggccgggcaactttgccttctaattgtctctcaatctccattgaacatcggacaacaatggaccattgctgtagcctcaaaactagtctccgtctctatttctttccccatccctgctctgccactaatccatcacgtctcagcatccagcgatacatataaattggcaaaactaaaaatgtctttatataacttttagagtaagggcaaaatgacagcgagcccatagcgctgaaaattgctgttttcctgctgcctccctcatctcctgcgaggcaagtggtatgcctggtacccttggcatttttcccagtgcccgccagtggtcaaccatgactcagccaagcacagtggttaagaccctggcctccagagtcagcctacaagtctttttttttttttttttttttgagacggagtctcgctctgttgtcatccaggctggagtgcagtggcccaatcttggctcaccgcaagctccacctcccgggttcacactcttctcctgcctcagcctcccgagtagctgggactacaggcgcccgcagcctgcaggtcttaggaggttgggcaagttgtttaacctcactgtgctccatttcctcacttaaaatgtggtgataaaataaatacataaaagatgaattttcagccaaaccagtaagtaatcagtagggaggcaacctacctaaaacgcacagacttcttttgattttaaactatttatgagaaatattaatcagaagccaaatgctacagttaccttcctaaacatttcttaactaaaccatccagaatgcattttgggaattgattgtgattatttttgggtttgaattcttgaaagactctgggcacagacagcttggtgaaactggacttagcattaatagcttcagttattgatgttttcatgaaacacaaaaaatgtgcctctgcctgtactctctggctttttaactgtgttgcctcggggcaatttcaacatagggaaccaaataagtcaatcaacatttattgagtgctagtagtgtgatgaactcaagattagggctgcagggagaaggcacatgatacaaacacgtggtttccttccttgatactattatgatccggttcaagtgaattcacaattatttcttgagctgactgttgtgagaggcattgtagctgatactcatattatcattcaattgttttttgaaaatatttattagcacctactgaatgtatacagtgaatgacatcgtggttataagtagaagagaagacacagaaaaataaataactggataattaatgacattacaattaaaatactaattattacctattcattattattagtaatcagcaagaaagtaagacaatgccataaaatggcacttatgcagccaaactgacagaggtgagcactttgcatgcattttcccacttaagccttcacacagcttcagaaggtgcggcagaggttcccgggaccctatgcggccctactcagccttgctctgatttcagctgcagctccggtggaccagagcatatggtcatgctcagcttcatctttcactcaagtgaacaccttcatcttttcagatctctgcctcagtcttctctgatattgagggattccactcagcaaccctcaaccagtaaaggacagcagatccaggataaatgctgcagctttctaccctttgggagggcaattcagggcagcacactgaacccaagtctggaggtcttagctgagtcaagtccctattgtctgctgctgcagcagcggcagcaggttcagtcattcatccttatataggctttttctccacctctacctcattctccctgcccctcttcctgcttccagggaccaccttccaaactacccacccccatgtccgtgtcccaggctctacttttggcaagacccaaattcagacccgaggtcatgactattaatatcctcattttgctcctgaggtgacagatccctagaccattaagctgaatgttacttacttagttaacgccccttaagcagagccagtattcaaatacctgcccctgcggttagttgttatacaaactcctgtgaacaatataaaggtaactgtgaaaaaggtctaactgattgcagtccaggtgtgagagaacttagagataatctcagacagtaaggtcaatcgggtagaaattattgttagtagtagtagtaaataagcaaaaacttttgtataaatgttgaaaactatcacagcaaaattatgtagaagtaaatgtggcttccatcatcctcttcttacccccatctttgtttgtattgctataacaaaatatctgagacagggtaatttataaagaatagaaatttattttctcacagttccagaggttgggaagtttaagtcccggttcagttttccagtgagggctgctctctgcttctaagatggtgccttgaatgctgcatcttccagaaagaaaaaaacactgtgtcctcaggtggcagaaggaggaagtgcaaaaagggatgaactatctttattaagcccttttataagagcccaaaatcctatttgtgagggcagagccctcctgattttattactaccttctaatactgttgcatttggaattaagtttcagcatgaatttgagaggatgaaaacattcaaaccatagtacacctctttttccagtcacactccccagtctcttaggcctgtgatgctgtgtctcccaattatcaagtatctagtagctcattggtctttgcttcatcatcccctgaccttcctttcattgctttgtagaatgagtgatatttatcgtaactgattttcagttgataagctgcatctcctggagatgtttgcattttatgtcttttctattatcaaatggaagcactcctgctgataaagatatttaggcattggaaattcagaagggtgccgtttttggatagcccaggctggagtgcagtggcacgatctcagctcactgcaagttccgcctcccgggttcacgccattctcctgcctcagcctcctgagtacctgggactacaggcagccgccaccgcgcctggctaattttttgtatttttagtagagacggggtttcactgtgttagccaggatggtctcaatctcctgaccttgtgatctgcccgcctcggcttcccaaagggtgaagtaacattattttagcaactgaacacacatcaggctgggcttgaaggaatcatctttggacaatttgaagtttctacattttgacaggaagttattactgatagagggacatagaaccagagcattagttgtaccaaatatgtaggaagatgcacaagtgtatgtgtttgcctgtgtgcatgtgtgtgcatgcataatgacttacctgtacaggtaactgagcaaatggctttcattgatgccttttatagatactatagaaataaggatcaaatattaatacaataaagctttgatatggctgcataaaattaagcataattatagtcaagtatgttatctgcttaacatggtcatgttattatcaaaacaaattatgcaaaataaattatggcatatcattcatgaactttatcatacattttgcttgttacaacatttaatttttccacagggcttgatctttatggtctgctgcttaggtaaatcacttttcttaccccaatgtaaatagctaccggaagtattaattagaaggattttcttgtcttatggcaaaggcatgagtctacatgtcttaaagactgaggatgattatagaatgaggaaatatatgtactttgcagttcagggtcagatgactgctttgtcctgagaggtattactcagttgcaaatgtactcatttattacagtaatttgattcaattggtagctttgctttctctggcattgttcatttttagtatgaacgatttagaaagaatagcaatttgtgtggaaggaagtgattttcatgtcaaggtacgtcaaatcaggttgataggaaaacactcctttgattacaaggccggataaacatgagagatgcttggacaggcctaacagcccagtcatcaaataaacttttcccaccttcctgggtgccttcattgcgttgatgagtgattgctcaggtttgaaattcaggtaactagtagggagttgtttattttgtcataatctatttagcacaaggtatccaatttttgaaaaactcttgcttttaagatgcaacagtagacaacaaaggaagatatgtatatatattgtgacatttcttagaactccaggttttctaggctggaagggaccttctaaatcatttaggccaatcctgtcacttaaaagctgaaataataataagagcctaaaggttaaatattttgtctgagaaaatacaagttattgtgctggaggatttcctagaaactggttctcctcatgtggtcccccatagaagtaataacagtacgctgatattaaaatagattttcctttaaatgaactaatgggatttgcaggaatccggatgggattggagacaattattctaagtgaagtaactcaggaatggaaaaccaaacatcatatgttctcactcataagtgggagctaatctatgaggaaggaaaggcataagaatgatacaattgactttggggactcagggtgaaagggtgggaaggtggtgagagataaaagactacaaattgagttcagtgtatgctgcttgggtgatgggggcaccaaaatctcaaaaatcaccactaaagaacttactcatgtaaccaaataccacgtgttccctaaaaacctatggaaataaaaaaaatttaagatgttcctttaataatggcatagatgtaattaataatgagacttatcgcctcagaacccaccccttagtttataaaaaaaaagatacaaataaaaaatacacaatgtacttctatttaccaatattctgataaaaagctgaaaatgcaaaacataaagtgttcacacattttggaagaggttagagaaacactgttactttggatataccttagttcctaatttttttaattaaatgacaagaaaaaatttttggattattttgctaacttattgacttatcttattgtcgtgggatttttgaactggaatctgtcttgaagatcattgagagcagctgttctcaagcctggatgcatgccagcaaaattttatatacacacattccgtgaaccacacacccaaggattctgattcagtgggccccaagaaggacctgggaataagtattgtgaataaaatcccctaaagttttggagactggccacgttggagaatcctctatctaattcagtcctcttgttttgcagatgagaaaagccaaaacccagagatattatgtacctgggtaatttttaaatgttaggacagcacatgatatggtgagagagggatctagcacccctcaggaaaatggtccaagcacaagccaaatgaaggttctcacagtgaactccttgagcataggagatctgtatgtcctttcactcttcatttctgtgggctagaagaattatgcaaaagcaatgagctctctaatataagcctctgctatatacagtggggtttcatcacagggtcattgaatttagtccaactttgctggcaaagacaaagagaaaaggagatacagataatgatttaaatagtgctagcgatttctctggccaatccattctgcgagcttttgttccagaatggacttccctggcttgctgtctgtcccaggaggctgacccctgtgtattggatcacccagccttctttgccagcaggcttgtggtcaagtttgcaggtcaaatagcagcagggaaaggtcagagtgtctttgctcactccctgttttggtgcctcagctctagctgtaagtgtgtgtctaccatttactgctgtaagctactgaagcagcttgtgttgggcaccgagcacacaatttcctccttttgtcttaggtgttaggcatgacaatcattttcttgtgtacaaagtctgtctctctctggggccttaccatctctttttgttcccttaccttatcttacacctctgtaatttatgcttttgttaaagaaatctatttgaattagtggtattaactctgttttcttcaggcacctaggttaatacaagatgggaaatataattgtttctctcaataattctaaatttttgagtttccttaaaaagtcactatctccttgaaccgaaaatgattaatgtttaagaatacaatgatgtgaaattcttagtgtatttgcttgatttgcatggtacattgctgtacattttatcatcttgcatgcatactactgtacagatttgttgatacaaaactatacacaatgtactttgtgaactgtttaagatgttttgaaagataattttgactacatgatctttactccttagaagctgacttcagaacctcctcagtggttgcagttcagtttagtttgtttcactgtatctatcacaaaagattttaaacctgggagactactctgaagtaagagaaccgacgtagaaataacccagtttatctaatccttttaacctacagtttgctgtggcctaggagtctgaaactcttcttcccaatgaccacttcaaaatgcctcccagaagatataaactagtacatccacttccaaggatgatttggcaatatttagcaaagttttaacatacccttcttccattgtttttttttatgaatgactcttcagatatacatttatagggatattctttgcagcattgtcttatgaaaaacagtatacaacctacacatgtctaaaggggccttgttaaaaaatgtataatgtacccagaaaatgtattagtccactttcattataaaaaatgaggcatacctagatgcttgcgatatattaagtcaaacaaaaatccaaagtgcagaatagcatgttacatgattacatatacacactgtatctatttccctttatatcttcctatgtttttatttttttttgttctttctaaacatcataggcatgcatgatttgtatagcaaaaatcaaaatgctccagtgatggtgatgagaatttggaagcacccagtaaacactgttagtcagatgacaaacttcataggaactcattttctccaactgagagatccttctgtatgggaagctccctctaaatttcactggccttcttctactcactttaaacctagagcccattcttagatgcatgcacctttgtcactgtggaggtgactggatttctgacccgatttacagagagatgcctgtgtcccagcaccatcactcagagaaaaacgtggaagccaatttgcacaggcatgggaagttttccatcaaccaagatagcagaaacacaaatgagaatagatgagcgcacccaatgctaggaagcagagagtctggggcaaaattccaaaaagccgagccacttacagaaaagtttcacaaggtggggaggtattgcaacaccgagaggatgatttggattcttacgtgcagccgttggatgccagaaagatagagaagatgaagatatggtcatacatttctgtcttgagaagaagatctggtagtaatacttcagggattttgtagtcttcccatctaggaattgaggttataaagaattattgtcattctaggtgactgcaagccaagttgagaggtttctctaaagagaatgaccccttcctttctgaggacacttgattgtctctgtcagccttcagtcttgtattcattctcaatgaaccttagaattccaggatgtgagaaattaaccgcaagttgttactgataaaagcttcaaagtttccctggcaccctaatatgccaaggctgaagatgtctctataatggtctaattcagtggttttcaacttgaggtgcgactgacactactgggcagaggccaaggatgctgttgatcattctgtagtgcccagggcagcccacaacaaagaatgatctggtgcagatggagaaatcctgatgttgttcaaatccttcaatttacggagaaagaaactgaggcccagaaatgttatgcatttcctaaagccattagggactgcatctctcacttaacgcgctcaaaagtcgttctgtctcagttcttcagaaacttcttttggggactccttccaatgtgccagtaatataaattcactcagctttgatttccacatacatgaaaagaggggagggatagagcccaagtaactttctgctttggcctgagcctgtccaggagaatgtagccattcttctctgtgttacctctccttagcagcactagatgcagttaaatctgtttctctcctttcttctcatccaccttcatctgtcattcctgtaatggatggagttggggcagtttgctaaattgtagcaaaatttgaggtgttcaaagaccaaaacagaatagataacttccaaagttcttttgcctctgaatttctatgactttatgaacatggaaaaccttcggtgattcagttgagaggattctgggaaagcagggagagtcattaaatgaatggaccttctgctcttaagtcacgagaagcaggccactgtgcctgcatgaagggcaggaatgccaagaaaatgggcctgctgtggatactaaatgtaatttattttatatgatttgggctactgaaagacctagcattaaggggagacctgtcctaagtatttctgtgtgctttccagttaaaggtgttcctaaaccttaaatgcttcttgaaagagaaatagctgccttgagtttagcaccactgcttccatctgttttgagtactagctacctttctagtgtctacataattttgcaggtttcctgttctacagttgttgcccttttaggcactccggtgatgtggtttaaagtaggtgcttcacagtcagaaagatacagttttttccaccctgagcatctccacaatgtgccgtgggcaaatagtttaaaccgtctgttccctaccttctacagctgtaaaattgcggtaataagagtatttttctcattgatttatcatgcaaaaataaaaaaaaattgtccaaaaggcttagcacaatgcttgtcatttggtaagtgattacaaggccaataattgtttcactgttttggaggaaaaagcaagtttgaattcatttatacatcaaaatgaatttatatatatttttttaaattacgctagtatctatatacatttgacatatggtaggagatacttctaacattagagatttgattggtctgtttttggatgtggtgttcacttattagaatagttgtctgatttatataagatactcccataaattcttctgtaagtgatctaacgccattcactttgcacttagggacaaaatggttaggtttgccatttatgcaagtgctgttatggagtacattcatttgggcagttttctttgtgtactattaatgtattttttattaatatttgtatagtatataaaatttagcaaatatatggaaatctgtattcttttaccaaaaagtgagaagtgtaaaagcaatggaggttttttgctgtctttgaggcagcttctgagcaagtacattctgtttacatatatcattttaaaattaatatttaatttattacagttaccttaaaaatagattctcttatgcttttatgttatacttgtatgtatatgtgtgtgtgtatatacatatacatatatatatatatatatatatatattttttttttttttttcctgagacagagtctgtgttgcacaagctggagtacagtggtgtgaccttggcttactgcaacctcctgcttccctggttcaagcaattctcataccttagcctcctgagtagctgcagtagctgggattactggcacgtgcaacaatgcctggctaatttttgtatttttagtagaggtggagtttcaccatgttggctgggctggtctgggattcctggcctcaaagtgatccgcccacctctgcctttcaaagtgctgggattacaggcatgaaccactgctactggccccatttgtatatcttattctgttttaaatataggagatgttagcaatcacttgttaaaattaaggaggctttaaattaatgttatctcccatttacaaatgaggttagcaaaacaatttttaactttttaaactgcagttatacttgaaaatatttagttttctttatgaaaactttgataaacagaatctttccaagtgattaagtgattctttaaaataaattaaacttatgaagtcaatatcaagttatcttaaacatctcaacactgtttaagaaacctaacagttctctttgaataactaagatcacaatttcaaaatcaattatgtttcaatttagaatccaaagactcctatgtttaatcaaattatcttaagtatttctaacattttaatacatataggttatttccatttttacataaataattttcatgaacttaacacagttacaatataattgtgggcttgatgtagcctctctgtggtaaattccaatcctttctgtttaaagaatggttgtactatcttgggccagtaaaggctacaaattaatggaatatatggggtctagatgcagttgattctccacatgtcacttacctacaaatcaacgtgctttttataattgctatagcaacagggacctcatgccctttagaagacattgtgccccctcctgcattcagattattgttatataacatttctgtccagtctcatcgagattgtttgtaatttttcttcactgttttgttcggttttgcacttatttgattctcttagtatgttttaatgttttctcatctggctcaaaacacattttctttccattccatcagaagtttcacatgcttatgtaatacttttgaaacttcatttaattttatttgcctgatttgagttgtcaaaatattctagattcttttcatattgttcctgactggcagggcgacaatgaaacagaatgacatgccattggtgttgcatatcccttgggtctttggctccacagatgacactaaagtcaagctaatgaaagtaaggaaaaataaccaactagaatccctccacacagatatttctaccattgactttgagcatgttcacttccagttttctaagcctgcagtgttccagggctcagttcttggactcttttttttcctatttatggttgtatattttcctacttacactggcattctcggtgatcccatttggtcccataactttgaatgccacttgcgtgctgaagatgaccacgcttatatttcctagtatgaacttccctcctagactctagcctattaggatgtaactgtttccttgactgcttcacttgggtgtctagaatctgatgacttcttacatgtcactcccccaccttcatttgcttccctttccagccccccatcctttgccttcatcatctctgcactggatgcaatggcctccctgcttcttcccttgacccccaccagtagccagagtgaggctgttaatgtcagtatgtcataatgtcatcctcttttcaaaactctgcaatgtgcctcccccaccccacccccattttactcagagaacaagccaaaccccttactgtggcctttacgctctttcctcattacctctccaagctcctttcttgttcttactgctgaaaccttcaatcactctgttctagtcacctggattcactatgttcttctagtttaccaggctcattcctatgggtaggtttctcccagaagcagacagactctaagacagggtaaatgcaactagtttatttcaaaggtgatgccaaattaaaactgggagagagactaggagtcaggtatagaaaggaagctgacacaagatagacttaggctgtaggcaggtgggtccaatcccacttaagaaccctgaccttgctacttaaggtgtggtctgtgaaccagcatgatgctatcacctgggagtttgttaaaatgagattcaggccccaccccagacctacttaatcaaaatcttgttaaaattttaacaagggcttcaggtgattcttacaccctaattaatgtttgagaaacactctctaggggacagtgtggaacatgtctctgtgttatcctacacaggctgggaaagctgggggtatttttcaacaactccctagctgtcattggttgagttttgcttccagggctattaacttccagcttgccccaagtactggcttaggatgctctttggcctgaaaataaaggcctgctggaagtgagtcacaggtgtttgcagtaaactgtcttcaggtgtgtagaggtgagcacccagaatatgcctatggtactaacagtgtctgcaactgagcctttgctgtagctgttctctcagcctgaaatgttcttgcctcaggtattcacttggctaaatcctctacctcctcccagtctttactcagatcatactgtctcagtgagacttatctgtatttaactttgcaacctgcatgcaccaacccagcatacccaattcccctcactctgctctgttctctttgtaattgcacttagcctttgaattcactgcataatttatccacttaatatactcattgtttacctgcttccatggaaagttagctacaccagagcagcagactttgtctgttttgcttattaatggataacgtagaggagctctttaatgtttgttaaatgaatacctttctatattttaaaatataagatggtagtatatataaaactttgtatcctgcatttggcttagcatatgtcacaaatatttcccatatcataaaaatccttaaatatcattttaattggtagtcaaatatttcattgtctctacaaattataattaaacactctcataacacttggcatattttctattttctttttgtgattataaataacacttctctgtatataaatctgtttcattttaaatattatttctttagaataaatgcgtagaagtcaaaatattaaagactaaaaatgactgtcaagactcagagagatacataagaaattgtcttttggaaatattgttcccatatacctctaaccagcaatgaatagacatgcctggaacaccatactcttttcatcaacccaaagctacatagcatagtagttaagagcatgattcggagataattgtcttggatttaataccagctctctgatttatgagttgtgtgacattggccaagttgcttatcttttcctcactttgttcatttgtcaaatgagaataatgaaaataatattacctcatggggttgttgtgaagattaaattacttagtatagataaagatggatatctggtacataataaatgctatgtaactgttagctaataccatattgagacattttaaaattgataaagtaataaatagtactttgtttttactttatttgcgttttgaagttgggggtatagtgccgtcagtgatgaagaggattagttgataagatttgtgtaatgtttcacaatccgatcgagtacatctcaacttagcatgatggtgctgaggcttggcattccaggttgagcattcctaatctgaatatttgaaatatgaaacattgtgagcaccaacaagatgctgcgatttttaaatttggggtgcttaactggcatataatgcaaatattctgaaatcggaaaatattagaagtggaaaacacttcttttcccaagataaggaatactcaacctctataaaatatcacaatacttcagaatcaggttttggagccctagatcaaataattgtcagaaaaatcttatttttgacataaagcatgaaatgaaaatacatagggatttatcactgatgaattttgagcttatcattgaaaatgtgagtccgtagggataacttcaatagtgacttttcaaccggaacacacctgcaggtttaggcaaatgggtaaatatactgatactgctaagaacaaaagttatccctatgaaagaggaaagatacaaatacaaaataggggaagtgaagaatcttatattccagtggaggacaactgatagatggtaaccacatgtcacctggttatttgtcattcattaacttagtggcttagaaaccacttactgaggccgggtgtggtgggtcacgcctgtaatcccagcactttgggaggctgaggcgggcggatcacaaggtcaggagatcgagaccatcctggctaacagggtgaaaccccgtctctactaaaaatgcaagaaattagccgggcatggtggtgggtgcctgtggtaccagctactcgggaggctgaagtaggagaatggcgtgaacccgggaggtggaacttgcagtgagccgagatcgtgccactgcactccagcctgggtgacagagcgagactctgtctcagaaaagaaaaagaaaaagaaaaagaaaccacttactgagaatctactgcgcataacattgagcatcaatgttacgaaagtacgacaaaatgagtctatcacacttcttgtccttaagaagcccactagatgctccctattcagcctggaaacatgactgctgctctataaggaaaggcttataacatgttcttgcctcagaacaatgatggcttcatcccaggactctactaaaataagcttatggtaaatttaccttatatgtggatgggttttgaaatcatacatttttaaaaccatatattttttttcacaaagtggctaaaataattctggacatggaaatttattttaatgcatttatgcaataaaggaggcagccttgagcaacatgtcaatttcatcaggagatcactatgcaacagacagagaatttgggcaacatttacactgcaatttctggagatattaagccagcagatacaggaacatgtgtcacttcatgtatgccttgctaattaaatgtacatggactttgaattttgaagcccagtcaaagtttcccagttctcttttagcagccgtttatttttactctggatttggtcagatgtagaaaccacagaaatggaggctgtaggattctgtcttctctaagcaagtttgtgcttttttcctctggctttcctcttaggtaggagcaaagatgtatgacagaggagtttgtaaacatccagccatttggggtgattcatttggttcttgtcaagggaaacaggtttctactcttgccacaatttctatgcaatcttgtattagttaatgtgtagacaaccagaacttgggataccctattttgggatgatgttttgtccctcagtggggtgtcctactcttttcatctattctgtgccatcatatgacttcatttacatactcttgggtcctggtttgatagatggctctattgacaggtggcattattaaagaccatttccctttgggccttgtatcactcacagcttaggctttaatttcagaataagtttttcctattacaactttatcaaaataaatttacgtaatataaaatccacccttttaaagtgtaaataaaattcaataatttttagcatatttagagatgtacaaccatcaccataatctaattttggaacttttgtcaccccaaaaagaaaccccatgtttattgtcgtcactctctttttcccctgcccccagcctctggcaaccactaatctaccttctgtccctgtggagttgccttttctgaacctttcatataaatggaataatgtaagatgtagccttttgcatctgatttcttttacatattataatgttttcaaggtttctctatgttgtagcacataacagtaacttcattcctttttgtgcctgagcagtatttcatattatggatataccacacttgtctatccattcatccctctatatgctgattggaaaaagctatttccactttttggctattgtgaatgcggctatgaatatttgtgtacaggtttttatgataacatatatttaaagtttccttggatgtagatctagaggtaggattacttggttcagtggaactctttgtttaactgtttgaagaatttcccaactgttttccaaagtggctgcacaacctgacaatcccaccagcaatgtggcaggcggggtggggggtgtgggggagttccactttctccacattctcaccaacacttgttattacctgacttttttgttatactcatcctgttcgtggtgaggtggtatctcattgtgatattttttaaaataaattttattgtgcatatttgaggtttacaacatgatgttatcagatacatatagatagtaaaattgttattatagtcaagcagattaacatatccatcatctcgtgtagctgctagtttaaatttgcctttctctaattactaagggtgtttttccgtgtgcttattggccatttgtatatcttctttggagcaaaatatatattcgaattatttgcccagtttttagtttggttattttttctttttattgttgaattgtatgatatttttatatattctagttacaagtcccttatgccatatgtgatttaaaatattttctctcaatctgtgagttgtcttttcattttcttgatggcgtcctttgaaacacaaaaattttaaattttgatggagtgtaaattatcaattttttctttttttgcttgtgtttttggtatcatagctaaccattgccaaatccaaagtcatgaagagctatttatatgttttcttctaagagttttatttagttttcagatttgttttgagttaatttttgcatatggtataaaacaggggtttagtttcattcttttttatgtggatatctagttgtctagcaacatttgttgaaaagatttttctgttccccattgaatttgtttaacaaccctgttaaaaattcagaatacttttaacctacacatttttcttaaaagatatttattggtgaatttccatcttttttttcccctgaataatacaattgctctcttcagtataaattttatatataagcattgatgcccataaatttttcagagcacctgttcttaactggaggtggaattattaccatgtgtggtggggcctctgaccagtgggaggtcgcagtactttttcctgccactctagatgaactgattctgtggtgagtcataccaatggggagagtaggagtagctaatacaacctgactgcctggctgaaatctgtttttcttaaccatacacctgaggtgtttactgaacaaagagtaagttattttagtaaataaataatctctggggaaatacttcgagattctgagaatatcctatttttcatcagtcttctacaaactagctttagcatccattgataattcttgcttgaattgataattaccatcaagtttgcaaaatgatggtttttctaattctatcagtctttttacatgtattaattggcactcttctataaagaagattttatcatctcctttaattctctttttaaaatttattgtagtatcagtatagattccagattcattcggtattcaatattctcatccatttctatcatttctcactttgatattcagttgtctcaagtttgctgtttttttaacccaacaatctatcttagagattacttcagtactttatggagatctttgtcattgtctttattgctacataatacccctttctgtggatgtaacaaagtttaatcctgccaatatcttgtgaattggtgtctaataacttaccacaacaatgaatagcactgtagatgtatttttctatgaggcgtgtcatcagagtaaatacctagggatttctgggtcagtgtatgaataggcttgttaggtttagcaattattctccatagggattacatcattctggattgccattagtaatatatgagtatgcttgtttttccagagtctcatcaacaatgtatattgtcaaacttctatatttttgccactcaattgacatatttcaacgtaattttaatttgcatttattttattgtgaatgaaatcaataatcttttcatatgtttaaagattttatatttgtcttattccaaaccaccagtgtatatagttttgttcatttttctagtgggttttttccttcaaactttaaaaatatttttatattggctattagccttttttgttgttgttctagaacatagacacttttttttacttttttattgtggtaaaatatatataacaaaactcttttaaccattttttaatttttaagcttttcattgaaatataacaatatagaaaatatataaacagtacaacttataagtacactgctcaatcagatttcataaactgagtacaagtacactcttgtacccagtatctgggtcaagagcagaatattccaacattccagaaaagaaaagaaacatgttaaaaataaaagatttctattaaaaaaaaactagacatagtaattcagataggggtaagagacacaatccctttatccctttatacgcatgtaacatatttatatgtaattccatatatacacataaacgcactctataatgtacaatgtccaaaaatgggttcacataagattttctaagcggtatttattttttaaaaagttacgtggtaataatttggagacagatgattaagactagtcaaacaggtttatcatttaagaagattttcacaaattcagacttcagggcctattgcctgaccatctcaagtcaggaaaggagtgaggagaagccttcttacccattttaggtacatttttaaaattatgataaaatatacataacaaaatttaccattttaaccacgtttatgggtacaattcagtggcattaacattcagaatgttgagcaaccatcattaccattcattttcagaatttgttcatcccaagcagaagctatgtacccgttaatcaatagccaacccctacccttccttctccccacctgtctctggtaaacactgttctcctttctatatgatcttgcctatgctagtacctcatataagtggtatcataattgatcttttgtgtctggcttatgtcactaagcataggttttcaaggtttatcctgttgtagcatttatcagaatttcatccctttttaaggctaaataatattccattgtatgtattgtaccacatttgtttatccattcacgatagatatttgagttgtttccgccttttgctattcaagtaatgctgctgtgaactttggcttataagtatctgctttttaaacatttgcgcaaatccatcctcaagtatttttgttctataaataaacttttcgaggcatttcacaatttagaggtcaaatagaaattaataataacatacatttttaaatagttcaatgttttattatcagcattcatattttttcaggctgaagattcagggatgaaataatgggcaaaaaactgaaatataattaacactacacaggcatatcgtaagtataccgtaatattttgctaattattggtttagaaaaatataaaaccaagaagtacataaattactttgtttttcatctttctgaatgtacttttacgttaaatacacagcaagtgcttatacttatttaaaggtaatcctttttttatcagccaaaacatgcttatccttagttaatcagaattcatttcaaaatacaaaacttcttaaatataagcatggcatgtagggctttagacccatactcttactggattggctgcttgatgattgttctccttcttttgtaatttcaatctcaattttggctttgatttttctctcaatctatttggagaccttctgcatactgcaagtattgtttatgtttcctctttaccaaatgtctccaaaaacttttcttttgacagtaagcaacaaccgtatcaacatgtgttttgtattttgcagccaattccagtgcccttttcagttgtagagattaatattgatctggattgcttgataatgaggccagcctgaagaagtgctatttcagcctcctgtatgtttccactaaaccttagtatgtgggccattttttgactctttaaatggaagactttttatagaattgatgtactgaaacttatcaatttcgccaattgctgcatagcctatttctgtcatagtaatattttgattagcaactgccatagcagctagacaagctcacattgtttgctcctcaacaaagcagcaaagtcttacatcatcttcccattttgaactgcctccatattcagggagaataacaggatatggtgatacactgatgtgaaccagagggccgttaactcttgttatagttacctgatttccaacaaaactcacaatttgggaatttttactgaattcgtttgtatccctttcacgtaatgttttaggcaaagtgtcactgtccacataaaccatattggaataataccacactgtaaattgagtatcttgaagcctgcaaaggacattgcatgtatcactccaggccaaagtatgcaccattgttccaagtttgagaattttttcttccttcccaaatcgtttcacagaagtgatatagatatctctatttttatcaatgaaagtgacttttctatcattggtaagtcctttttgatccagagcaattttcaagattgcatccttacgaggaagaagctttccatcatctaatagttttccagttgataccttgaagaaaaagattattttttcatcagctttgtctcattgctatggtatcattactcagagacacagtctgtgcattcagaatatgtgttctcactgcaggaaattttggagatgaaataaagggcccttcatatgaatataaatcgatactactaacatctacaagaagaaaatgtctttctgcctgcaggataaaactaacagttccttctttgagatcaaatataattggtgtattccagttctttgtggagaccacataacattgaagagacattgaaacaactaagtgtgcagagttcaaagatactttagtggccatgatggaattccaataagttcactgcatcattaagaatgttacgaacctgtatggtccttcttttagttaatattacttgaaactttttccactcccagtgtttttccaccacaggtgcaaaaacaacatgcccaattccacacactccagcagtctgagtgccgtcagttgaccacgcaatattaaatatgctaccagtgtttttctaaagcatgtgatcacccagttttattacgtaagtgtaaagtatgaaataatccaatagcaaacaattctccatctggagcccaggcaactaaagtaataggatgctcatgagattgtgaattgtacagtgggtggctgtaactatcccatgccttatatttacagtcttcaccagcagataagattattgactgagttccaatctatttttaaaatgatgccatcataagccttctgtaaaactttagcatttgatcgaagaggtttctttttgtgagacagagtctcactctgtctcccaggcaagagtgcagtggcgtgacctcggctcactgcaacctccgcctcccaggttcaagcaattctcctgcctcagcctcccaagtagctgcgattacaggcgcccgccaccacgcccggctatttttttgtatttttagtagagacaggggtttcaccatgttggccaggctagttttgaactcctgacctcaggtgatccacccacctcagcctcccaaagttctggtattacaggcgtgagccactgtgtcggccactgaagaggtttaatgattagctgcttgcctgctgtataaagaacattttctgaatcaggaccccacactactgaataccattcctcagaaggcactcctcctttttctgtacttgataagtatattttctgggaatattctctgggagtagtcaggagctgacctgggcttgctgagctaaagttgatctaagcatccaagtctttgaccaaatttttatttgtccaccttctccaattgtaactaatgctgttgcttcatcattctatcttcctgcaagtattctccagagtgagctgctacacttttttccactctttctaacttggaaatcaaattaaatttatcatcagaacttatgaggacaaagctttctgcttgaatttgtctcttatactcaaactctttggaaaccggtgaagatctatagggtaaatatcatcaggaagctttactatttgagttgttccactagtgaacaagttcctcttcactatctggtgatcatcactatatgaatacagcccttcagcagtagtccagcctacacagcttactaattcttgatgctttggttctcttaaaagagatatcttcagtctcatgactccacttccagcaaaaatttaaaatgccacttgattgtatttactcaagttccaggaaagcagtggcaattgctttcatatagctggtaccagttaccaagaagcctctcgatctcctggtcaccatagtgacttcttgactattagtcttttaactatgatgtatgttgcaaacattttctcccagatttttatactcttttattgtgattttcttttttgccttatagaaaattcatttttatagagccacatttatcaatcttttattgcatctgtattttagacatagaaaggttttccccacactcaggttataaaggaatggatccaacttttttttctaatatttttataacttcatgtatttcatttgtattcttgatgcatttggagtttattctgacatatggtataaggaatggatgcaatttcatcattttccaaatgattatagagtgtcttgacactcattatttaaaaagtgtactttttttatctggtggattgagttgacatttatataatatacaaacttctatttgtatttgggttttttttcctggacttcctaattttttccccactgcttagtctctctattcaatgtactatatcacagtctttcaaatatagagactttagtacatatttcagtatctggtaacactagctgctgatcagatagctgtggttctatgatggatatgatttttcattttctaacttcattccgtatgtttctgttatacagactttatttatttatttatttatttatttattttaatcaggtgaatttatctgctggcattcgtgttttccagggcctgaagaaagtggattgagctcgtttaaggactatactccattctttctttctttttttttttattatactttaagtttttgggtacatgtgcacattgtgcaggttagttacatatgtatacatgtgccatgctggtgcgctgcacccactaactcgtcatctagcattaggtatatctcccaatgctatccctcccccctccctccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctacatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagactttaaatctcacttgctgactttgaaaatttttgttggtattttacagaggttgtaataaacacatggattgaatgataaatgacatgtttatggtgttgaagtgttttatccacgaagaaaggatggctttccagttgttaaaacctatcttaagtttttaatattcaactctttatgtgcttaaatttgttttataagttgtttccttcctgggttgtaaaggttgtgctttaatcatttatgtatttatttagttagttagtttgctttcacttgtcacctcgaacaatgtctttaatatagttgttaatttgattttataagtatccagtgacagaaatagtactcagtgatgtggttactatccagctaaaaggatatagaaaagtattaggttggttgtaatggcaaaaatccacaattactttgcaccaacttaataaatttagaaatccagttgactcttaaattttcttattattgttattatcttttaagatggagtctgactctgttgcccaggctggagtacagtggcagtggtgtgatctcgacccactgcaacttctgccatccatgttcaaataattctcctggctcagcttcctgatagaagggactacaggtgtgcaccactacaggtgtgcgccaccacacctggccaatttattttttattttttattttttatttttagtagacatctggtttcaccatgttgttcaggctggtctcgaactcctgacctcaagtgatacactcacctcagcctccgaaagtgttgggattacaggcataagccaccatgcccagcctaaattttcttattcttaactcagaatgtgttctagaactttgaaactgattttgcaaaaatacgaatgtaaattccacagttaacaaataacctgagtgtcgcattatttataaagctttctgtgacatgcttccctgcctacctatatattttttaatttatggtttttattggctgtatattagatacatatatttatggggtacatggcatattttgatacagacatacgatgtgtaacaattgcatcagggtgaatggggtgtccatcacctcaataatttatcctttctttgtgttacaaacaatccaattatactcttttacttatttttaaatgtacaataagttagtgttgactgtagtccctttgttgtgctatcaaatactagatcttatttattctaagtttatttctggacccattaaccatccccacatcccctttcctacccccaactacccttcctagcttctggtaaccaccgtctactctctatctccatgcgttcaattgtttgaatttttagctcccataaataaatgagaatatgtgaagtttgtttttctgtgcctggcttatttcacttaacatagtgactttcagttctattcatgttgttgcaaatgacaggatctcattcttttttatagctgaatagtgctcccacttttcttcatccattcgtctgatgatagacacttaggttgcttccaaatcttggctattgtgaatagtgctgcagtaaacatgggagtgcagatatctcttaagtatactggtttcctttctttgggcatatacctagcagggggattgctggagtatatcatagctctatttttagctttgaggaacctccaaactgttctccatgatggttgcactaatttatgcctacctatcatttgactgttctttctctgcatctccatgtaccacatagatggttctgtattagtatccatcccactctagtgctcttgtcaatctctccctcttagactgtaagctcattggaggtattgactgtgactgatttgtctatgcatcctgctatcataatacctatcttaaggctgccctcgttaaattgtcacaggatgatttcctgctaacagaattttgtgaatagaattaaatgttatgaatctagaattttatactgtaaaaacatgctgatataccattgcagaatcaagaagataggatcattaagctggatgttcagcatctacttgccatttataatttaaatatgggaatgtgacccaaatttgaaggattttcttcactccttaagaacttcccactttctctactggttttataatgtactatgttgactattttcaactataaaggcatatcacagtatcaattatttgcattaaacctgtattttctgtctataccctgccaagtaaatgagagcccaaatgacattttcacgaacatatttattttttgtttttatttttttttgtttgttttctcttgctgacccttaatgaaggctaggcaaaaatggagtcgactttgatgcagtcaattttaatttttgcttagtgctcatgaagtctgctgcccagtgagttgtatcatctgcattgttgtaacatctgaatcaactgtggcctacactgtttgatcaggatgacaaaattgctttatttattcttcttttacagttatagcctgcagataaataggcattattataggggtcaagcttgatcatgctgcttgttatattacaagattttctctgtgactacaatggcaaattgattagataaaacttattaacatgcaatgccaaataattgatttattatactaaaatacctctcatgcctaaatcagttacaataactcatttttagtatggaaaaatcatgcttatgcattttggggtttccctgaacactaaattagctacttaggaatttgtccttgccaactcaattatcatatcatatcattagtcttgtcttcttttctgtcatttctctagtaaagttacatcagactaataattcaagtatactgtggtgagtgcttaccttgaaaaaatatatttcttgagattctattttttatttaaatattctttttatatgcactgctacaaaacaagcaagtgctattgttgtactgacaacagagatttatttagcccctccagctgatcaactgagggattttagtttgtagccatgtctagacaaaatgcaaatgtgagtatttgatgctttttcttaccatcagtatgcatttggaaagtgttaagcattacttctccgggttgtttcatagaactaattatcaagatttcaaagacatctttgcatagatggtgttttatttttttggaataaatttatccctacatttgttttctagaaagacattgatagagtcattctcataacaggatgggatggaattaaggtaacactaatagggaatgaaaggtcatgaaactaaaatatatgttttgcgtccaatgggtacatttatcattgacagctggaaatttcaggacacctgatgatgaaagaagaaaaatactcaaaatgactgcaagagagttgtgggtactctcttcacatctactggataccttccattagcttctgtgcttctccgcatgatttctctgattacaagagcatgtaagtcccaattgagtacaagcaaaaaaatgtcaagaaattaacatccagctgaggaacgcagctcctcaccagcaacggaacaaagctggacggagaatgactttgacgagttgagagaggaaggcttcagaagctcaaactactccgagctaaaggaggaagtttgaaccaatggcaaagaagttaaaaactttgaaaaaaaattagacgaatggataactagaataaccaatgcagagaagtccttaaaggacctgatggatcagaaaaccatggcacgagacctacgtgacgaatgcacaagcctcagtaaccgatgcgatcaactggaagaaagggtatcagcaatggaagacgaaatgaatgaaatgaagcatgaagagaagtttagagaaaaaagaataaaaagaaatgcacaaagcctccaagaaatatgggactatgtgaaaagaccaaatctacatctaattggtgtacctgaaagtgatggggagaatggaaccaagttggaaaacattctgcaggatattatccaggagaacttccccaatctaacaaggcaggccaacattcaaattcaggaaatacagagaacgccacaaagatactcctcgacaagagcaactccaagacacataattgtcagattcaccaaagttgaaatgaaggaaaaaatgttaagggcagccagagagaaaggtcgggttacccagaaagggaagcccatcagactaacagctgatctctcggcagaaactctacaagccagaagagagtggggcccaatattaaacattcttaaagaaaagaattttcaacccagagtttcatatccagccaaactaagcttcataagtgaaggagaaataaaatcctttacagacaagcaaatgctgagagatttcgtcaccaccaggcctgccctacaagagctcctgaaggaagcactaaatatagaaaggaacaactggtaccagccactgccaaaacatgccaaattgtaaagaccatcaaggctaggaagaaactgcatcaactaatgagcaaaataaccagctaacatcataatgacaggatcaaattcacacataacaatactaatcttaaatgtaaatgggctaaatgctccaattcaaaggcacagactggcaaattgattaaagagtcaagacccatcgatgtgctgtattcaggaaacccatctcacgtgcagagacacacataggctcaaaataaagggatggaggaagatctaccaagcaaatggaaaacaaaaaaaggcagggattgcaatcctagtctcagataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacaagacagaaagttaaccaggatatccaggaattgaactcagctctgcaccaagtggacctaatagacatctacagagctctccaccccaaatcaacagaatatacattcttttcagcaccacaccacacctattccaaaattgaccacacagttggaagtaaagcactcctcagaaaatgtaaaagaatagaaattataacaaactgtctctcagaccacagtgcaatcaaactagagctcaggattaagaaactcactgaaaaccactcaactacatggaaactgaacaacctgctcctgaatgactactgggtacataacgaaacgaaggcagaaataaagatgttctttgaaaccaacaagaacaaagacacaacataccagaatccctgggactcattcagagcagtgtgtagagggaaatttatagcattaaatgcccagaagagaaagcaggaaagatctaaaattgacaccctaacatcagaattaaaagaagtagagaaccaagagcaaacacattcaaaagctagcagaaggcaagaaataactaagatcagagcagaactgaaggaaatagagacacaaaaaacccttcaaaaaatcaatgaatccaggagctgtttttttgaaaagatcaacaaaactgatagacaactagcaagactaataaagaagaaaagagagaagaatcaaatagacacaataaaaaatgacaaaggggatgtcaccaccgatcccacagaaatacaaactaccgtcagagaatactgtaaatacctctatgcaaataaactagaaaagctagaaggaatggataagttcctcgacacatacactctcccaagactaaaccaggaagaaattgaatttctgaatagaccaaaaacaggctctgaaattgaggcaataattaatagcttaccaaccaaaaaagtccaggaccagatggactcacagccgaattctaccagaggtacaaggaggagctggtaccattccttctgaaactattccaatcaatagaaaaagagggaatcctccctaactcattttatgaggccagcatcattctgataccaaagccgggcagagacacaaccaaaatagagaattttagaccaatatccttgatgaactttgatgcaaaaatcctcaataaaatactggcaaacagaatccagcagcacatcaaaaagcttatccaccatgatcatgtgggcttcatccctgggatgcaaggctggttcaacatatgcaaatcaataaacgtaatccagcatataaacagaaccaaagacaaaaaccacatgattatctcgatagatgcagaaaaggcctttgacaaaattcaacaacgcttcatgctaaaaactctcaataaattaggtattgacgggacgtatctcaaaataataagagctatctatgacaaacccacagccaatatcatactgaatggacaaaaactggaagcattccctttgaaaagtggcacaagacagggatgccctctctttacccctcctattcaacatagtgttggaagttctggccagggcaatcaggcaggagaaagaaataaagggtgttcaattgggaaaagaagaagtcaaattgtccctgtttgcagaggacatgattgtttatcgagaaaaccccattagcctcagcccaaaatccccttaagctgataagcagcttcagcaaagcctcaggatacaaaatcagtgtgcaaaaatcacaagcatttttatacaccaataacagacaaacagagagccaaatcatgagtgaactcccattcacaattgcttcaaagagaataaaatacctaggaatccaacttgcaagggatgagaaggacctcttcaaggagaactacaaaccactgctcaatgaaataaaagaggatacaaacaaatggaagaacattccatgctcatgggtaggaagaatcaatatcgtgaaaatggccatactgtccaaggtaatttacagattcaatgccatccccatcaagctaccaatgactttcttcacagaattggaaaaaactactttaaagttatcatatggaaccaaaaaagagcccacattgccaagtcaatcctaagccaaaaaaacaaagctggaggcatcacgttacctgacttcaaactatactgcaaggctacagtaatcaaaacagcatggtactggtaccaaaatagagatatagaccaatggaacagaacagagccctcagaaataatgcctcatatctacaagtatctgatctttgacaaacctgacaaaaacaagcaatggggaaaggattccctatttaataaatggtgctgggaaaactggctagccatatggagaaagctgaaactggatcccttccttataccttatacaaaaattaattcaagatggattaaagacttacatgttagacctaaagccatgtaaaccctagaagaaaacctaggcaataccattcaggacataggcatgggcaaggacttcatgtctaaaacaccaaaagcaatggcaacaaaagccaaaattgacagatgggatctagttaaactaaagagcttctgcacagcaaaagaaaccaccatcagagtgaacaggcaacctacagaatgggagagaatttttgcaacctactcacctgatagagggctaatatccagaatctacaatgaactcaaacaaatttagaagaaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataagaacacttttgcactgttggtgggactgtaaactagttcaaccattgtggaagtcggtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccgcagttctcactcataggtgggaattgatcaaagagaacacatggacacaggaaggggaacatcacacaccggggactgttgtggggtagggggagaggggagggagagcattaggagatatacctaatgctaaatgacgagttaatgggtgcagcacaccaacgtggcacatgtatacatatgtaacaaacgtgcacgttgtgcacatgtaccctaaaacttaaagtataataataataaaaaaaaaaggaatctaaatttaaaaaataaaaaagacaaaaaaaaaagaaattaacatcttaggagcaacctttatgtaacaactagaaaggattggtactagaaaggactagagtactagaaaggtactaaaaaggactaggaagtctagtccagtgtctgattcttggtggacctcacctaagacagtgaataatgtctctgctccctcagaatttaggtggctggaagaaaaatggtactctatttagtaaattttagttgtgcaaacaaaagaaacacctctttgctcttggaagcttgcctccttttttccctggaccagagttatttttttgctaattggatcactctctgttgaagttgggttggagcacaaagaccaacttaaaggcctctgaggaagtatacagcccctatgtccaaatccaaaccttggaatcttacctcccttgtcagcataatggtacagcaagcccttttaggcatgcttaagtaagagagagcaaaggaaagaagacagtggagaaaagagggtgagtttctcaacatggtgcaagagaaagtagaaggagggctctcattctataaaaccttttcgtgagcagtgagcttcctcactgtatgcagcctgataatggctctagaatgccttggaggcagaaagaattaaggagaaaagaaggaaaagggagaagattgaaaaccagaaagagactttctttccccttcattcttagcatgggtatgtcagttaaatcagggtcatggatgtttgtaaatttaaaaaatgcccctcagaatttgggcagcccgtatcaatcatataccaagaacttaaattattcattcatgccaagatggggagtgactcaagatgacttcatatatctcttaagaatctccatcctcagtcgggcgtggtggctcacacctgtaatcccagcagtttgggaggcctaggcaggtggatcacctgaggtcaggaattggaaaccagcctggccagcatggtgaaaccccacctttactaaaaatacaaaattagccaggcgtggtggcaggcacctgtaatcccagctactcgggaggctaaggcaggagaatcgcttgaacttgggaggtggaggttgcagtgagccgagatcgcccattgcactgcactccagcctggataacaagagtgaaactcagtctcaaaaaaaaaaaaaaaaaatctccatcctctgtgtgattctcctaacatggcagaggtcgtagtttcctatagaggatgatcccagcaccacattctaaactgacatgattcttcttatcctagccctaaactctctcaattccatttttcttcttcttttcacaaaactcaactttccaggaagcaaaatgaaactggtcctaaacatgtggtgcttttttacatcattatgttgttgagtgtataacttctacttcaggaatgctttttaccttccatgtggaagtacagtttagtgtaaagcagtggtccttagtttgttgtccttagaccagcagtatgagcatcaacaagggagcttgatagtcatgcaaaattttaaccccacccaagcatactgctgttagaaactctactggtagaacccaggaatctgttgttcaataagcccttcaggtgatcctgatcctccataaattttgggacctactcatgtaataattgaccgctgcaaatactgggaactgagacatgaaaatctcactgtagcttggtgtaagtctagatatcccagttattctaccccatcccctttcattgagagacacagttgtaattacgaatgctcattggtcttgatttaggaagttggtgagaggggaaagaaaggctcattagttcccgttagggataggcctggataattgtagtgggaatagatgaagagaaaacctgtggtatttggtttttttccttccaggatgagagaggatgccttcctatttcaaaatatctcctccacattgactgaaatttcacgaattagagctaataagaaaacattccagaatatgttaaagagtatgtgggaagatgattagtcataaacttaatgtgaattagctttcattctaacctggctgatatgctttaagtaaatgagagtttgattttagggaagggtagttccaaagcaagacacacacgaagctgagtaagaggtgtgtggtggggaagggggcgataggcaagaatttaggatgttagagtccttggagagcttggacagggcaccaagtgggaggagagaagtactgaaggtatatgccaaagccaataccaactgtttccttcatttcacatccctcctaggagtcatcagctctcggtaaaggatagtggttatttgattttttttttaacatcctcacttacttctccctcactcatttttattctcctagattcagaacattggagtttatggaagcaaactggtatttttccagcaatagcatggaaaataaactgcaaagaagattctgtcttgaatgaattctagggaccagtaaatgctacaagaatcacttgaccttttaaaaaatgactagtctttgtgctaagtgtgaaagcaatgctatgcttccattgagttccacaaatctttttggtgcaggaaaatgctaatgggatatagcacaaaagcttcaaggtgggagacacagctgccttagagagtctgtcattgagaaggaggggaaagggccattagacaaatctgtgtggaaatacaggatttttggaggcacaaaggacaataggagtttcatggataaaacacatactgttttttgacacccaagaatttctaagatttggcccacaaccaggtgaaaacaggagatggatttatagagctttcttatccctctttgtgtctagctgctcaccatcctcctacctcaatttttcttcttcttttttttttcagatttgtcaggtctgtcacattttgtgtctagcttttggttaaattactctcacgaaagatacttaacctataaaggtcaagtgcagaaaattgttcagagtcactaacttaaggtcatatggctacctagtggcaacagagagatctatggctccatgatcttgccataatttcatttgttatttctgcctgtaaatagacctactggctctgcataaacatggttgatttgttgctaaaaagattacaaaaataattgcaacctcgaagtttgagaacctgtctctagctcacttaaggtctttcctcacacagtgagggctggcaagttgatgcctcagatttccactgtgctccttaggatcagcagagaataaatttgtattgagtctgcacagtttcattcaatatgcacgtggaagcagtgaaacaaatgcagtgtagctgatttcccaagagatgctgctaacgtgaaccagaagctcattcagaataattaaatggacatattccaaatatatatttactcacatcagtcacttccctccccagtttccggtgcttcttgttcctttgcactcaatctatcagcaggaaccactacctataatcttgttaagagcagttaaataggaataactgcaggtactgtttaattcactttcaggaaacaggctttaattgaagagttcccatcactttccatgtacttcccaaaatattagaggttttaatttgcttttactgaccatcatcatgtaagaaagctttcatggaagaaagtcttatatgaagttctcaaaatcagagaaagatgagagtacttgagaagtaaaatatgtaaataaattcactctgcaaggaattctagctgatgaatattacttttgttatagaaaacttcctatgtttaagattcattcaccccaatggtatccttggaattctgagccaatatctagatctccaaattagatatgcaaaccagactgtctttctcagaggtctggactgcagtaggcatttcaaatgatctgactacgcaggagctcactttctagcttggatcagagagataaacaccaggtaaagtcagaaaagtcctcaggggcccacctctctgttggtggcctgccttttgagccctaacaagggagccagctacaggacttctgctattgtttcctttgagttgccaacagccttagtttccctaagttcccaattccactctccgatatgctttttctgcattatacgatctctgctgccagccctcactattcaccgtttcctcactgcacccttttatatctcctgttagtttttgataatgaaccatgctaaggtgacacagaatatcgggcctgagccctttctttgatatctggtttgtattggtaagcccctgtaagaaacatcccccaaatctcagtggcttatcataacaaggatttattttttgcctacatcacagctcaatgcagattaggaagctgtcttccaagtaagaatgcaagatgctgggctctttctttagggtggctttgccatcctggaattcttcacttccagttagtgggagaaagaccagtacctcacaagaacttttggggtccagtccgttccattggcaagagctagttccatggccccaatctaactgcaagtgagactgggaaatacactctttttgtgcatcttggaagaggaacggagttggtgaacaccaacctactctctgctatcctcgttgctgaatgacttactgacttccaatgaagggagcaatattaaggaatcactgtactggctaatggaaaacaaagcaagcacagtttgaatttaattattttctcttccatgattacttaaccatatcccccaattttactatttattagcatgaacacctatgcaaaattctgaagatccaaattactttaattatgactttgatattacttcagcagttttaaacaaatagaaaaagttcaaaacattcttaacccagtcagcagagtcatctccagagaagcttctgggaatagtttatctcacttttgtggtgtcaataaaagatatgcatggatcatctgaattaataagtaaagagttatagattgattaagatgatagctaatgcttttcctgtcttctagcatgatggccagcagcctagcacataataagagctaagaaatacaagctgatttctttttcccttctctgatgagtaatttctctggtgaacctgagaatggtctttgaaatcccttgttaggaagttgaagcttatgtttgttagagttagtccattttgtgtcttcgctgttttcaaacattttgttttttcagacttggaaatccatggtcaaattcaatatcatctgtgcacttatgtgaaaacacagagaggtgctataggccaaggatttcattcagctctcaaccccactgcaaggtggccacagggctctagagagcactcctccgttgaggaaatggagacccactgaagtgagatttgtgagcctcagaggtcacgtgttatgccttcagaagatgatttctaggcagttcatgaagtttctaggcagtgataggctatttccctattttgagtagtggagaccagagatgaggccagtggctacagtatttgggcactgaaaattgaggaaagggaaaaagtgctgtgatgttagtgctaagatgtccatctggttttgtccagcatgatactccagaaggcaaagtcttgtcccacagaaatatctaaatttaatgcctagattccagggatcagtgctgaaggggaaaacagaaaaattgttttcttttttttttaatttaggaagaatagattttgccacaccaatgcaggatgttaccacactcactccatctaagacatggcttgttttgacagtcttttagcttatagccctggctcatgctgatattttttaatgtaaatgagtttcttagattattaaggcaataattcttccctatactcctgtttggttcgatttgatgactgactgtttttttaatcttggttgaagattcctgaaagcgaagttgcctcaagtaattacacttacctcaaggaaaactgtattgtcgtcacataaacatcatcaaatatttaaatccacgccatatttaaaatgtcttttaatcctttattttatctcctgagagaacagtgtatcttttaggttgacttttaggccaacacactccacacctaattttggattttctagtttcatatttaattaacatcttatgttataaaaatgtttaaatatttgacttgtttcaattgatttaagaaaatgtcctttctcccagagaaggagaattcattatttcagtcaataagtcatgctgtgacaggtaaagcttgtctctatgataatgcatttgaatactgttttaggaaatagctgtaaatgttgcactgtatggacaaaatagaagcataactgcagttttgcagtttacagtttcgatagatatatatttatgagtacctattgtacaaagctgtaggtccataatgaactaaatatttgtatctctctgaagatgctaggggatattcagacttacgtcattagccctctgagattagataattcctaagtcctgacacctctactttttcctgattagaatgaagataacgatccctgtgtccaatatgtgggatgctgtgagacctagtgagctcaatacatgtgaaaatacatgtgtaaaagtgtcaacagtctgactcctttttaaaattaaggagttagagtaatattgccaggtaaaatacaggataaccagttaaattatatttcagataaacaacaaataacttacacttgctaaatctgggaatcttaaattggggttattgagaagcagtctctgtcattttcctaaggaaagagaaatttcccatcccttcaatttcattacctacattggtgactgatttttcaggagggccttttgggagctcctgtagtcagtgttaaggaaagccccaaagttttgaatgtagcagcaacgtaacctgaacaattctatagccacaaccatttaagagattttgataactgattcatagacactttgaaactgatgttcaagaaaaatcatctaatttgttccatttagagatgaagactcaaacccaaagttgtgaagtgtttgccattatagaggtagctagaagaacggctgcagctagaacttccttctcctgactcccaggccaatgttcttcccactccaccacactgggtctgggggctaaatccaagcagccacctgcttttgtaaataaagtttaatttggagcacagacacatccatttgtttacatattgtctatggctactgtaactgtacaatggcaaagttgagtggttgccacagagactgcaaggttggcaaagcgtgtatttattatctggtagtttacgaaagaagtctgccaaacactgctaaaggagaatgtgttgattgtcttcacctcatgattataagtatataactggctttgttcttctaattatcacagaaccatactaaatatatgtattttttcaaaaagcataagctgcacaataccatggatgaacacatagattaactgtagtagtcagtttcagaaaagtggactagaaattgtcagaacttttctttttcctcttaacacttttgatcctataatgagggcaaactacaggattagtgagtaatattgacaggtcaccgtgcacagggcattatatctattttaggcattctgaaataagttatggtgtttggatgctgccatcaagataagtagtaagtcatattaaaaagttcattagacttactttgtattacctagcacatcttaaataattctaggaacacaatgtgatactcagtatatattcatacaaatacagatgcttacactttaagctatcctgaatatcttcagagagcagagtaagagacagaaacagatctaagatcttgtcttagtcttattcctctcaatatggcaatgacaaaggttatcactagaaggagtgcgttcctcttctgtctgaaagtgtttaagcagctccaagatgacctttgggaggttgtagagaaaagggctggactacttggctaaatccctttttgtgcaaaggttctatgataccagtctatgacattttggaagcctcgtgtactgtctcctttgtatcacagtgactggagtcttctctcaggcagcctataaggatagacattcataatatcacaagtgtgtttgaatcctgacccactgtccatgttttcctaacaagactgttttagaagtttgttatgtctgcataaaataatcctgaaaaccacatccttaactaaattgctctcatgtatatattgaaaattattcatggctctatgcttggccaagtttgtgtcaaatgttgttttttattttatttctttgaagctaaagataacttgtcatgggccatgtacttggagaggtacttcgattgcttaaaaggagaagaaagaatgttcaggtcagctcagaaaaacataatttgtttgaaatcatacaagttacactgtaacgttagataacgccttgaactatggtgaagtagatatacctgacctccagggattctgcagcagttactggatctgattttctgtagatagtgaagagccatgtgaggagtagtcctcaatcttctgtaagaacctttctctttccttggccacagaagcaatgaagagaataagcagtaaatggcatttatgccattccacatgctttatacattacttcacttaatccacagaataagttgagtattgttaaccttccgttttataatgatccttagacagttatgtaataagctcaaggtcatagagcttgaagcaaaggagctggtattctgatttaggtctgttggattccgaagcccctactggggcgattttaccacaatgtctcccaccggcaatgaagaatccaagtaacacagactttggctttatgatttagccaaagctatttatagcctgtttttacatcaattcaaatgttttcattaagcccttgctgtgtttgaggcactgagctaattgttacagaaattcagaaatacttcatcaccctcaaggaccctcaaggatcttataatctagttaggcataaaagacatgaagatatgaaaagataactgaaaatggaaggcagcccgtgccaacagctgactaagtggaatatgtaagtgctacaggggcttcaaggcaggcaagttaccaccagctgcaagtaaaagcagaaggaatggaatttgagtctgaatgcagtataagatgatgttacagcccatcagtcagatgaggattgcagtctgtacatcacagtttgtctacagacctgttttgttagcttgcataggttttttttaatcctaaaaaatttacatataaatatggttctgttttgtatcaaatttttcaggatacttggaccatgcatgttcatgtgacaaaagacagggcccatgttttccagttagctgtggcctctgctgtcccggaagctacagtttctcggcttccttcatctacatttctcatgtggccttgtggatatttgatcaagataaggaaagtgaaatccagagagtgaagtaaagtttattaagatcccaactcattacttacaagctggatttgacccaaaaatttcaaactattagtccagttttattttaatagaccacactatcattcatgggatttggttcatactttttggtagaagatatataatttattattcaacatctatagggcctgatgtgtttggaaaggcagtttttttaactttataaagataatactattcctatatgaacttttatgaaagagtctagcagagtctggtgtagcatctgataattaatatttttaacgtgaaatgtatgaatgttcaccccaagtggcagaaatatagactaggcatagccaccaattcagatcagatttttatatcaaatttcctttttttaaaaaaaatttgtaaacttgtaggatttcagaattgcagataaattgtggatagctataaatatcaatattcttgtgtctgttgctcaggatttttatctataaatgcagatagcagttcctacttcattaaatatttaatactatatgtaaaaaacagtgcctagagcatagtaaaatctgtagaagtaatgggtattgttactattttctattattggtatttttgtgtaaaatatgcatttcacaaatcagattattgatatttcttctgcaaccaactcataaatgttaactttcaagcatgcagaggtaccatacacaaaaaaatgagactccatatgatcagttctgaatggctgactccaatccagtgtaggcaaacaatggtctatggggcacatgtggcctgctacctctttgtaggaacagcaagataagaatggttcttatattttgaaatggttgaaaaaaacaaaaagaacactatttcatgacatatgaaaattgcatacaatttaaatatcagtgttcatacataaagcttaattgaaacagtcatgccctttttcacgttgtctctggttgctgtaatggcagcgttgagtagttgcaacagagactacatgttcctcaaagcctaaagtatttataatcttgtgcctttaaaggaaaagattcctgacccctggcctgacttactgctggtcacgatgtctcttgatatctctggctcctcacttggttgcccttctgcttccttgtctggccttcccaatcaaactatttcactctacttggtttcctaagatgaccttagatttgcttctactgccatctgggacatccctccttctctgttgcagaatttgatcttctccattcttttattacttttcccatagactttgtgtctctttgttttcctagttctgggagtggaaagcaggactctgatctatggctgacctagaattaatgtgtggaagtacagggtagtgagcaggggtgcatttcctctgggataatgcagtttgtaatttcagatgttatttcaagcttgtctgagatgccaaacgcccagcctaaaataagccttcatttagaaaaatctgtattttcacaccatggggattttgcttcttagtgtatctatagataaaattggtaataaacccaaatccagggcaactgaattttccatcagaatgcccagcaaaaggcctggtagctgaggctgtcctttgcactcttttgcttcttcaatggagccaatagagcatgaagaggggaaaattgcgcacatcacccaaagagtttggaataccccatgttactatgatatgggtcttgacttgcgtagataacacaagacctttttatcccccgtttctttcaagccactacgttttcttttttcatactttaatgattttaaagggaagttcagtataaggtaggcagagataagatgggaaaggaatttgaattatctgggaactcttaggagaattttgtcctcatttgtcttatgtaatacacacttttgagtcctcataatgatctgaataaaagaacattttactacttgtaggtataattatataactgagtaatgaatttactaaccaaaccttgacgttgccaacaattcaaactgcctttcatccacagcctctttcttcttcttctttttttttaaattatagtttaagtactgaggtacatatgcagaacatgtaggtttgttacgtaggtatacacgtgccatggtggtttgctgcacccattaacgcatcatctacattaggtatgtctcctaacactatccctcccctagccctccaccccccgacaggccctggtatgtgatgttcccctccctgtgtccatgggttctcatagttcaactcccacttataagtgagaacatgtggtgttttgttttctgttcttgtgttagtttgctgagaatggtggtttccagcttcgtccatgtccctgtaaaggacatgaacccatccttttttatgtctgcatagtattctgtggtgtatatgtgccacattttctttatctagtttatcattgatgggcatttgggttggttccaagtctttggtattgtgaacagtgctgcaatacatatacatgtgcatgtgtctttatagttgaatgatttataatcctttggttatatacccagtaatgggattgctgggtccaatggtatttctggttctagatccttgaggaatcgccacactgtcttccacaatggttaaactaatttacactcccatcaacagtgtaaaagtgttaccatttctccacatcctctccagcatctgttgtttcctgacttttgaataatcgccattctaactggcatgagatagcatctcattgtggttttcatttgcgttgctctaataaccagtgatgatgagcattttttcatatgtttattggctgcataaatgtcttcttttgacaagtatctgtccacatcctttgcctactttttgatggggttgtttttttcttgtaaatttgtttaagttctttgtagattctggatattagccctttgtcagatggatagattgccaaaattttctcccattctgtaggttgcctgttaactctgatgatagtttcttttgctgtgcagaagctctttcatttaattagatcccatttgtcaattttagcttttgttgccgttgtttttggtgttttagtcatgaagtctttgcccatgcctatgtccagaatggtattgcctaggttttcttctaggatttttatggctttagttgttacatttaagtcttcaatccatcttgagttaatttttgtataaggtgtaaggaaggagtccggtttcagttttctgcatatggctagccagttttcccaacaccatttattgaaaagagaatctttccccattgcttgtttttgtcaggtttgccaaagatccgatggttgtagttgtgtggtattatttctgaggcctctgttctgttccattggtctatatatctgttttggtaccactaccatgctgttttggttactgtagccttgtagtatagtttgaagtcagttagcatgatgcctctagctttgttctttttgtttaggattttcttggctatgtgggctctttttggttccatatgaaatttaaagtagttttttctaattctgtgaataaagtcagtggtagcttaatggggatagcagtgagcctacagattactttggaaagtatggccattttcacgatattgattctttgtattcattagcatgaaatgtttttacatttgtttgtgtcctcctgtctcatttcattgagcagtggtttgtagttctccttgaagaggtctttcacatcccttgtaagttgtattcctaggtattttattctctttgtagcaattatgaatgggagtcactcatggtttggctgtttgtctattattggtgtacaggaatgcttgtgatttttgcacattgatttcatattgcaagacttggctgaagttgcttatgaccttatggagatttgggggtgagacaatggggttttctatatattcaatcatgtcatctgcaaacagagacaatttgacttcctctcttcctatttgaataccctttatttctttatcttgcctgattgccctggccagaacttccaatactatgttgaatagaaagatccacagcctctttctattctcagttcttcaagaattggttaccttaaagcactttcttaactggtgatgtaggtttttagtatcatcaatatcgtgtagttggagtcagtcagacctgtgctccaacatttactatggcctgagctgcaatttctatatctgtaaaatatcttctatcactcaaagaataataacacagtcaaaggaaagggtgtatgtcaatgattcagttggtgccaatgtaattgcagtttttactatcaaaagtcacatccaaggccgggcgcggtggctcatgcctgtaatcccagcactttgagaggccgaggcgggcggatcacgaggtcaggagatggagaccaccctggctaacacggcgaaacaccgtctctactaaaaatacaaaaaattagccaggcctggcggcaggtgcctgtagttccagccactcgggaggctgagtcaggagaatggcgtgaacctgaaggcggagcttgcagtgagccggagcttgcagtgagccggagcttgcagtgagccggagcttgcagtgagccggagcttgcagtgagccgagatggcgccactgcactccagcccgggcgacagagcgagactctgtctcaaaaaaaaaaaaaaaaaaaaaaaaaaaggagtgtccaaaactgcaattgcttttgcagcaactgaatactttgtccagtatgtcagacttcttgagctttccataagtgatggttgttaatactattagcagtattgagcagtgattgtggaatctcagtgtggccaactgcattgcaacttattgaaaataactcatgcataatttgtatatgtattgcatttatgaatatgtgtgtgctcatatttagaaaacattccctgtttaactatcatcttcagatataatgccagagaataattttaaatattaaatgaacatgcaaatcaaaatagttttaaatctgcaagctcaacaggactttagagattatctagataattgccttcattttacagatgaggttacttagtaatttgttcaaagtcacacagctagttgattgcagtgcacttcagaatagggtcttctagagttctaggtcacctctttctgctccttcacttagattctttttttttttttttcactttgtctcccagtattcatatatatatatatttttttttattatactttaagttttagggtacatgtgcacattgtgcaggttagttacatatgtatacatgtgccatgctggtgcgctgcacccactaactcgtcatctagcattaggtatatcgcccaatgctatccctcccccctccccccaccccaccacagtccccagagtgtgatattccccttcctgtgtccatgtgatctcattgttcatttcccacctatgagtgagaatatgcggtgtttggttttttgttcttgcgatagtttactgagaatgatggtttccagtttcatccatgtccctacaaaggacatgaactcatcattttttatggctgcatagtattccatggtgtagattcttatactgaatttaatttccatttaaatgctctccaccatttataaatgtgggaaacattcaggttaattattttttaaagtgtttacagttccctggaaaacaccacatttattgggtagtggaaatagaataggaggttgctggcagagtgatagttagtctctattaccacttgataacgagttggtttctgcataagaaaactagaaattggaattgtcattacccaccacccaacacacaaatacacacctttaccttcatttccatgttcggttttaggtcagatccctgtgggagtattctttgctgttaagtaggaataaagggggaaaaatggacatagctgaacaaatatttctatttgctttctttccaccagagttgaacttaacattatcagattgatttagagaaattattataaaaatcctctttgtaatagtggtctttatgaattgttatatttttctaatctgtggaatggtattttatccacatatttatgtataagaaaatggtatctgagagatgagtagcttatcaaggtcacatggttaattattggttaaactgagtcttgggttttggtctttaggcaacaagtccaggggcctgttatagtgaaggctatgagtctctttcttccctgtatttatgggtctcaaaaaaccttggaagcaaagggaatgagaaaagggaataggccatttcttactgaatatcttgcttggaaaactctaaaaatgcattcttaatacagattattaaacatgtttcttatggtgcattttgatacattttcttatttgcaaattgtatttcttcagcaagattttcattcttaaaacatctatttcttttttatttttccttttcttttcttttcttttcttttttttttttttttttttgagacagagtctctctctgtctcccaggctggagtgctttggcatgatcttggcttactgcaacctctgcctcccaggttcaagggattctcctgcctcagcctcccgagtagctgggactacaggcatgcaccaccacgctcagctaatttttgcatttttagtatagactgcatgttgcccaggctgctctcaaactcttagtctcatgtgatctgcccacctaggcctcccaaagtgctgggattacaggcatgagccaccatgcccggccaactacttctcaaattggcacaaatagatgctgttttattagtcccataacatctaattaaatttaatagcaataataaaaaccagtttgctaaattagaaattgccaactaaaaaaataagcctgtgtaattttcttttcctgtcacctttaaaaaaattttattacagatttagggggtacttgtgcagatttgttacgtgagtatattgcaaaatgctggggtttgggcttctagtgaacccattacccaaatagtaaacgtagtacctaatacgtagtttttcaatctcttcttccctcccagcctcccctacattggagtccccagtgtctattatttccatgtttatgtccatgtgtactcattgtttagctcccacttattagtgagcacgtggtattttttgtttcagaattatttcacttgatataatagcctccagctccatccatgttgctgtaaaatacatgatgaatgaagctggaggctatacatgtggttttatagctgtgtggcattctatagtgtgtatacatatcatattttcttatccattcatccattgatggacacgtaggttgattccataactttgctactgtgagtagtgctgcaataaccataagagtccggctatatttttttatagaatgatttattttcctttaggtagatacctagcattaggattgtttaatcgaattttagttccacttttagttatttgagaaatctctatactcttgttcatagaagatgagctaatttacgtttctgccaatagtgtataagtgttccctttctctgcctctttgccaacaatttttttttaaataacagccattatgactggtgtgagatgggttttcattgtagtttttatttgcatttctctgatgattagtgatgtcgagcattttctcatatgtttgttggctgcttgtatggattcttttgagaattgtctgttcatgtcctttgtccaccttttaatggagttgttttttctttctgatttccttaagtttctcataaattctggatgttagtcctctgttgagtgtgtagtttgcaaatactttctcctattctgtaggctgcttcctctgttaattgtttcttttgctgtgcaggagctctttaagttccatttgtctatttttgtttctgtcgcatttacttttgaagtcttaattataaattttttgcctaggccaatatccagaagagtttctcctagattttattctagaatttttatagtttcaggtcttacatttaagtccttcacccatcttgagttaatttttgtatatggcgagagatggggatctatttttagtcttctgcatgtgtctagccagttttcccagcactatttattgaatacggtgttcctctctctttgtctatttttgttgactttgtagaagatcagttggttataggtgtgtgactttatttctgtgttctctattctgttccattgatctatgtgtgtatttctgtacttgtacgatgttcctttggttaccatagctttgtagtatagtttgaagtcaggtaaggtcatacctctggctttgttcttttttgcgtaggattactttggctattctggcatattttagttccatattaattttaatcatttttttctaatcctgtgaaaattgatgttggtaatttcataggaatttcactgaatttttagttttttttatggacagtatagtcattttaatgatgtgaattcttcctattcataagcatgggatgtttttgcacttgtttgtatcacttatgatttctttcatcattgttttatggttctggtaacggtcttttacctcttggttagatgtattcctgggtattttatttttttgtgtgtggctattataaatgggattgagtttttcatttggttctcagcttgagcactattggtgtatgaaatgcaattgatttttgtgcattaattttgtatcctgaaaactgctgaagttctttatcaggtctaggagtcttttaaaagaatcattaaggctttctagttatagaatcatgtcatcagtaaatagaaataatttgatttcctcttttcctatttagatgctttttctttctttctcttgcttaattattctggctaggacttccggtactatgctgaatagaaatggttagagtagacatccttgtctcgttccaggttttaggaggaagtctttcaacttttccccattcagtataatgttaggtgtgggcttgtcatatatggctttgattattttgaggtacttccttcaaggcctggtttgtcgagcggtttttttttttttttatcataaagtgatgttggattttattgaattctgttttggcatcgattgagaggatcgtatagtttttgttcttagttctgtttatgtagtgaattacacttattgatttacatatgttgaatcatccttgcatccatggaataaaatccacttgattgtgatgaactgactttttgataagcttcttgatttgatttgctagtattttgttgaagattttggggtctacgttcatcaaggatactgacctatagttttctatttttgttgtgtcattgtcacattttggtatcaggatgatactggcttcacagaatgatttaaggaggaatctctctttctcagttttttggaaacatttccgaaagattggtatcagctcttctttgtacatctggtagaatgtggctatgaatccatctgatcttgggttttttttagttggtagattttttattaccgattcatttctataacttgttattagtctgttcaggatttcaatttcttactgttttaatcttgggaagtcatatgtttccaggaatttatccatttcctcttggtttctattttgtacacatagaaatgttcatagtagtctttatggatcttttgtatttttgtggtgtcgggtgtgatgacacctttatcaattctgattgtgcttatttgaatcttctctctttttcttggttaatctagatattgatatgtcagttttgtttatcctttcaaataaccaactttttgttttgttgatcctttgtttgttttttggggtcacaattccatttaatctttgttgtttctttgcttttgctaactttgcatttggttagtttttgtttttctagttcctttaggtgcagcattaggttgttaatttgagaactttctttctttttggtgtaggcatttagcgctataaaatttcctcttaacactgttttgttgtatctccattggttttggtatgttgtgtgtctatttttgtttgtttcaaaattttaaaaacttctgccttaatttagttgcttattcaaaagccattcaggagcaagttgtttagtttccatatatttgtgtggttttgagagttcctcttggtattaatttttaaattttgttttgtggtctgataatatgcttgatatgattttgattttagaacttagtgagatttgccttatgaccattttagaggttgtttcatgcacagatgataaaatgtatattctttggtattgaattgaatgttctgtagatgcctattaagtccatttggacaagagtccaatttaagtcctgagttactttattagcttatgctttgattatctttctagtgctgtcagtggagtgttgaagcccttcactattattgtatggctgtctgcctcttttcttagatacagtagtatttgtttgtgaatcttggtactctgatactgggtttgtatatacttaggatagttaaattttcttgttgaattgaatcctttatcattatataatactcttttatttatttttactgttgttttaaagtatgtttcatcagatacaagaatagcaatccctgcttttttttttccttcgctttccatttgcatgagagatctttcttcatctctttactttgagtctgtgggtatcattacacataatatgggactcttgaaggcaacagcaggttgagtattgttttttaatccaattttccactctatgtcttttaaatagagcatttaagctacttactttcaaggttaatattgatatgtgaggttttgttcctctcctagcattgttagctagttgctttgtacaattgtgtagctgctttatgggatctgtgaactttgtacttacctgtccttttacggtagcaagtatcatcctttcatttccatgtttagaaatcctttgatcatttcttatagggctggtctggtggttatgaattcccttagcatttgcttgcctgggaaaagttttatttctttttcacttatggagtttagtttgtcaggatataaaatgcatgaatgtcatttattttcctttaagaaggctaaaagtaggcccctaatttcttctggtttagaagaccgctgttagcctaatgggatttcctttataggtaattttgccctttactctatgccttcaagttgttttcattagcattgaccttggatagcctgatgatcatatatcttggtgatggtcatcttgtatagtatctcgcaggtgttctctgaatttcttgtatctgggtcttgagctctagcaatattagggcaattttcctgaactattctttcaaatatgttttccaagttgcctactttttcttcttctctatcataatgccgattagtcatagatttggttgctttacatagccccatgtttcttatgtgctttgttcattaattttttttaaattttgtctgactgggttgctttgtgttcatttcaactttctcttggatctcattgagtttccttgcaatctatactttaaattctttatctgtcattttagacttttgactctggttgggatccattgccagagagctaatgtaatcttttggagttgtcaaaacactgtctttttgtactgctggagttctcctcttgatttctactcatcttaaggaaccgtcgcttcttatttttgagttttctatcattttgatgggactgtttttaattttttatcttttcccttgagggtatgactatggtatatgttgtgtataatcatccggttttgtttctgggtgcttttgtgggggccaaggctctgaatgggttccttggttgtggataggttctgtgtgatagctttctaagatgctgcttgttgtagggatatattggacatatgagcccatacaccatctcctgctgtgctccgggtgtggaggtctcagggagcacatcttgtgtactagcagtaagaccctccggaagatttttaatttggtggtgcaattcaggctgcattccagtaggtggcaatgaagagtaagagccggctcattctcagctcagggggaagtgcccaccctgatggggagagactgtgttggggtgttctaggtccctggggtagggagtgggagtgaagccttgtcctgagcagccaggaacacgattcccttccctatcatggccctgttgcagggctcaaaacctccagttcatttagactttgttctttggctcccagctgcagtgtggctgtggacctttggatgtggctatggccctctggcagcgaccaccaaactggactcagggcacagcctcttccctcagtctggagcagacaactgtatggcttgtctggcctccgttgtcagggtgctgctgctctgtgtagggagagggagttgggccccaaccttcatgcaagtccaagcagcacaggctcactttctgcgccaagaaaaagcactttctccaagtgtacatgtgtcagcccccagtggggagaacctctgctgtatccacaatagtagatggggtgggggtcgggaaataacgccctctctatccctcttcccagctgctgggtgctgccccttccagagattggtgatgcgccttcatttcctttgtcccaaaaagagctttgatgggctgcactccctcctcccttggggcagcctacaccaagggttagatctctagggaccccacagctccccagggacttgattgctgtgcttgtgaaagtctgaggggattataaggtatgtttgctggggatctgctggtgcatcgtcttgggggcagagatttcccaggcaggacagtggccaatgataggtacataaccagtatggtactcaccatctcagtttgggtctgagtgggatgggggaacctctgcgcgaactcgctacctggtcctctgtcctcatgaagtttccaaatcgccacggacagtgttgtccagggctgtgagtgcagggggtcttcccaacagtttggcaggcagcagattgccacagaggtgaggggagcagagaggactcccactaccctttcttcggggctccacgttgctctggggtcggtctcagccagactcttgctactttccttttctgcaccccagctgtcctggctctcttccctcagttttctcttgagagcccgtccattcacagtaactgtgatccacgtccccttttttcttcagttctgtactctttctactctctttctattggtcagttggatttaagttcctcgtgtataacggagtgggtgggttggattctagcaaagttcattttttgcagttgtgttttgtgagtatatgagttgtctttataactcagaaataatggtcgtgaagacatatctaccttgtttccttcttaaataaatttcacttatttctggctttataaattcccagccttgtgtttgaattattttccacgtaattttcaaaagtcaggggtcctgggtctgaatgtgtcccctttatggccattgccattttttggtatgtatcctttaatgggtcatttcacttctttgagctttagttttctcgttagtaaatgagagctattaatatttactttagttgtatattataaatattcaataagaaagtatacataaaaacatgcagaatattcaggtcatatgctaagggatccacaaatattactgctagttgagtgacttgaaaaaaattatcttctctgtcagaagaaatactctcttctcatatagatgagatcctaatgccatttggtcactcttttttgtcactatgaatcagggcccctcagcctcaagatcacaattgcaagaattaagaaaaatgatctttattttgcattcaaaagtagtggtgtgtttcaataatagtgtattatgattatttataagtagttttgatatgtggcaggtacatccttattttagataatgtataaaaatttatttttatagaataaatggttcaatttgtccaaattattatgataagaagacttctgaatgttaattatgacttctgctaacagtattggtagaagagtaatttggaataaccctccttatggagggagattagaaaatctaggtaaataatttacagatatcagagaactaagaagctagtagagagttatagggctaagatcctagaggagacaaaaatatacaaagatatgctcaaaatttagggctactttctcctggtacatttaccgattctagaagtgtcagccggaagtttagttgcacttttgacaggcccttaaagcaaaagatacaaaacattagagtccagagtcttacaaagaaggatcccaagtaatccctatactcaaccttttagtttggggttcctcagaatttgctccaggccagacttctaagaagctatagctttcagtcatctcagtcattgaatttgcataaaggagactctgtattgtcagtgcccagaagcctagtagaaacaaataaatatcttctcttgaagaagatacaccaacctttgcctcgaagtatttatacttttttccaataaaattttatttatttatttattatttatagagatagggtctcctttgtcacccaggctgttctcaaatccctgccctcaagtgatcctcttgccttggcctcccaaagtgccttttaaaaaatcttaccacacaataaaagaaaactaggcacaagacaagggtcggggtgctggctgatgcttcatgacatttgtgggggtgtgatcaattttaagctctgtattttattttgtgcaatgcacttttctgtctgcgtatttaaaaatgtttaaaaaaacaaacaattatgaaacgattgttggagcaccctggagacatgtttggcccctccttttattttagttgacatgtaatatacatatttatgtgatacagagtgatatttcaatacatgtgtacatgtggaatgatcaaatttggatcatctgggtatttatcacctcaaacatagcatgtctttgtgttgtaaacactcacaatcctctcttttagctttttgaggatatacaataagttagttaaccatattcaccttatagtgctgcagaacatcagacacatttggtctatctagctgtaacagtgtgtctgttaaccagtctctcctcctccctatacttctcagcctctaatgcacacacttctattctctatttccgtgtagccactcctatattttgcattccagttttaagagactcggagtggagaaagatatgggaatactataggacattcaaaaaagttttttttcctttgcaaaagggatttatttctaagatctcagaaattatgttccttatctccttaagagtcacatggcataaccaaaaatttttcagcaaaatgataaaattgaggctgctcagtctctcaaaataaaatgttcatcagaaggcttagaaagtaggcaggtttgatactcctttaacaaaggaagaacataaatcccttctcatttgtgtttgttttgtaatcttaagatgaaagttcaaaagagggagagtgaaatggcgaaaaacaggaattataaatctgttgaaatgcagcaatgtgctaccatggaaattgtcttatttgtttgtaacattaccatttatttcacatgtactatgtgttgcttattttctttcttttttttttttttttttgagatggactctcacagtcgcccaggctggagtgcagtggcgagatctcagctcactgcagcctccgccctccaagttcaatggattctcctgcctcagcctccagagaagctgggattacgggcacctgccactgacccagctaattttttgtatttttagtagagacggggtttcaccatcttggtcaggctggtcttgaactcctgacctcatgatccacccacctcagcctcccaaagtgctgggattacagacgtgagccactgcacctggccttttgcttattttccacctcagtacttgtcagttactggaagcactattttcctgtcttctagcactggacattgaacatacatgatttagatgtgtcattcacctcctgtgatgtatttttcttattgttttcacttgaagcattattttcaaataatttccactctagaaagtagagtgcagtttttttaaaaaaaataaatcaaagagtcttaaaatttagagagcccttggaaatcactagttcatcatcagtacaggtatactttctatcatatcagtggcagatggatttctagcctgtacttaaacactactggcatcagggagcccattatctgacaggacagctctgcatttttgcaaaacctaactactgagaaagttcttttctgcatgaggttcaaatgtggaaccctgtatatttcactcatctttacccacttctatctttattatgatgtgattatttttatttcaattttctcagtaatcagcatctgctaattagcatatgcattgccaaagattccctcatgtccacagatgggcatattacaggcttaaattagtgtgatgtgggtgactaccacaggtagatctcctatgccaaaactactccagttaccactgagaggggcctagagaacagttgctttaggcagagccttgtctatgatgcaaaagaggattgttactgattagctcttgtaactacgaagctggattaaatatagctttctgtattatgttcttcaagctcattttcaacagttaccaaagtttttgtctgtgccagagactttcctgattgaggaaattatcaataatttccacttctaaccaattctggttaacttggatattgggagaaaaggcactttaaggcaacttttgctattgtttagaacaaaactagtcaacatgtagaccaaaatggaaagaatgtaattttacttacatttgtctgttcttattgaaatgcctacaagtaacacctatatagcctacaaatcctgaatattatatatatatatatcttgattttaaaatgccttaaaattcctattaaaattgcctcctatattttttgtatcaactgaatagtccctcttttttcctaatacattggcaaaaatgtagaagcagccatgggcttccttttccttttttttttttttttttttttttttaccccctcatccaatcagccagttcatctcctttcatggccgtaatttgtcaggattcaggccccatggatcactcccccgacatccttgtgtatcctcttccagtttgaggcaagtcagtcttggcctcttaggaaaagttgggcagagaggggacatgctatttggaccatgaagggagagaaatgtttttaatccacatcggtgacaatgtgattatagatgcacttccagacaagagatgctttacatcggatggcggttctgctgatccataggacatttcattgtttttcaccaagtcattattgttattgttgttggtacttttgaaatcagaggttgattacagacaggtttatctacttctggactgtagctctgatcagagcatgttacttcctttctctacactgttcccctgagggtaaatttggtgtgggagttaggattgcaggtgaagaagaacatgagtgctctctgtctgtttcatttctaagtctatagacagtggagacaatgtgatgtacagtttgatgcagcgttcactttggaagtaataaatggggatttaaacattttctgccttttcttgcatagtttactgttctttcttccagtgatgcaggatgtagaatttgaggaggaggaaaacctaattttacactattgaaacagaagaaatcttggattggtccctacctggctttggggtcagataacttggcgggggggaacatccacatgaagttccagaaacttgatgctggccttggcaatgtcatagtcctgtcacataccacaggctcatgccctgaacattcttagcgtcccttttccacccttctcctgtgcttacccctctgcctctttcatgcctcctgcatgctcctgctttgatagtccaaattcttttccatgtggttcaggaacctgccaggttatcttccctgtgtgtgtaacatggagttaatggtatcttccttgcttgactctcatgaaaactaaaagcaaggtatgcctagtactagtgcagtgcctagaacaaagaaagctctctgtagtcagcaattcattatttggaagaatgtgtctacaattaccattacttcttttagcttaatgaggaggacttgggagacttaatcggggtttcctgggtttgcgcttgagatggaacagaatggccagagaagcaaaatttcaattactcgtgtgtagatttcagataagagcagtattcaggctgtatcctcttcaaggttagaggagaaaacctgtgagtatgtgtctgtcatcgtatgtgcatgtgtgttcactggggtagagagtgctgagtggaggagaaaaatatggccttcccatgttattttctatttcctaaattttcaattaatccagtgaaagcacttatggttattgcttccaatatctttttttttttttttttcccacaacatgcatcccttgctggttgtgtgtttgatgcacttcacctttggattcagaatgggacattcatttttactctctggagagaaattttaaagatacacatgtaaagtaactcagaaattcaactcatcataaaggtgttacaaggtgtcaatacaattcctgaatgtgaggtttggttccatgttcccctgctgacttgtgggagtgggagtggaacaagcggtaggacttccaatgtgctgcttcggtcctcagtggactgtatgagagagaatgcagattgcagcagagctctgacccattttactgggaaggactctggcacaaacagcctggggctcacatgtgtttcctttgctgatgtacaggagaactctgacattgcttacatttctttctccgaagacatgcatcacctgcaaatgtcaaatgataattttgtgcttgccaaagggaatcagcttcctgaaaatggaaccacttcaggattgcaaaaggaggatgtattctgtatagacctcctctttgggtccttttagactctgctggggaattttttcaggtactgtttgagaaaaaagtatcagttatgactctgttgttactatagaaaacaaaaaaaaaaagctggtaaaaaggcttaaggatgaagggacaagaagtcttctctatctactactaaatgtctaatttaaaataagagcaaatgctttgtagtacaatgaaataatcatgctactaaatacttagtatatttgctcataatcctcacaaccatcttatgacatattaaccccagcttaccaaagatagatcaagaaaagttaagtgactacttacatttagaaagtggcaacgtcaagattcaaatccatacattctggctcaagtttatgctcttaaccaattatgttgtatttagccaatcaccaggaagttattctgtacactcccaaacattgtaatatttcaaaatatctgaaggataggggttactcatccctttttccatctgaatgtcaatatcctatagagatggtagttgttacagcatttaatggctctttctggagagactctcagcctgaaagctcccacgcccccattgatgggctaagttgcctgagactttggcaggtgcatcagttctgggaagcattaatgtggctctgtccctctatgactgagaatgtgtggtgtaactggcacatgtcagtaggtacttgatgatcttatgactgagaaggactaagaagaatttgaggcctctgtgcagagagatgagatgctcttggtgcacacttagcctcaattctgtaagctctgaatgtcatcccaaaaagcctgtaagtcacataccttccacagaagctgggcggggtggggggaggggggttgcctcagtatccaaccatgaccttcctcagtggggttcccctgccttctggctgacactgaactgctttttgaggctagtttgatccttctgcctctgaccttttcagtttaagacctgtaattgtctctcctgcacttaaaacctcctctttcgttaaatgatcctctcttgacatgttcctcagctctgtttaacttgtgctgtttcagctaataacctctattttgttctcaccttgcagagcttcaattccattcttttcttgactcttttccccatttattctcgcagatggattttatagtcctttcttaggttcaacatcatcatttgaaatttgtattgaagctgctttaaattcctgtgttgatttaggaagagttgatttgtttataatgataagtcctttcgtatctactattgtatggttttctatttatttgagatttattttccatctttgtaaatttttatatgctttaaatttagttcctatttgttgatgtgtttatttctatagattttatatttttattccttctttgaatgggaatattttattgtattttctaacaggatattgctagtatataaagccactatcaatgtctgaatatttattttataactagtgttctttctaaaaattttgttatctcttatagtttttcaattgatacttttttttaagagaaatcattttattgaatttttgctgcacaggacttcatgttttccatttggcttgattcctgcttccagcattttctcgttgagatttattccttaagtcttagtgttctcattgttggcaaactttgcttattatgcatcaaccatatttcttttcttagtattttttcaagaacatgaaaacagttactcacaagtttgatatcaatatttacttgtattggattcaaatttactacacctcttagacttagccatttgaacacggatcccctctcttaggagcagaggattgttactatcttcttaattttattctccacattttgacccttcaaggcttcggctgtgttccaccttcctcactggtgggatgtgagatcccagaaggctccttagctggggctgcacagtgtagaattatatatgaccaaataattcaaaaatgacaaggtatagcattatggagtcaagtatttaacatgatttatttttactgtgagcttccataatctttgaattttgagtttgtttttgggctgatagggtcacaaagcatattcattacccaagtctttacagaggatctgctataatttaaaaaaatcataaccatgatagtgataacaatactagcaacattttatgattactgtatcttgtattaaggctttacattccatttcttctcataacacagtgaggtaagtgttataatccctcttttaaatcatgtcttgaagaggtttactaagttgctcaaggaaacacatttagtgttggagccaaggtctgaacctgacaaaatctgtccccttaatccccaagaacactcttagttgctagtgatgcaaatagtttgaagagaaatacttaatatctttaatatgtttagaagtccattggggaaggtagacattcaaataatgaactcatagtatcaaaactataaatatactataaatggagatatatgtgagttgtaatgggaatatagggagaataattccctatgacattacttatttgtcttttagtgtggattttgatattacctcattggccacctcaaccaaaaatggtttttaaactttcatttattgtatgacatagataggggaaatttttttactgcttagagaataaaaagctgacatatacctgacacaaaatcttcctctgagagaaaggtgaataatgattagaatctggaaggaatcccttagctttcaagattaaggtattccagtcccctttagcctccactcattcatgtcctgtgatgctaggttccttagggtcctatccttatttgtcatctattcttgcttataagtcctacttcagcttatatttatgctgctattattcatccccaaggatgtgttcacagggtgctaaaaaatgtaaattacaaaaaaaaaaaagccaaaatcaatcttgtctattttgttccccaataaaacttgagtcagccaaatatgtttaacgggcttaatcaatattgcatagataaaataactgatggaattaactttttgcttttctcagcatgcttagttttatgttgacttaagtaggtatggctgaacagttaaattagttgtgtttgttgaacgttagtattactccttaaattgtcctttgcttttatgtaaatgtataatttgatgattaacaactaatgaaaagcctgaattataatctttgtcaaactgaatattaatgttgctttcttgagcagtttaatgagaacatcttttatttttaaatgaatttttatgttaaaatgttcatatcagtggataattaccaaatgcacgtgggtgctgcaatggtcttgacttagcatgatctgagagcccttggaaagtcacatttgggttcttctacaataatttagtgagttctggatctggtgtgactgttgcttgctgttgagcatatgtctatatcaataacaccttttcaattccgatggagaaaagtcacattcagctttttatcaatacattctataacacctgaaaatatgacagcatgagccatgatttatcctcaaaatggtcttttctcagttcaaggtcccatggcaaaaataagtaagtaaatatattaaaaatctgaattacttctgtggcagttatgagagcgcactccttggactgtggggagcataattgacttatagcaccaactggtgtgcattgaaacctttacttcatttccaagaaggtgtgcattgaaacctttacttcatttccaagaagacaggcttcccacgggctacactcatcaatgactgagtggaggcagcaatgcaaaggcagacctgtttcttggtgacatggagctcctgataataaactttggcttaaggactccgaaggccttactgacctcacctagaattgcactgctgtctgagacgtctccgctaaactttccttccgtgtgtccttcacccagggtacaagtcaattctacatggtagtttgacagcactcccagcctctcctgactcccttcttattttcccttatggatgttacctctaataaatctctgtgcagctgatctctctcatcttgatatctgcttcttggaggacctgttttaatactagcaccttcaaagctaagacagtattatgggcttagtttaaggctaactggtactcatgagtgtgcattttatattgtgctttgagctaactatgtaattgtgtctttcaacaagctagactcaaagtgtagaactttaaaacaactgtttgtcttctactgccccttcaaaattgtttttagaatttgttcttcccaccatcttagatgacaacttgagcagatcccactgacttttattctcagatagcaaaaatgtcctttgaacacttccctaaagtcttagttcatcaattaaagcgctcactcctataaaataaacaaaaatctattaaagttttgttacaattctctctctcccccagttaaggcctgtgcagctatctctgagttttggcaagtgttatagctgagccattctctttggggttgttggggaaacctgtcatcacagggggtctctcacacctgttccactgatatggccaagtacaaagtgattcagacattttaactgcaattctcccttatccctgaggtatctatcctaatagcttcagcatctttctggtgaggtatccaaacccattctggtggcctctctgtgcaacatctaagacaaccccacacagattctcacacaggtatggtccacatttcttccatggaaaataatgcacatcatttgtccaatgaactctgggcatgcaggctctcccaacatggaagcctcactacagaacaccatccaccccagcaggcagacagttacagtctctttttctttagatttctcaggcatcgtgcctctcaaactctaggacatacaacatacaaatcaaattctgtatcagtccatttcatgacattctccctaggcttaatggttgaaaaaggatctcctatttcccatagatcgggttgtagtggggtaagcaggaccatcattacacagcattctctccaaaattcctctaaactccaggatccttcttggttactccaaccttacaaaagctggagttgaattttctgttccatgtccatgtcaccaaactaatgttaagcaaccttctctacttttgtggtcccactttgcagcatgaaaatagttggcacctattcagtagattgatattcagtttgtggtcttagtaccagcagcagcttcacctggtagcttgaagaaatgctgaatcttaggtctcatcccagacctactgaatgggaatctgcgtttttacctggtgcccaggcgatttatattcacagtcacttttgagaagcactagcttagagtactcggacgaaacagaaataagaagtaacccattttaacattctgttacaacagtattattcaacaaatttatcgaccactattaggttcaagacatattcaaaaggcttacttagtgtctcatagaaaggattagtatatattagtagttccatgggattttagaggggaaagattattttatgaccagagattcagaaagggaatgatttgactggagtcttgaaagacacacagcacgtgtccatgtcgaattgaggaaactggtcattttatgtaaagggattagagtaagcaaaggtgcagaccttagctatatttgactagaaagagagcatgtgaaggcaacaatgggggcaataccaaggaagatatgtaggtatgtgtgagccttgaatgctgaattggagtttgaacttcatttagaatgaaatgagggggtcactttggtggggtgtggagtgattctccttagctgctgctgttgagtgacagcttgagactttcattcagatctgaagcttaaaatatggctggtgcagaaagcatcggtctggagatgagggctggtttgtgctaggtcagggattccacgtttcatcacatggtcttttgatgctgctcatttctctatttggaaaaaaaaagtctgtgatagaccaagaactatggcctcaagaactctcagcaaattttaagagaggaacatgctggatatagtattctggagcctgttctggagaagtgccaattttcttttccccttaacagcaaaacttatctagttgtctgtatttactgtctctaattctccaactctcacgctttcttcaatatggattatgccccattctgatagtgtctcctccccagctgccagagtaccctttagaaataatcagattataacaattccctgtttttgcatgtaaacaacttagaatccacactaactttcttaccattgcctgacatttagaatggtctggctccgacctttctctccaaccctgtcttgtactcgtcttcctcctttaactatacggtagacttccaggccagcagcagaataaagcttgaagtaagagagatctagggaaaaataaaaagaaaaatttgcctatttctctctctatatgtatgtatgtaaatatgtttttaatattcaaaaggatatatgataaaaataacaattatagctattttaggtgagagagaggatatcgaccttaaatgggaaacttttgtctatactatttgaatgcaattctctgcaataaaaatatattcccatatatttctgaagtatatgcctgaaatttctgaagtcagagacttaacaaaaagtctcaggatacagcctttcccttctccaaatgcctcaaataaagacaatttgatcatacctatttagtgttctcatagtagtgtggttatagctctactctaacattgctttgtccttcaaatatttatggaacacccagtcttttgtatttgtctaagacagtcactgctccttctttcaagtttactttgcataattgttttggtgtccatctctccttcaaaattattatctattttaccacatgtactatttgttagttggctttgtccattttaacaacttgtctcagaggttttttttctgacaggagatatggatctacctcaatctccccaatgtgtaagaaaattaggtgttttaatggagaacttgagacagctctttctaaggagattatgcggtactgatgaattacaatgcctggtattctatgtagcttgatgaatatcaggcactttttaatttatttctcctttaacttgtaatggaatctgggccccaagtgaaatgagttattttctagaaagaaaatatcagaggcacagaagtttaaataacttaattatctttgtagcaacttctaggagtggatccagaaggagttgtgacctcaagtcctcatgtaattcatctagtagtaattcatccatttgttcacctgtccatctctcttggtctgcaaaggatttgaaatggttaactgtgtgtagttatgtgactgatattcttagatgattgatcgctaagaggaattcatcaaaataatattcagatcattgttagaataacttgcttgtaaaataagtattgtgatgggaacaacactcatttatacatagactctggggtttttagaaaagagtaagccttcctcttgaagagacatttcatgtatgcgaaatgactgtgaacgtttctttgctttatcagtttaaatgtgcactgactgttggaaaagaatacaattaggtgtgattttgccagtccagaggttagtaacaagtcatagaagattcagtagtctcagctggacagagtggccaggacaggccattctggggatgggatagctgggctaaagcacatcctccactttggtgactccctctatagcgtttttattttattttattttattttgagatggagtcttgctgtgttgcccaggctggaatgctctgtggtgatgttggctcactgcaacctctgcctgctgggttcaagcaattccactgcctcagtctcctgagtagctgggattacaggcaagtgccaccacgcctggctaatttttgtatttttagtagagacgaggtttcaccatgttggccaggctggtctcaaactcctgaccccaggtgatccgcccaccttggcctcccaaagtgctgggattataggcgtgagctaccctatccggcccctccatagcttcttctccttcctcccaacttccaggaattgtaagaagcaccagattcccaatccacttttacacacatgcctaaatgttctttctaagaataaacatgttgtttcacttcatgtttttttttcttagtagattataaaagaaacaccagcataagataaacaggtctgtatcataataaattacatttttctaagttataatacagctgataaatgtgtactgttgaactttttaccataggtacactttaaaacatttcaccagtaaaacattttgaccaagaaagtcagtgttttctttctgatagtttgcaaatgatgatctttctaatcgagatttccatcttcatcaaatgtcagcgaatctctaaaggacattttcattccctaatatactgctaaggagggttggctgagtttgaaataggtgaggatggaaagtctgaccacaactgcctctttaagtcagagccggtacatggattgttaattctgcggcttgcaatgtgttgccttatgtattttatctaccaaataattctcctgagagaaaacttatcagaggcttagcagtcccttggttttaatcaaatatgtccaaagatgttgatatcacttgatgagctagtaaagttctttacttgacaaagggcagttttgtcaagagtagaaccaaaagtgatagcaacttcagggtgatccccagcttctctgtgcctaagagtgacagagctttccagtgttcagtgtaagaggctatagcatttaagttggatgaaatgctcccctttctatctttctcccatggaaaaagccaggtcagggttaaatctaattttcctctggctccaagactctgctgcaaatcgtattactgaactttgcttgggaatatagcaaaccccagtaagtggtctcactataaatagctggccatgcatctcaaggtgaccctctccagcaaccctgctgtatttcttcaatacatttgcttcctaataccccaagatggtcacttaattatcttttcctttttcctttcctcctcaccattcatgttcacattctgatgaaatttttcaaactgtaaaaggaaactggaagcattcagaggagaagcccatcatcatctcaccatcactgaattcctaaacctaagtgcatctgtactcgaatattccccctttgattaaaatgaaagaaaatctcttgcacttcatctgcttgcaaatttagagtgcaacccatccactctaagtttttcaagcattttctcctataaagtagaagtgcgcttcaatatatcccacatttaaaaaaatacttggctgggcacagtggctcatgcctgtaatcccagcactttgggaggctgaggcgggtggatcacttgaagtcaggagttcgaaatcagcctggccagcatggtgaaaccctgtctccactaaatatataatacaaaaattagccaggtgtggtggtgggcacctataatcccagctattcaggaggctggggtatgagaattacttgaacctgggaggcagaggttgcagtcagcaaagatcctgctactgctaccgcactccagcatgggcaaaagagtgatactctgtctcaaaaaaaaaaaaaaaaaaaaaaaattaaattctccttgcactcctccaagtaccttatttcttttctccccttcacaaaatgtaacagttttctctatttgttgtctctacttcttcacttcttgttctcctttaaatttacttctttgagagtttttccacctataccttggaatgcttccatcaaagccaaaaataaaatccacactgtcaaatctcattttcacagcataactggttactctctgcttattgacatgttctccactcatggcttctttgacaccacattcatttagctttcctcctacctcacgggccattccttttcagaagtgtctccaactcctgcatacaaattctaaattttggggcatttcaggcctttgacctgggcccctttctcttctccatttacactctctatgtgattccattcagccttatacttttctttaaattgcatttttatgctgagaatttagtttgtatctttagcccagatctccactctgagcttagtacgtctatatccagttacctacgtgagaggtgttgcatacacttctccaactcagtatctcaaaaaaaaaaatagctgttgaaaccaaaaaattcattagcaatccaattaacattatttcaaaacctttctttctacctgctccatcactgccacctaatccatgccatcatctcttttggtgactgaccacatggattttttaagcttctccctgcttcattcttgctcactcctcttctcactccccagcccattttcacaagcagaaggaatgaattacaaatacattgactgaggtataatatataatacacatatagtaaagtgcataaatctgaagtgtacaccaagtaattaacatccagatcaatacctgttgttaagcccatttcaattttttaataatttttatttctaagatttcattggatttgtttaatttagatttctgttttatggagaaattctccatcttattacatatttccttcaatatatttatgatgagttttttttaaagcctgcctttgataactctaatatctggataacctgttaatctgcttctatcatggttccttttttttcttgatttttagttatttggctggtagcacagagacagaataaaatccaaatttcttgattcacaggctattactatttttactgccgctctgctgctatttctctgcctctgtcttttattgccatattgagttattttacaatagagatgtttccttttgttctcatctctcatagttcctattcctttctccattgtttatagctacactttctaaatacttttaaaggaaaagaacctagttttttactaaataaaattgtatttataattcccaaaataaacgaggtaaaagtggagttacttcaggtcaagtgttggagagacatggagttcattctatttgctcctcctcattatcctcccccttttttttttgacaaggaatcttgctccattgcccaggcaggagtgcagtggcactatctctgctcaccgcaacctctgtgtcccaagttcaagcgattctcctgcttcagcctcctgagtagctgggattacaggcaaggcacgcaccaccgcacccagctagtttttgtatttttagtagagatggggtttcaccatattggtcaggctggtctcgaactcctgacctcatgatccgctcgccttggcctcccaaagtgctgggatcacaggtgtgagccaccgtgcccggccatcctccccattcttatacttgggtaacctagagagccaaagaacagatttcaaaaaacactggcatgtgaatcagttcagattattaaactgcttgcctttgttcagtgctctttgcattacagcattcttgcatatgtattatctcatttgacgcctgcctactagatcctgtgtgaagtatctaagacgtggaatttgaccatagtcatattataagtgactcacttataatatgaaaactgagactcacacagattaggcaaattcccataagtcatacaaataaacaaatgaaccaaagtattatagcttggagtctagtaggttttctttcatgtgcatgcatataaacttctgccagatccttcttaatacagtggactgagagctagacacacagtctagcctgagaatgtactggcataaagtatttttattaaaattcagtttttcaactttcaaagatgtcaaagggtgttcagaagtaccttgagaacctcctgtcctgcctgaaggattttcaagtgcaaagcagacttgctgctgtacgacatgcttgtgtatgtcacactctggatacacagagctgtcacctacacacatctttccctaaactcttaaggcaggtctgcagaactgggaatgtgctgctccagtagaggtgttctatccgtgttttataggatgcaagaaaaacaacaactaaattatagtaaataccttttctgtatgtagctactattttctactttctcaatgtggagcacttttaaaaagcatattcttttaaatgtttaaatgtgtctgagtgttcattctagtgttgatgaaatgctgtctttcttcctctgcgtctctctttagccatatttccctgatatgctcagaagatgcaccccaggggtgttcacccagttctggtgactcttgtctcatggggataaaaagaagaacatttgattggtcctcctggacagtagcattctttgctaatgctgttgccatagttctggtgtcactgtcaaaaataagtgatcccttggccagctgcagtacttgcatcttgctggaagcctgttggtggctgtcgtaggttaatacttctagtcatgacagtcatttttctggaaggaaggtagattttgtcctctgtgactgaagttcattgtctggcagttgctgagggtacaaatcggggagagaaagccctctttctgcagtatttttctcagaagtatttgtttcattccgatcacagacttgtggtccaatcattataactgtgatacacaaacacacacacactctctcacagtacatacacatgctctcttacacatagacatacatctcgccattcttttacacacatagaaacacctgttctctcacacttattttaaggagttcgccagggtaactaagcacagcctgtcttccttaccttatgttcaggcctttgggagctgagatcttacattcttatacccaaagcactttctgtttcctggaacaggatgaataatatttcttctaagacaaatgcatagctggtcatatgtacaaagcaaattatagtttaccaaccgtgttcaaattaacttttctgaaaacacaatagtattacttcacttttgtagattaaaaatatttttgtcagtgcaaacccaacacaatccttctactaaattgtcttagctgactatcttgtttccctatcattattgattgccttgttctttcatttaattcatttctgtgaccctgtcattatttttttttctacctgtgccatcaccatcagacctatcagacaactctcaatactgttttccaaacacatagatctttttattttatttatttatttttttatgagacagagtctcactctgtagctcaggctggagtgcagtggcgccatcttggctcactgcaactccacagtcccggggtcaaatgattctcctgcctcagcctcctgagtagctggaactacaggcatgtgccaccatgcccagctaatttttgtatttttagtagagacagggtttcaccgtgttggccaggatggtctcaatctcttgacctcgtgatctgcccgcctcggcctcccaaagtgctgggattacaggcgtgagccaccatgcccggccacacgtagacctgttaagatattgtgtcgagtccttttctttctttcatggtccttgggcctctcgcctcagcgagcccatgtttggacccattgctctggatacttgctgtacctgcttcattgctcttcctgggacttctgttagcactcattctaggaattcccttcattgtccttaaacgatgcctggattctatatcttttccggtttatctttttgttttcatggaagtcagtaacttccagagaaataatcaataagaaaaccactttttcatcctttttttcccttggagaatattcatgtttggaaatgtttttgtctatgctaacttaaaaaaatatattcttagatttttttccccctggccacacacaaatttcttgattctttttctttggatttcctttaagattttcatgactgacctctaatattcttatctgttttattttccttccctttttttgtattctaacttcaagtgattttctgaactccttttctcagtacttaatagttatatttcagctatcagatttctaacagtcaagagttctttcttattttctgatagttaaattttagtagtgtcttatgatgcagtataatttttagtttctctaaataattatatttacagttttttttttaaattctgcttcttaattgtttcatatgctgattgtggttcatctgggttttgattttccagtttgattgtatccacctttcatattagtggtttgtctttcattgttttgtaatccttatctcttggttcatattgtaacaataagacactgagaaggtggctggtgctctgtattctctgctgggctttggtaactggagagttacactctggggtattaatgtggcaaggctgaatttgcattggtgtatatgtgtttgtttgaaagtgctgccaatgtcactttctggaaatctcatctctaaggctcttcactttgtctggaggaaaagccccagtttttctacctgagggatatacacctgctcctatggtttctgggagcaggatggacaagagaactgatagttcaatagttcttatacaggattttatttaactttttaatttttatctcagtctcactttttgcctagagtttctgggtctatagcttctcagagttaatttctcatgagaataaaccttgggtattcttcccgaggcagtaacagtctaactgcccgtgatggtgaacaggacatgggggggtctcagcagtgttttcagatggtcaattattctcttgctttcagctcctttctctaggcccacaattcttcccacctgctgcatctcaatgtggagcctgtcagggttcttctgataagaataaatggaataactgcccacattagaccctttcccattctctttccttcattctgaaggttttcatatattttttattattatcctttgtgtaaagtcacaacaggcagaagaaattcatgtgtttggccaattcgtgaagtttaaacagaagtcacatgttgcattttaaggtctcaggtgactaaggaatagaaagctgtaaacactattaactacacatgaaaaaaacatttctactacggtgatgaaaatatagagacagaaaaactacacagactattgcagaaatcatgaaaatctgaactatgtcctaaggtagtaggaatgaatagaagaatgtgaaagtgaagagtatgtaagtggtggtttcaaccagatttcgtgactggctgaataggacagtaaacagaataattggaataaacaagtaggataaaaagtataagattattttatggcttttgactagaggactagctagaagccatcaccatcctttgaacaaagggaatgcaggaggaagattggcagagttgcagttcagttctattttaaacttactagagtggaaatgatcactaggtagatactttcttcttggagtttgaaagacagtgactccaatgagtgctggagtcttcttcagtgaagtagttgtagtgagtcctgataattctgtgttggtacagcagtctctctagatcccttaacttattaagcagattttagtaataaagtaattcatattcagaagcatctacctttatttgaaataaagaattgtaagacctcatgagttgtaaaaactcatgtttatagaaataggaaataatatatgtagaaccagctctgaagcctacagtttgggattgtcaaagtgataatttcctttcttataaaaatgaatcattactgatgttcaagtcttgaagagaataaatattaaaacaagaacttgaaattctccaatgaccacttaaaacttctcttgttcttaaaaaacacatcaagcaaaaatattttcaggtttgctcttaaaaagtgattcagatttgagaggttacacaaaatgacttgcagtgagttttctcagtaacacttaagtatcatttcatacacatccttgttctcttattgctcttctttagtttcagcagaaaaaaaattatctcccatcttttctttaagtgaagttaatccttcattttctgttccatgtgccatctcttcttatcatttcccccaccaaatttatttctccttcctcagtcattctatccttccatccctcatctgaaataaacatttaatagatacctactatatgactcagtttaaaaccgaccaaaatatcaaaccagcccatgtgattaatggcaactagacaatagtgaacactgaattgaaggtggcagtagcagctggtagtgaggcaaggaagaaaagaagtgcttttcttgtttcagagttttcagactaacagccacatggcagaatactggctcaggggcactcttgctcttatatgttccctgctgtgtagaatgaaagatactttcaaagtgaagttacattcctgaaaacatacattatccaaattagtttgtttcataggttattatacagtaggtatcatgtgaccatattgaaattaaatatatttttgtgtagaaccatatcagaaagttagaaaatacattattacaactccttaaaagaaaattgcgactaatatttttgactgttttatttatttcaaatcttaattccatattgcaattatgcctgagcctttgtctaaatttttaatttttaatacaccaataattgagctaaatacagctgaaaaaatgagggctacctaggtatgaggggaaagaaacatctataacaaaaaaatgtattttaaatgataatcattcaaatattaacaagcattataagcatataattaaaaagcatttataagccagtgtgttggtttagtttttgatgcacttgaagtactttgatgcattgcttgataaacataaggaggtgcccggcattgagttagaatatagagtctaatataaagatgatgacctggttcccatttttcaaggagcttgcagtctacaggagaggaagtgaagtaacgcagtttttaaagtttatgatattaattcagctttggaacccagctgagaacaggagaagaaatggacttcaattgatgctgcttcttttatgcagaatgagaactcacctgttagtttaaagggaattattattgtgatatgtaacacagagtagagtcctttctcaagcttttgtactaaatagcatgattcccattactttagggtggttttgctgtttactttagaggaagcatgagaatagattaggtcatctctcaaagtctctttatatttattctatgattatgtaagaactataaaaacatcctttggaaagaaattttccattaaaacacatgagttgagtcttgagaggattgaaattttgtcctttattctaaaagttattgaaaactggtatgagcaaaggcaaaagagtgacggtttctgtgactttgaggccacagtttgtaaaagagaaaaaaacatactttagagagaaaagttttcaagtgtctaacaatatacaaggattatctgggttttattctgtttcgcaggaatcaatgctttggatctgtagacagcatttagagataatggttggatgatagttttctattatttcaatggaaatgtagtttgctaaataatactttttttttttgaaacagagtctcgctctgtcgcccaggctggagtgcagtggcgcgatcttggctcgctgcaatctccgcctccagggttcaagctattctcctgcctcagcctccccagtagctgggactacaggcgcccgccaccacgcctggctaatttttttgtatttttagtagagacggggtttcaccgtgttagccaggatggtctcagtctcctgacctcatgatccgcccgctttggcctctcaaagtgctgggattacaggcttgagccaccgtgcctggcctttgctaaataatactttttaaacatctcaataaaacgtgtaggccaagaaaaaaaatagcttgtaaaataatcatagtattatagtagatttgaatttccagtgtcaaattatagcaagttttcttaacttttatttttcccatagcacatagatttacctccagtgctagataaggaccaatgacaatcaaataaaaaggcttgtcctattctgagctataatgtgactttctctgcttcattcttattactttgtttggaaaataggggagataaaaagaggtggaggcatacagtaagccaaatttctctctcttggttgatttcatgatgacaaaaaggaacctgctatgggagatattacagattcaggcaactcttcagatataagcactcagaggaggaagcattccttgtagttgttccatcttagtgtggtttgcttttctacatttagcctggcggaattctgatgtatggagtgagagtcagaatctggaacataggtgcaaactttcagtcctttaatctagagtgggattcctgtactcactacctgcccaaggggaaagtttactcactttctctctattatgcacctcctgtaatgacagacgtttcctatttgggatcacaaatgtttttcatctgtgctgtcttagcctccaactagtgctttacaaagctgaaggacaaaaatagttagcaacctctctgctatcagaagtgagctttttacaaactatattttattttcctttctttcctttcctttccctctcctcccctcccctcccctcccctcccttcccctcccctcccctcccctccctttcctttcctttttttctttctttccttttttttttttttttgacagtcttgctctgtcgcccaggctagagtgcagtagtgtgatcttggctcaccacagcctccacctcccaggttcatgccattctcctgcctcagcctcccaagtagctgagattacaggcatgcaccaccacgcccagctaatttttgtatttttagtagagatggagttttgccaagttagcaaggctggcctggaagtcctgatctcaggtgatccatccacctcggcctcccaaagtactgggattacaagcatgagccactgtacctggcctacaaactatattttctaatacaattgctattttacttcacaactttattcagaataatccacacctcataaaccctatacacatggtaatccggtaatccttaatatgaggtagggtcattatgaaactggattgtgagttgctggggtagggatggagatattataggtggatatctccctcctcccaacataatctgttcagacagactctgtgacaaccttttctccatgaaactcactctgcttggtggctatcccatctgtcttggacatcagcaaggaagaagaggcctattttcaatatcatttccagctattgttgcaggtccttctgtttaaagtataaatattggccgggtgtggtggctcatgcctgtaatcccagcactttggaaggctgaagcagacagatcacttgaggccaggagtttaagaacagcctggccgatatagtggaacccagtctctactaaaaatataaaaaaattagccaggcctggtagcacacacctataatcatagctactcaggaggctgaggcatgagaattgcatgaacccaggaggcagaggttgcagtgagccaagattgtgccaactgcactccagcctgggtgacagagtgagacgctgcctcaaaaaaaaaaaaaagtataaatattaatagatacttcttaacctaatctgggaagtcccacagaagacaaacagtacttttcaaatattctataccatatagcaataccaatagagaaaaatattatcattctgtttgttaggtcaaatgagatctgaatgtaaaatcaaattctgtcttcagtgtataaccttggaaatgagatcgctttctatgttgaaaagacttgtggaaaaatattacaggaataaaacaatgcattttgtggttgttggtttcaaaatgattaaaagaggattacacttattaagaaaaaataagattgcatgttatttgaacattatagctctagctatatgatgtctttttgagaaaattaattattagttttccaaaccattaaaccagaggctggagtacagatcaaagttggttttttttgtgtgaattttctttggtaccaaatataattttttccctttctagtgacttccttgaacagaactgattggcctcataagtgacccttaatagaaatcaccaaacagaggcagaaatggaagcttgatgacttagtccttcctcttgtaactgcagataagagtaaacaattgttttccaaaagtttgcatataccattgcacttcctttaatgagaaatacttgttcacagggttacagctagattaaatgatccaaaagttagccccataccagtcgattactcttattcttccaactgttagagcagggcataatgcacactacaaaatttgagagagaaaatacttttccttcttccctgactttataccagaattgctatgttggtaaattaaacataattattctttcacttctgactttactcttggagaaacatcctcctgtttatgtagtacaataagatggacaatagacatcaaaggctcccatatgtcttccttagtggcttcccataatgctgagaattcttctgtaaacatcaaatcatttaaacctagaactatgtgaccttggtagaaaatgactttaacttacttaacttttcatttcctcataaaaataaagttaatgccaaaactcaattgttcatccttcttttttagagagaaactatttttgtaaatgaagtcctatttggaatcccaattataaagcaaataacatcataactgttctacttgattggaggcagtggaggcagaatcctagatgtgaagaccttgcctcagcccctgaagcctctctgggaaaccacagggcctctcagaaaacagtttgaaaatcgatgggcaatatgatcaccacaagaccttttagttctgagacactttgattccaataagtaattactgaatgtttccatgttatttgctctatactctggtatagttcatgggaatcaacaggagaggtcccgctcatcaaaggattgcatgatttgggtaaatggaaagcctaagaattttttagggtaagcaggaccactccaagggggcagagaggagtgctgtgtttggtggtgaacagtgagacatgaagggagatactgcccttccccaaaaggtgggggaagaatcatcaacctttcaaagttggcatgcaaagtctttgatatatagaaatggtggcatgcaaagtctttgatttatagagaaccttttgccacagaggttgaggctaggatgcaacaatggtggaaactgccattaccacttggccttccacccaagccactgtgtgatataaagccttctgcttaaagccaggggcacaggtatagttagggaacctgtgaaaattttcttgttaaaattctactttctaaaagaaggaagaaagttactatccccaacatttcctcttcacaacttatgaagcaacatcattcatctgggataatacctgaggttcgttgcctcatgccaaggaaatcaaggacatgaacacttgtggagtgaggttaagagccgaggtttaatatgcaaagaaagagaaaagagagtagctctctttcctgcagagagagaggggctcctgagtgggtcttccagtcccatcgtgaagtgcatgggtttttatagactggattgaggaagtggtgtctgatttacatagggcccaaagattggcccaggcatgatgtttacatagtgcctgaaggagctggccacccaccttaatctattatgcaaatgaggtttctacctggccagcgccatgttgtctgcttcttactgtacacatggttgataaaaggaaagatggaactgtcatgttgaatatgtctagcccccaggtagtcttttactattgtcacatctgccgacattcactcgtgcaagcttccagcttgcttatctatgtttgcagctcaattttacaggctgctttttgttagaaaagaaataattttggtgctgctttttataaaaagggaaaccttactgaggactttcttaccctcactatctgccaaaataatttctttttaacgctcatgtcagttggacctctctgctcagagccaacccaagttacaggttgaggcccatggacagtactacccctaaacattgctttcccctaatgccaaaagtccacattaaaatgaaaatacttctgagagagtgagttatgccttgatcaaacattatcttgcatgtaatagtaggtgaaaccagagtatgaagcaacagggttgcaaataggtacagtaaatagtgtttttcaggttaaatggatatgcagatgtatcttgataaattgtgtcatattttactctttatcatgttaggcgagattttttttttccacctctcctccacactcaacccaacctacatcttaccccttaaattgcaaactcgttgggagaagagattattgcatgtaaagtctgtcaataaatgttggttaagcaaaagagagatagagaaaaggagggagggaaggagagagaaaagaaagaatgctactgcatcccctctgtgtagctttatggcattcatgatctactaaactctgggattattttagagatagtaggaagacaagtagtgggaaaatcagcatattttaacagttggttaaagaagaatataagcagaaaaatcagagtggcaactggaacaaagaagaaagtcaggtcagatatctgcagctgtagtaggaaagaatggagtattagaagctggttaggtccggggaagtctttccgggggtaatcacacaaagcaagctgttaagttctgcaggttgcttgttaaaacattataagatgctgtaatcccagcactttgggaggccgaggcgggtggatcatgaagtcaggagatcaagatcatcgtacctaatactgtgaaaccccgtctctactaaaaatacgaaaaattagctgggcgtggtggcacaagcctgttgtcccagttactcgggaggctgaggcaggagaattgcttgaacctggaaggcagaggttgcagtgagccgagatcgcaccactgcactccagcctgggcaacagagtgagactctccctcaaaaaaataaagaaaaatttaaaaacctttaagtttacatagtttaaaaataatctgtaataattaaaaatgtacctgtgtacgttttgctggaagtggctcctataaaggttatctttagcttgtctattacaacagtctagtagattccttcacacctctgaaaggcttactttgtgcatttactcagggtcttccacctgaacatacagctctgcctcaccagtgtgcactcacactatgactggcagctccttttttatccccaaaccactgccaaaaacactagtatgtaaattttgtagaaagcatgatgttacctccttaatgtatgcatcctctttctatagattattttctgcagtcttaaggacaccctatgatcccaatagcctgccactggaatacttttcttttcattgacacttttaattaaaagaataaagcactaaggatgaaattggagtctccttatttggctctcttgtcctatatccttccttccttaggggcaatcactataaaaaatttaatgtccatccttccaggttatgttgcattattttactattcataaatatagtagaagtggggctttgtgattttaaattttttatacaaatgatgctataccggttgatctacaacttgcttttttcactccattttagatttttgaaaactactcacatggatgcctatcagtctaattcattcattttaacatattctactatataaacatagcaaaacttatccattccctatcaataggcatttataccacatcatatttttttttgctactgcaaataatgcagtaaacatatttctacatataaccttttacctctatgtaagagtttatgtcgtgtacctagaggaagaattttggggcaaagagattagcaagtttaaaacttattagatattgctatttatttcttcagaatctttgtataaatttttattattggcagcattacatgaatgtttccatgcataagaatgtggtagtctcaggtatttaattattttccgttccagtggctgtgaaataatatatcactactatagtgactgcacaatcttcatggctgaagatttgagcatcttttcctttgtttttaattcagatttccacttaatgaattggaatttaaaatgcattccccacttttctactggattgtttttcaagttcttttattatagatgccaatcctccatttgctctatgttctggaaatatatactgttcttttattttttaattttatgatatatttttacttgtaatgtgcttaagttgatcattcttatccttcatgacttatgctttcagagtcctaaaatatttttagctcactgttatacatatacttacatatttcctacattttcaaatgaattttagaagactacattgatgttttaatgtacaaaaatgtatttgggtatatgctttgagaaaggaagctaatattttttaaattcttttttccatatggaaaccagttgtgccaacattatcaattgcatccttcactgtggttttgtgctgctgtttctttattttataataagtcagttcccatgtacaggcatatcttgttttattgtagtttgctttattttgcttcacacttcacaggtaccattttatttttctttttaaaattgatacataatcgaggtacatattttgggggtacatgtaataatttgatattcatataatgtgtaaagatcaaatcagggtaattgggacatccatcatcttaaatattttaaaaataattttattttaattttttctttaaagttgtatctgctttcatttggttaaaacttaaaaggcagtatcaatcatagtttgctcaaggatgtggaaattcaaagaattcattttcagaaatattcattgattactatattcctagccctggggatactgaggacagtagggatactgagatgaatgacatgatttccctcaaggctctcaatctattaggagatgaaggcatgtgatttataaattatggtatgactttgatgacctggtaaggcagcaatagacgcatagaagaaggagacagtaacagtatcaaggaccgctttccaaagaagatgccacctcattgggttatttttatagtcattttaaatttttttaattgagataaaatatacatataaaatttaccatccacatcattttaattatatagttcagtggtaataaatacatttatattcttttttctccttgcccgccccctcacctacccttcccagaattttattggtttaattgaaacataatagatgtacatattttcaaggtacatgtgataatctagcacttttctttaatgtgtatatatcaaaccagtgtaattagaatattcatcatcttaattatttgtcttttctttatgctacaaacatttgaaatatccccttctagctattttgaaatatacaatagataatcataaagtatagtcacacttctgttctattgaacatgatgtcttattttttgtctatctaactctatatttgtgcccactaatcagcctatctttataacctcttcccccatacccttcccagcctctggtaaccaccaatgtactggctaccttcaagaggtccactttcttagctctcatagatgagtgagaacatgcaatatttgtctttctgtgcttagcatatttcagtaatcataataacttccagtttcatccatattgttgcaaataacaatattttattcattttcatgactgaataattttccattgtgtatatatgccacgttgtctctatgcattcatccactgatgggaacttaggttgattccacatgttggctattgtaaatagtgctgcgataaacatgagaatgcagacatttctttaatatattgattttctttcttttgagtttatatctagtaatggaattgctgaaccatatggtagttttaagttttttgaggaacctccgtatagttttccatagtggctgtactaattcacattcttaccagcagtgtatgatggttcccctttctccatatccttgccagcatcattattactgatctttttgataaaaaactgttttagctagggtaagatgatatcacattatggttttgatatgcatttccctgatgattggagatgttgagtttttttcatataccatttgtatgtcttattttgataaatggctattcagatattttgcccatttttgcttccgattagtttttgttgttgttgttgttgttattgagttatttgagctccttatatattctgattattaattcctggtcagatggatagtttgcaaatattttcttccattccgtgggatatctcttcacttttttgattgttttctttgctgtgccaggaccttttaccttgatgtaacccaatttttttatttttgcttttgttttctgttcttttgaggtcttacacaaaaatcctttgcccagtctgatgttctcaagtgtttttccaatattatcttctagtagttttatagtttcaggccttagattaaagcctttatccattttgatatgattgttgtatatgatgtgaggtagaggtctagtttcattcttctgcatatggtaatagagttttctcagaactattatgtttctctctctctctctctctctctctctctctctctctctctctcattttctctatctctagctctctctctatttacagacagggtctcactctgttgcccaagctggagtgcattgggacaatcttgactcactgcagcctcaacctctgggcacaagtgagtctcctgcctctgcctcctgagtacttggggctaccggcacatgccactagtgcagctattttttgcatttttttgtagagatgggattttgccatgttgcccaggctggtctcaaactcctgagctcaagtgatttccccgccttggcctcccaaagtgctgaggttacaaacatgtactaccacgcctggccccaaaccatatattgagaagagtgtcttttccctattatatgttcttggcatctttgttgaaaatgtgttggctgtaaatgtgcagatttacatctggcttctctcttctgttcctttggtctgtgtgtctgtttttatgccaataccatgctgatttggttactatagttttatagtatattttgaagttcagataatgtgatgcttcagctttttctttattttcagaaaaaaaaaagattgctttggccttttgagttcttacgtggttccatataaattttagaattgttttttctatttttgtgaaaatagtattggcattttcatagtgagtatatttaatctgtggatttctttgggtactatattcattttaacaatattacttcttctaattcatgaacatggaatatccactttcttgtgtcctcttcaattttttttcatcagtgttttttagtttttcttgtatagatattttacttctttggttaaattgatccctaagtattttcttcttgtagctattttaattggattgctttcttgattttttattcagattgtttgctgttgatatatagaaatgatactgatttttgcatgttgattttctaacctgcaactgtactgaattcgtttatcccttcttataattttttggtggagtctaggtttttctaatataatatcatgtcatctgtgaatagggataattcaactcattaccttccagtttgaatgtcctttgttttgctgccctacttactctggccaggacttccagtattatattggataaaagtggtaaaagtgggcatcattgtcttgttctaggtttttgaggaaacgcttttaatttttccctgttctgtatgttagctatgtgtttgtcatttatggcctttattattttgaggtatgttttttctatactctgtttgttgcggtttttatcatgaagggacgttaaattttatcaaatgctttttcagcatctattgaaatgatcttacggtttttttttttttggttctgttaatgtgatgtatcacattgattgacatgagtatcttgaaccatactacttgcatcctaggaataaatcccacttgatcatggtgaatgagtttggaagtattccctcctctccagttttttgtttttttttttaaagaatttgtgtagaattgctgttagtagttcttaaatatttagtagaattcagtggtgaagccatcaggtcctgggcttttctttgatcggagactttttattatagcttctatcttattactcagtaaaggaaagctgaaagatattgcgtttttttacaaatcaaaggtctgtggcaatcctgcattgagcaagtggttaggcaacattctttcaagaacagtctcacttcatgtctctgtatcacatttggtaattcttgaaatattttaatttttttcatgattattatgtgtattatagtgatctgtgatcagtgacctttgatattactattgtaattgttttggaacaccgcatactgtgcccatttataatggtgaacttaaaaaacgttgtgtgtattctgagtactccacatataggccattagttctctttctctcttttttggcatcctgatttctgcagacacaacaatattgaaattaggccaattagtaaccctacattggcctctgagtgtttaagtgagctgaagagtcacacatctctcactttaaattgaaaactagaaatgattaagcttagcggggaaggcatgtcgaaagtcaataggctgaaaggtaggcctgttgtgcctgttagccaagttgtataaggaaaagttcttgaaggaaattaaaaatactacttcagtgaatacacaaatgataaaaaagcaaaacaactttattgctcatataaagaaagttttagtgatctggatagatcatatcagccacaacattctcttccttaagccaaagcctaattcacaacaaggccctaaggctccacaattctatgaagggtaagaggagtgaggaagccacagaagaaaagtttgaagttggaagaggtcagttcatggagttaaaggaaaaagctctctccataacataaaagtacaaggcaaagcaaagaaacaagtgcttatgcagaagctgctgcaagttatccagaagacctagttaagataattgatgaaggtgactacactaaacaacagattttcaatatagacaaaacagccttctattggacgaaaacgacaccaggacttttaaagctggagaacagaagtcagtgcctggcttccaagcttcaaagaacaagctgattctcttattaggagttaatgcagctggtgactctaagctgaagccagtgctccattttgcattctgaaaatcctagagcctttgggaattatgctgagtctactctacttgtgctctgttaatggagccacaaacctggatgatagcacatttatttgcaacgtggtttactgaatacttacactgctcagaagaaaaagaaagattgctttcaaagtgttacagctcatttacaatgtacttggtcactcaagagctctgaaggagatgtacaaagagattaatgtgttcacacctacaaacacaacatctattctgcagcccatggatcagggagtaattttgactctcaagtctcattatttaagaaatacattttgtaaggctatagctgccaaacatagtgatttatcagatgaatctaggaaaaagtcaattgaaaaccttctggaaaggattcgccattctagatgtcattaaggccatttgtgattcatgggaggaggtcaaaataccaacattaataggagttggaaaaagttgattccaaccctcatggatgactttgaggggttcaagacttcagtgaaggaagtaactacagatgtggtagaactaaaaagagaactggaattagatatgaagcctgaaagtgggagtgaattcctgcaaactcatgattaaacttcagtgagtgaggagttgcttcttatggatgagcaaagtaaatgggtttctgagatggcatctactcctggtgaagatgttattgaacatcgttgaaatgacaaaggatttagaatattactacgtaaatttagttgataaagcagcagcagcgtttgagaggatggagtccaattttgaaagaattcctgctgtgggtgaaatgctatcaaacagtgtcacaaggtacaggcaaatctttcccagaaggaagagtcaatgaatgtgccaagcttcactgttgtcttatttcaataaattgccacagtcacctcacacttcaacaaccaccaccctgattagtcagcattcatcacaatggaggcaataaccttcatcagcaaaaagattacaatttgcggaaggctcagacgattgttagtatttttagcaataaagtatttttaattaaggcatgcacattattttttagacctaatgctattaaactaggaaaccaaaaaaagtgtgtgactcacttcattccaatatttgctttattatggtggtctggaactaagtctgctatgtttctgtggtatgcctgtgtgtgtgtgttttgtggccctctgttttgttgcaataattattttttaaatgtgttgtatgacaatatcatagtttctcaattatcacagctttttaatttcccttgatatttaatagggcaatgatgctcttctttttcttcttttttcagtgtttgcttgactatttttgtagaagtctttcaaaaaaatcttatcgtgttattgattctgagtgtattgtctttatatattaatttttagaagactgtatctttatatactaagctttttacctataaaattttgtcagtttattcatgtattcttttatctctttcaaaaatgctttatatttttctctgtaaaggtattgcactgcttttgtcagatttatcttatggacataatataatcattatgttattgtgaatgaattatttttgtattgtattacctatttttatcattaaaatatgggcatagtgttaagttttttatgttgatcttatatggagtgaacttaacaagtattcttattgattttaataggctgtctataggttgctttggactttttaatgtagccagtaatatttgctaatatggcagctagtctgtaaattatgattttgttgcaatcttgttccattttttttttcttatttcattagttagggctttggggcactttgttaaattgtagaaatgataacagtcctatgtgtctgatttctgatcttacacttaataatttctaaatggtgtaccatgtttttaataaatacatttcatcagatcaaggaaatttctggagattttcttagtttcttaaaatgcttgtgctttgttttggttctttagttagtttttggtagttgtgaataaatgtttaattttattaaaaatagtttactgtatataatgagataattttaggtttcttttttcaatcctttaacatggtgaattgtaccaatagatttttaaaattgacttatttgaggtataatctctctgtatgtataacgcatccattgtatgtgtgcagtttgatacatttttggctaccgtacgaatccttgtagccaatttcacaatcaagatagaaaaaaaaattaatcaccacagaatgttctgtcatgcccccttgtagtcaattatctttgctgtgaaggcaactgctgatctgattttcatcaagatcaagttttgcttgatcttgaatttcaaataatggaataatgcagtgtgtacaattttgcatctagcttctttcagttagcacaatggtgttgagagctatccatatttgtatgtgtatcagcaatatatttcttgttgtttggatagagcaaaatttgtttatacattcatgtgttgattgacatttatgttatttccagtatttgggtattattaataaagctgctatgaaatttcacatttaagtattcatgtgaacatgtattttaatttttctttctagtagtggaataccttggttatatggcaaacgtatgtttaaatttttaagtaatagctaccctgtttctaaagtgattgtagttttttacattcttccctgaagtgtagcagagtttgtgttgcttcacatcttatcaactcttattattgtcagtctttttaattgcagctattttaaagtatttgtcatggtatcttatggtttcaaatttcattaccccaagactaatgatattgagtatctttaggtgtacttttccctattcatatattctcttgtacagtctccattcaactcttttgtccacttgtaaattggtttgttatcttgatatagtattctagatataactagagagagatgtaatgaatatctatgtgtgtttatatatacttatatatacatttatatggatatataaatgatatggataatataaattattttcatatgtatttttttcttagtatatttcttagtatgttttcttagtatttcattttcttaaagatatcttgcaaagagcataactttaaatcttgattaaatcaaattcaaaagtaataaatcaaagtaatttatttttcttttaacactgatttttaaaactgcttatttgaaaaaaattatggattcataggaagttatagagatagtagagaggtgacagttatccttcaccagtttctcccagcagttacatctcattacgtagagtacaatatcaaaaacaggaatttggcattggtataatgtgcaagtatggttctacgtcattttatcacacgtgtaaattgtataagcaccattgcaatcaaactatagacatgttccttcaccacaaagctctctccctggttctgtctctttataatcactcgcactattctccttaaccattcagagctcctggcaactgctaatgtgttttttatctttataattttgtcattccatgactattatataaatgaaattatagaacttctgacctttggagactggcttttttcacttagcataatgccctgagatctattcaaattattgcatgtatcaatagttcatttatttttactgctgactagcgtcctatgacatggatgtgccacagtttgtttaactattgatctgttaatgaaaattttggatatttccagtttgggttattaaaataaagctgctatgattaatcatatgtagatttttgtgtagacatattttcatttcgctaggataaatgcctaaatgtgtaatggcttgttgaattatgagtgtatgtttagctttatgacatcgtacacgagacccagtttcacagcatcctctccaccatttggtattgtcactgctttttgttttatttgttctattaaatgtgtagagacatttcactatggtttttatttgcattttctaaatagctactaatattgattatcctttcataagcttgtcatccatatgtcctctttagtgaaataactgtctgtatcttttgccagtttccatattagattttttctgttgaattttgagagaattctttacatattacagaaactagtcctttggtggatttgtgatttacaatttttttcttccagttcattgcttgtctttttatcctcctaacaaggtctttctaagaacaattttttaaatgttgaagtccaaataattgattctttcatattatgctattggtatcattattaagaattaatccccaagccctatgtcttgaaattttctcctaagttaactaagagttttacatttttatattttacctttaaatctatggttcattttgagataatttttgcaaaaaatgtgaagtttaggtaaagtttcctctttttaaaatttatttttatttttgcctatgaatatccaattgctcaagcactagttgttgaaaagtttatcttccattgaattgcttttgaatctttgccaaaaaaaatcagttgaccagaaatgtgtgggtctttttctgggctctctattcggtttcataaatctaaatgccattccatttaccagtacaacacagtcttggttgctataaatataaagtaatcttaattgaataaagtaatccctcccattttattcttttctatcagagttgtttttagctattgtagttcccttatctttccatataagtttcggagaactcttgtccttaaatataaaaataattctagggccgggcacagtggctcacatctgtaattctagcactttgagaggccatggcaggtggatcgtgaggtcaggcatttgagaccagcctggtcaacatagtgaaaacttgtctctaataaaaatacaaaaaattagcctggcatggtggtgggtgcctgtaattccagctactcaggaggctgaggcaggagaatcacttgaatctgggagacggaggttgcggtgaactgagactgcgccactgcactccagcccgggcgacagtgtgagattccatctaaaaagataataataataataattctaggttttggtaaaaattgtgttaagcctttatataaatttggggattatctgtatcttgctatggtaacttttccaattcacaaacgtggtacatctcttcatctattgagatagtctttgaataatttcatcagtgtaatagggagtgtaatagggaaatttaagtctcaaacaatatttgtgtatttgtttatttttccttagtgtcagattttgctttatctattttgcagctttttatttggtacatgttcatttttgattgctttgtcttctaagtagattgacttctatatcattatgtgcctctctgatagttttctttgctttgaagtctgctttatctaatattagcacagatactattgctttattagattaatgtttgtatggtctttttccattgattactttcaactgccaatatcatgaattaaagtctgtggtaatttttatgcaaaagaaaacttatacacaatacaatacgtacagtaacctctagaaaaacaatacaaagaaatattctaaaaactaaaaaatgttcaagtaatccaaagcaatgcaagaaaaaagaaaatacagaaatgaaaatcagggagaacaaacagatgacaaaaaataaaaggataaacttaagccttaacatatcaataattacattaaatggtgtaaatgcaccaaataaaagttacagcataataaagtggattaaaaaacatgcctcaactatatgctctccataaggaacttaatccaaatgtaatggtattgggagtttgaaagtaaagcatggaaaaagataggccatacaaacattaatctaataaagcaacagtagccatgctaatattagataaagtagacttcaaagcaaagaaaactaacaaagaggcacattatataatgatatagaggccaatctacttagaagacatcgcaacaaaaatgaatatgcaccaaataaaaagctgcaaaataaataaagcaaaagctgacacaaaggaaaaacaaacaaatccacaaatattgtttgagacttaaactcccatactacactgatgaaattaactcaagatggattaaagacttaaacctaagacctaaaaccataaaaatcctagaagaaaatgtaggcaataccattcaggatataagcatgggcaaagacttcaggactaaaacaccaaaagcgatggcaacaaaagccaaaattgacaaataggatctaatgaaactaaagagcttctgcacagaaaaagaaactatcttcagagtgaacaggcaatctgcaaaatgggagaaaatttttgcaatctatccatctgacaaagggctaatacacagaatctacaaggaacttaaacaaatttacaagaaaaaaacaaccccatcaaagagtgggtgaaggatatgaacagacacttctcaaaagaagacatttatgcggccaatagttatatgaaaaaagctcataatcactagtcattagagaaatgcaaatcaaaaccacaatgagataccatctcacaccagttagaatggcgatcattaaaaagtcaggaaacaataggtggtggagaagctgtagagaaataggagtgcttttacactgttggtgggaaagtaaattaattcggtcattgtggaaaacagtgcggcgattcctcagtgatctagaaccagaaataccatttgacccagcaatcccattactgggtatatacccaaaggattataaatcattctacgataaagacacatgcacacatatgtttattgtagcactgttcatgataccaaagacttggaaccaacccacatgcccaacaatgatagactggataaagaaaatgtgacacatatacacgatggaatactatgtagccataaaaaaggatgagttcatgacctttgcagggacatggatgaagttggaaaccatcattctcagcaaactaacacaggaacagaaaaccaaacaccgcatgttctcactcataaatgggagttgaacaatgagaacacatggacacagagaggggaacatcacacactggggagttgttggggagtgggggactagggaagggatagcattaagagaaatagctaatgtacatgacgggttaatgggtacagcaaaccaccatgacacatgtatacctatgtaacaaacctgcacattctgcacatgtatcccagaacttcaagtgtgtgtgtgtgtatatatatatataaaatatatattaaatatatatttcatatatatttatgtataatataaaataatatatttaatataatatataatatttaatatatatatatttttaaaagcttgaaccttcctccttgggaactggagctgggacaagacaagaatactcactctcatcactcctgttcaacatgtactagaagtcctagccagagcagtcaggcaagaggaggaaatgaaaggcatctaaataaaaaaagaagtcgaaatatctctctcctctgaagatacgattctatacctaggatatcctaaagactcttccaaaagactcctggcactgataaataactttaataaagtctcaggatataaaatcagtaaaaatgtcagcagcatttctatacaccaacaaggtccaggttgagagtgaaatcaagaacacaatcccatttacaatagccacaaagaaaatgaagtactcataaatatagctaatgaaggaggtgaaagatttctacaagaactacaaaaccttgctgaataaatcggagacaacagaaataaatggaaaaacattctatgctcacagattggaagaattaatatcatacgaatatttatttttatatccttaacttatttgctacaactttctacttcacaaaactttctatttttttcatttgtttcagacatatttagaattgttttaaagtgttttgttttagcggcattggaatccttgtcctgtcatcctaacatctgtgtgtgaacatttgcatctgttgattgtctttcctcattccctttgatatctccctgggtcttgctatgacaagtaagttttgctggaaacctgaacagttagggtgttatgtttaagactttggatcttattaaaatctcgtgttttagcaggcatggtttgacatttctctagtgattgaaagggagttctgattcatttctaccaggttgagttggaagtccaggttctttagcctgcccccacggacacccaagtggaaagggctttatgttacttctggaaatggctgggagttgagacttcccactgagtctctgcttacagaaccctagttgggagggaaattagtacctaattgctgcttcccatcactgatatcaggggagtaacctccttagtactgagaagtggtcaaagtcctgactctcaactaggcctctcaactgggtcattctcttgcttaaaaacaatctgattccacattcctcctctaacaccattccagtgaggaagaaaggggcacatcactgctgcttcttttgggtggaagttcaggctttgagtcccaagatcaatagctaatctaccgtcttctctccaattttcagagtttatcatattttacatataatgaccagaattgttagttgcgtttagtgggagtaatagggagagtaggtctatttttcctggaagtggaagttccactaatgaattttacattgttaaagcacggttttatcacgggggtaaatacagcttggccagatgcgtacatatgtacatacatccacactgctagattaattgcaaaatattctttaggattttactcatctgtgacactggtatgtaatcttatcacatactttcttttctgatttcagtatcaagcttatactagccttagaaaattaattaggtgcatatctttctgtatcctacttctatagtcaaatgtatgctatgtggaagttatccattttataaatatttgttaaaatgtgtctaatagtttaaaatattagatattctttcatagggagaattttctactgattcaatttctttaataattgatattgtgctaagtttttctattatttttgagtaaattttggtaatttatatttttaagaaaatttttattttgatagtttaatagtcttagaaaattatccatttccttaagtttgaccattaattggcataaagatgtatatatcattctctcagaacttttcaaaatctttactgtacctttaactatatcctcttacataataataatattgtttatatgtacattctattttcttagtgctgcttaagatttatacttccattacaactttaaaaaagtctttatttatactcatttttccatgtcataagtttacgttattgtctttttttttgtactttgagtttataatgtgttttttttttatcttcttgagttgcacttaaactgatctattttacttttttgttatattttaaacaaagttttaaggttataacctttcttctgttacattaaatttatctcacaaatatatgtatgcatgtgatgtgttttagtgcatttagttttaatttttattaatgttttatcatttccattatgatttcttttcctataaaataaggcatgcttaaaagttttcaaatgtggttttcatttttgtttttgttgtattttgttttgttatatttgaatcaccattgttgatttcttatttgattggtctttttgatattctgtggaatatgttgaggcttcttcgtggccaggtagataattaatttttttttttttttttttttgtgagacggagtctcagtctgtctcccaggctggagtgcagtggtgcaatctcggctcactgcaagctccgcctcccgggttcacgccattctcctgcctcagcctcccgagtagctgggactacaggcgcctgccaacacgcctggctaattttttgtatttttagtagagtcgaggtttcaccgtgttagccaggatggtctctatctcctgacctcgtgatccacccgcctcggcctcccaaagtgctaggattacaggcgtgagccactgcgcccagcccataattaatttttaacagtattttatgtgaaaagaataaatatatttctgtttggtatgaattctgaacctacatctgtatttggtataggcttaagattcctatcttcataggcaaatcttttccattcacgttcctaggtggaaagaaaatttccctctgtttctccacttccgtagttaattcttatctcatgcttttatattttatgagtgtttttaataatattctttctggttttattcaaatagttctagaaagttatagcttttcttgtttacagattctattgtacctgggtttaccactactgtaaaagttgcgtgaccaatggtgttatttatcttggttttcaactgttagcatcccctgtccctagcacaatgcctagaacttagggacacttggtggatgggaaatgaatcaatgaatgaaatgtttcaatattcctgtgagcaattttgatttttactgcactgaagattagttttgagttgcttcttcatttgtaataattgggagattatgtttgattttgagcttagatatgttttaaagtttaacaaaatcatgttacctagtatttgtgtgtctgcatggaattttggtatatgtggaccagagggaagaatccttccatgtggtatcttattttgctttattgcctggcagactagactggattttcaaaaacagaaaataaaattttgattgtgttatatgtcattctcttgcttgaaaatattgtgtgattccacattgcgattaggatataatttatattccttaatacagtagtctccctgatctactatttactttccatggtttcagtcacccatggtcaacagtggtccaaaaatattcaatggaaaattccagaagttaataatgagtaagttttaagttgtatcccttctgagataggtaatgaaatcttatgaattctgctttgtccttcccaggacgtgagtcatccctttcttcagcatattcatgctgtatacactatccatagttaggcacttagtagtcatctccgttatcacacctaaacaatgtagcatgtttagagtttggtgctatccttggttctagtcatgcactggggatcttggaacatatccccgcaggaataagggctgactcctataaaatatgtaaggacttttgtgttagaaccttattcactctcctttcatttcttgcaattgtttactgtcgcactcccatgtctcagtccctaacactctatgctctttcaagcttcaatgccttttgaaatcctttttactctgccaggaataccttcacacatcaacaaaacccactcctctcccgaatgagtccttcccaaacccaatgttctccatggctgaagagttagaggatctcttctctgtgcttccatatcactttgttcatatctttaacatccttatgatactgaactgtcattgcaattcagtttttttctttttcttttttttttttgacagcgtcttgctctgtcacccaggctggagtgcagtggcacaatctaggctcactgcaagctccgcctcccaggtttacttatgccgttctcctccctcagcctcctgagtagctgggactacaggcggctgccaccacacctggctaattttttgtatttttagtagagatggggtttcaccatgttagccaggatggtctcgatctcctgacctcgtgatctgcctgcctcggcctcccaaagtgctgggatcacaggcatgagccaccgtgcctgaccaattcagtttttttagattactgttgaggctgtaaatgagtgatcaaaggtatgtgagttatgagttaaatcagcattaatctcccagcactcatccagttgcatccagaagtatgtctgaaacatacaccatccacaggtacttcctctgacctggaagcatgtgctccttattaataattcacaagacagtttaaggaattcaataaaagggaagataaagttatttgcagacttatctagcatacagtaggtactctgtaaaggctaatgacagctcagcaaccctctgatttcattaatgatttttctttgcactgtttttggctcccatgtgatgactttcaggcatactacacatgtatcaaagtcgtatctcttttaatatggtgacaaatagagcaaactgtttccaaagaagataatgaattatcaccagtgggaaatttatactgtgttatcactgaagaacctcagagcaaagatgtttaagggaattcctaaactagatagggtggaactcaatttacatacaaacttggagatctctcctattcaaatttccttcaaaaagtgtgttataatagaggtaaaacattgagggagaaaatacaacatttttacttttatcttagaagattgtaaattgactatatctatccatcttaatcttaaatgtaggcattaggtattatgaatatttatttttcgtggtaactggtgaataaacattccttgttttagtgaaaattcactacacataccaaaagatatcatagaatttagagctagaagatttagatagatgctggtgaaatattcttattttacttatatatgaaggaaaactgagggttagggagatgacatgtttccgtagattacgttcagatttacttcttggggatgctcacacaagaacctctgatggatctaatacacaggagacacacatatattattggtatttctatatactgagaattttggttttataggtcaccatgcagcatggttgaatagaatagtgctgttcgccgagtaaatattttatcagtttttttattttaaattgtttgtggaatttgaagacattaaaattgtataaccactacaaacttactttaatcccatttataggggaagtttcactataaagtagatggatgtactgtggtctcgcattaacgacattaaattgctgagctgcaaaatgaacctgttgtgagatgatatgtgccttctaagactaggaacattgggagcagcattatagggagtacccagcatgtaattacagacattttaccacaattttactaagcagaacaactgtatgtagaataaaaggcaatttatcagcgaacaaagactgtgtgtatatgtgtgtgtatttactatatctatctatatacacaatatctgtatatacatatatgattatctgcatatctgtacatgttttatatatatattacactgccccttgaataatagccaagatttttgcctattgtatacattttacattttattctttccccagctttattaaggcatagttgacaaataaattagctatttcaaggtgttaaaatataatgatttgatattcatatacattgtgaaatgattaccacaataaaagcaactaatacatccatcactatactgagttacgtgtgtgtgtgtgtgtgtgtgtgtggtgaggacacttatgtactatattaacacatttcgagaaaacaatgtagtattattggctatagttgtcatggtgtgtattagatccccagaatttattcatcttataactgaaagtttgtacactttgaccaaaaactatttcccccacccccagccctggcaactactgttctactctccacttttatgagttcagtttttttttttgtgagattttacttataagtgaaataatatttctcttttctttttctgccttatttcacctagtatatgtcctctagattaatcaatcttgtcatgaatggcaggagttttttctttttaatggctaaataatcatctgtgtgtgtgtgtgtgtgcgtttgtgtgtgtatacacatatatacacataacattgtcttcatctgctgacaaataggttttttgttttttgttttttgttttgagacggggtctcggagtctcgctgtctcgctgtctcccagactggagtgcagtggcgcgatctcagctcactgcaagctccgcccccagggttcacgccattctcctgccttagcctcccgagtagctgagactacaggcgccagccaccacgcctggctaattttttttttgtatttttagtagagacggggtttcaccaaaataggttgtttttataccttggctatagtgaataattctgcagtgaatatggcagtgcaggtatctcttcaacatgctaatctcattttatttaaatttatacctataagtgagattgctggattattatagtagttctagttttatgtttttgaggaacctccatactgctttacttaatggctgtaccaatttatgtttctgtcatcaatgtacaagagttcctttttgtgcatgccattaccaacacattatctcttgtgttttaattataaccattctaacaggtgtgaggtgatatctcattttggttttgatttgtatttctctgctgatgaatgatattgagcacctttttaaatgtgtattagccattaatgtcttttttgaaaaaaatacctgttttagaccccttgccaatttattaatcaaagagtttgtgattttgctatggagttatatattttggatattgaccctttatcagacatatagtttgcaaatattttctcccatttcacggtttccttttcattttgccgattgtttcctttgctgtgcaaaagcatgttaatttgatgaacctgtttatgttttattttgttgcctgcatttccagtgtcatatccaaggaaattattgctatcccggccaatacgttgccaatggtaaattttccttaaacttttatcttggagctttatgggttcaggtcctacacttaagaatccattccaagttaatttttatgtggtataaaataaggatccaattgtattcttttacatgtggatatctcatttttccaataccatttattgaagagacagtcctttccccattgtgtattcttggcaccttcatcaaatattagtttgccatatgtctgtggttttatttctgagctctctcttctgttccatcagtctatgtgtgtatttttatgctggtaccatattgtttcaattactataaccttgtaatatagcttgaaatcgggacaaatcatgccccagcttcgttcttttctttaaagattgctttggctattcagggcttttttatgattccatataagttttagaattttttttctatttctgtaaaaaagccattggaattctggtagagattcctttgactctgtaagcctttgaaaaagccatgggaattttggtagagattcctttgaatctgtaggtcacttaaaatgcaagctttttaaggatatcagtttttccagtgcaggcacactgaacatctttccatttatttatgttttcttcaattatttcatcgatgtcttatagttttcagtgtagtcttatagtttccagtgtacagatctttcacctccttcgttaaatttatatgtaagtatttaacattttgatatagtaaattttaatttttaaaaatttctttttcaagatggagtctcactctgtcaccaaagctggagtgtagtggggtaatcactgctaactgcagccttgacctcccaggctcaggtgatcttcccacatcaatctcctgagtagctggggctataggcatgtgccaccatgccctgcaaattttttttttgtattgtttgtagagactggttttgccatgttgcccactgttttaatattttttcagatagtttgttatattagtgtatagtttttttatcatgacactttagatttgtttatcagttttaagttttttggtggagtctagggttttccatatgtgagttattgtcacctgtaaacagaaacgatttacttcttcatttttttatttagatgccttttatttatttttttcttgccttatttctccagtgagaacttctagtactatgctggatagaaacgatgagagtgggagcccttgtcttgtttctgatcttaggggaaaatctttcagcttttcactgtcgagtatgatgttagctatgggcttattgtgtatggcttttattatgtacaggtgcattccctcgatatctgatttgctaagagtttttatcatgaaaagatgttgaattttgtcaagagctttttctgcatctattcagatcattatataattttcatccttcattcttttatttttgtgtatcacttttttttttttaactttaagacagggtcttgctctgtcacccaggagtgcagtggtaccatctaggctcactgcagcctcaatattctcaatcagtcctcccatctcagcctccccagtagctgggagtagaggtgtacaccaccatgcttggctaatttttgtatttttagtagagatagtgtcttgccccagctagtcttgcccaggctagtcttgaactcctgggccgtagtgatctgcccacttgggcctgccaaagtggattacaggcatgagccactgcactcagccgtgtatgccatttattgatttgcattccttgaaacatccttgcatcctagggataaattccatttgatcatggtgtatgatccttttactgtgccattgaatttggtttgttagcattttgttgaagacttttttgcatctatgttcatcaggaatagtggcctgtaattttcttgtagaatccttgtctggctttggtgtgagtaatgctggcccataaagtgagctgtaagtattatctcctcttcaattttttgaagagtttgagaaatactggtgttaaatcttggcacacaatgaagctatcttgtaatgggcttttctttgttgagagataattgatgactacttccatgttgttactcattattggtctgctcagactttatctttctttatgattcagtattggtaggttgtatgttctagtaatttatccatttcttccaggttattcaatttgatggcatgtaattattcaaagtggtctcttaagatcctttgtagttttgtgctaccagttgtaatgttgctcttccatttataattttatttatttgatccatttcccttattttcttggtgagtctagctaagagtttgacaattttgtttatattttcaaaaaaaccctcttagtttcatctatcttttccattgtcattgtagtctctatttcatttatttcttctgtaatctttattatttccttagttctgctgacattgggcttagtttgtttggttttgtatctagttctttgaagtaaaaatttaggttgtttatttgagatctttttttaaatgtgggtatttatcactgtatccctcttagaagtgcttttgctacatcctgtaagttttggtatattgtgtttctatttttgtttgtctctaaatatttattaatttcacctttgacccattggttcttcaggagtgtgttgttttatttccacatatttgtggatgttctaaaattcttcctgttattgatttctactttcaaatattgtggtcagaaaagacacttgatatgatttcaatgtttaaatttgttaagatgtgttttgtggcttgaagacttttccaaaatgtacactctagaggaatatatattctgttgctgttgggtagaatattgtgtcattttaaaatattttcaacaatatgattattaaataacagaatcttggaaaatataagagaatatgaatgaatatattaacctattactgaagtttaataacattatggggatgtttttctcaagtctatttctatatataactgtttttgtttttacatagtcaccttataacctgaagtaacctcaaacatgaggttacttcctaatttttattttatacatcaggaacattttctatatttttatttagcctctaaatgcattgattttaatggtcacagattattgcatcaaagtcatagaacataattttcaacccatagttctatatttaatcatgtatgcttttgcaattttttggtagtaaataatgaaacagtgccaatcttaacatattttttagtatttaaattgtatgtttgctggggttgccataacataatatcgaaaattgagtgacttagagtagccgaaatttattctgagttctggaggctggacgttcactatcaaggtgttggcagggccatactccctctgaaggaactaggggagaatcttctgaggcctctccccaagtttctgggaattgcttggcttgtggaagcatcactaatctttacttgatattattgtgtgtgcatatatctccaaatttcccctaatttttttttttttttttttttttttgagacggagtctcgctttgtcgccaggctggagtgcagtggtgcgatctcgactcactgcaacctccgcctcctgtgttcaagcgattcttgtgcctcagcctcccgaatagctgggattacaagcacgcaccaccatgcccagctaatttttgtatttttagtagagacggggtttcaccgtgtcagccaggctggtctcagactcctgacctcatgatctgcccgcctcagcctcccaaagtcctgggattacaggtgtgagcaaccgcatccggcccaaatttcccctttttataagaacaccaatcacagtggattatgagtccaccctgctctagtatggcatgttttaactagttccgtctgcagtggtcctatttctaaacaaggccacattgtgatgtaccagacgttaggacttcaacatttaaattggcagaggtaggacacaattcaacccataacaaaaataatttccttagcaccagtttccaaaagtggaattttcctgtcaaaacagtgtattgatagacatgttttgaaagttattttttaacttgtattattacaattttcatgctcatcaactatgcatgatagtgtttgattaataatattctcaacagccttgggaattatttttaatatcattaaaatcagtatctttaatcttcattaattttgtactctttagttgtagttttagtaaaatagataatttgtatgcatatttaccattgttgcattttaatttgtcaattatctagtaagtctaaatttaaaaatctctttccataggtttaataaatattcctttctctttttacttgtctttcttcctttaactattctatatttaaatctttaatgtatgtggaacttggtggcatatgtatgagatgaggatacaaatgaatattatagatacttaacctattgtccaagcaccatttactgactagtgcttctctttgtctttaataaaaaatgttttcttagtcattaaattcttgagtataagggtttcttaattatattttgtgtttcacttttaatctattattttgccaggaccatactgttttagctgttataaattattaatatttttatagattcatctcatagtgcttcttttacaaaattttagatatttttacttgtttattaatccagttacacttaaaattggtaaaatttcaagttacagcaatctgccattaggattttgactgtgaaatctacaaatctgttagattataattcatcttcactatatagaaaaatgaaataatattttccattattcagatttttagctattccatgaagtggtgtagcttattaaaattgtccattccaatatttaagaaatggttattagtcatctcctatatttcaggaatgtggtaaaagtaaaaaaaacagagagagagattaaaaaacagactaccatcaaggagctcaaattctgaaaggattgcagataaggaaactggcaaaggatgaagattagcaaagaggaatgcacagtgcacaatactgaacccaggatgacagcagggagaagtgtcacaagtttccagaaagagaggttgtgcttcagctaggtttgggacataacaggcagtcagctccatgaggatggagaacagttgtttcacagggaggaaacagcaatgcaaaggcacatagatttcaaagaacatggcacagaaatggaacttcaagaatgtaattgtgactgaagtttatgatgtgaatgagatataatgagtgatgagatcgcatttcacatggattttatgttctttcatgagggcactgtgtgtcattggtgggttttaagaaggagagtgacataattttatcttttttagaaagatttcagggaagaatacagcagggagacaagaaaacagtcaaagtgaacaaaaaaggttcactggccataaatatgtgttcagtgaatgaatgaaacattgaaagaactgatgtattaccagatttaacagctgaaaagtaattgatgaccttgttaagattacctgtatttagtgggatggttgagatggaagacagatatcaacaggagataatgaatataaagtactcattcaaaatattgcagatttgaaatcagatcttatttcattgttttccaaactagttgctagtgtataagaaataacattattattttgcttatgggttgactatatagttactctgttgactcttttatttgctgtaatagttttccatgtgattttgcatgttttgattactagatataaaattataattcttgtaaaaataactttctattttgacttctaataattatatagtttgttttggtttgttttaatatataggccagaattttcagaaagaagtgaaaattatgctttggacagtttcgtttgcttttaatggtgatggaaatgccctactatttcacacataaattgctgactgtaatactatatgtaatacttttttaacatattacacttaaagaagacccattacaatcccattttaaggaggttttgaacaactagaaggttttgattttttatcagatgacttttgctccctatgaaaattaagatatatattttctggccaattgatatgtcatattagattagtcatatcattattttaaatgatgctttgggtacaattttcttgaatatggtatattattcttctgcggtaatgctaaattttatttattttatatagtattttaaaataattatggccataaataagatttatcttttattactttacaatacattttaccctgttttgcatctgaagatacaaccctgaaatactgaaaaatctgcaccaaaatatttacttatgatagttaagcagcctatacttaatgagtcaagagaagtaatgcatttcagattttcatctgtaagggtcatcattgagctacatgaccttggacaaattttaatctttccattgctcatttatataaacaagggatttgaactaagtaaactccagtgtcactccagctctagcattttgccaacttgtatccatagagaagtttctccagttttatgctaataagcaaagatgaattaatgagtttcagagcaatagtactgtgtaaggtagtagtagactctatcctatgaccaggcaaatttaaacctgtgtttaaaaaatgatgatgcagtagtccattctccatctccttgtgtccatgagtagctggacctggaaaatgttggccctatgatttatcttgcattgcatctgaaaactgtagaccaagcacccttcactgttctgttcagctcacctgaaacattagatgtaaagagcaccagatgggagatcaggagccctggatttgtgtccctcttctgccatttactagctttgtgatcttaatcaagtcacttaacctctttaggcatcagttttcttatgtgtaagatggaatcaacttaatcttttagctcgtaaactctatgatatgagaagccataaatatataaactcttaataaaacaactttaatctacagagtcatctgaggtttactttcccaaatactgatctcaattaattctatcaacaatgttgcgaggcagttagtcaaagtatttgtgattgtatttcagagttggatctaggctcttgactccaaagagtttggtagcttatccaatgtgtctagtaagtggcagagcctcagctggagcccaggacttctgattcttcaactatgttcttttcttaatataacacattgtctttcattaaatcctgtaatcacttttatacttttcaagcattctattacatttctctgcactttaaattgtgagaaccaactatccttgtacccttgggctcaaccttgaaactctgtttatttataattttaaacaatgtaacatattaacactctgttcatgtatatgtttaaacaatttcttgaaaagtactccatctaacatttatcccttcttttcctgattctctttcagatagcagttctgtggatgaaaaggttttaaatcatacttattcttccctcctgaggaatcttgtcttttgtacatgtttgtttgtgacatattagatctgtttgattcctctgttttagttttgaaatgtgcatgttatcccagctttccattatttggttgtcctttaagtgtgcctctgatatgttgcacttatggagaggtcacaccttgccagctgcgcttaccttagctatacttgccaacctaggggtctgctactgtcaaacacagcatcttttcttaagtctggctaatcatgacctttctgactgattcatgatcttcactgtgcatatcaagttttaagggcaaatagtacttggaatatgacatattttccgggactctgccagtgcatttgtttaaatgctgacagctaatttcaaaacctctactcataaaaacacagtagctttgacttggagctgaccctgcttagcatctgtcatactaggtgttacgtgtgtagtgcagctgacctgtgtcccgatttcgtgtacataaaactgtagtatgctaaaagcctgtttgttttgtttttctcttactcttcatttaaggctcgaatagtaagtggcaatgatttggatgcttccaaattttctgcactccaggtgtgtggtgggtaagtaccttcatacctttctaatttattccattcatagatggcacttggctgtgttctcaacatatatgctttgagtgcaagatgctgcatgattagctagcctcattgttacttcattttacaataaagttgacattatagtgttttcttaaaaaaatgtaatacatgttaactataaaacaattctaaaaatatgaatatgtatatgattatatatataagtcaaaatcaactaaccagtttaactgttaacattatcattacatacccaaatagaatcacaaaattttatacaaatgaattcatattgatacaattaatgctctctttcaatgtgcttgtttgcacttaatgatatatgtacatgaacatttttcctgtcaacaactcaatgaatataatctatactattatttttcatagttgcatagtattacacttaacataagtatcaaagtatttaaaatttaatcacaaaaataatgtatgaaatttattttctatgtaaaaaattcaagcagcctcgtctttaatgttaaaagttacgcactggtatcagtgtggcatgaatgttcataggcatttttctacgtgtttgcaatacgtatctgtgttcatataaaataagtagttttgcatcgtggtttttttttttgcattttaacataaaacagtccactctgtgtaaataaataagcatgaatttaatgctgactttgtatctagtgctgttaaaattgtcctatacataatgactcacttaatctttacaatggccgtatgaggtaagtactattttgactctaattttacaaatgaagaaaccaatccacaaagcacttaagagatgtttccttcagacagctagtgagtgacaaagtcagtattcaagctcagttaatccaattccagagcctgtaatctcaatttacatgccacattgcctctgcaacttgccgttttctctttttccatttaacaacaaatgctttgccaaattttctactttattattttgaagtgatgcaaatatttgaaaacattcatacaacatgttttattcttctattggtgggttttcaaaattatttctaattcataattgcaaattatgacataattatagatactatggtaaatatatcacaatagattttaaaagtgtaatttgtggatcaatgcttatacacagtttatatattcatatatacctctttatatatgaatatagagagatatctatataattaattatctatctatctatatagatttttgttttaaaaccaagaccgggttttgccatattgttcaggctggtcttgatctcctgagctcaggtgatccacacaccttggcctcccaaagtgctggaattacatacatgagccaccgtgcctggcaaataatttaaatatatatacatatatatgtatagtgtattagatgttttataaatgttgaaatttgaatacatttatgtacagtataaatagaagcaaaatttagaggcatgttttagtttttttatctaggcaaaaagtttcacagttctgttttgtaatacactcattttttgaaaatcagtttgttattaaatacatccacatgttacttattttaaataaaatatttgtaagatttaaagttttaaatgtaaagctcctacaaattaatatatatgtatcgtttttattttgatgtttccaaatagaagtgattaagatgttatttctgttacatctctaactttaatgtccttgaaatatatgaagaattactctcgttcatattctaatgttatagtaatttaaataagttataaaagcagctgtggtgaaagatcattatgaattattcagagatattaaggtagtgaatagactctctactacaacaccatgaatactgtgtctttaagttgaccagcaataataatttgacaactaaatacaatgattgtcttaggaaataattaagttgaattctaagttagttatgaaaattgttgggacatcgtgtcatgcacctggaggtttatctgagtttatgatgttatagattctgcacctcccttcgcctacagcatctatcactttgtaaaaatttgatttgctaactcatgtctgaatatggacgtgatccttgtcagagcaacagagttaatctacatccatgcttttgttaagcacatgcagtataaatgtctggctaaaatagttcctctttgcatttcgaatagatctttccacattgttacgttttctgaaaatgcctctttcaacgactttctaagggattttggaactgtgatatatgggaagggggtgataattttcagtcatcaagagaatttgtcattgcctgaatgcttattttctcttaaagaacctgaagggtacgtttacatatgagccttcaatcacaacctctttcagaaagatgtgcttattttactttttctataaatattttagaatatatttttaaaataaaatgaaatactatttaaatatcacaacttctattatcctaaaaaactatgactggggcagacttttgaaatacggagtcattgcttttctattacaatgctgctaaatctttcacttttctaccttcgccatccccaatcagttgagagccaaacgacattcatccttcccttagtttactcaagtgtcaatgacagcataatctctacacactaaaaccaaattaataaactatatacactgaaaccagataatgaaattaataattctgctttctgatttctgcttagctctctgtacatttcctgtaagtgttgccagaaaagacatggcaaatgtcattctgtttttcctatctgtcacaataaaagttcagacaggctctggggaaaaactggaagagggacagagaagaggtgacagaaaaataaaaggagcaagagaaagtaggaaagatacatgttttggtgaaatcaatgaatttaacatttataccctttagtggttttataagattttgttaacttttatcatctatgtaagcaaagagtcatacagaaagcacacagcaactcaatatgaaaagtacaagaggtttagtggacagaaatgtctcaaagataaaatggagaggtagcagaagtaggtgagaagagcctttggaccatgacacagttcttaggtttgcaaaagtatatggagcaggaaggtgaattgagtatgaaaagcctgaaattgactataatgaggctaaaagaaagtcattcagacaaatgcagaggaaagtttgcttattagatgagtctttcattgggtacaagtagccagctctattatctccaccaagtttagccattggttgggagcagcttggggagggtgtagccttggggtgaatgctgcacccggtgaatgacacactggaggtgtgtcagctggaggcttttacccaactatcctgcagcagattctctctaagggatatctgagtgatacatgcccatggcagctaccgagcatcaatttgatgaaactacctttttttttttttttttgagatggagtcttgctctgttgcccagactggagtgcagtggcacaatctcggctcactgcaagctctgcctcccgggttcatgccattcccctgcctcagcctcctgagtagctgggactacaggcgccctccaccacgcccggccatttttttgtatttttagtagagacggggtttcaccatgttagccaggatggtctcgatctcctgacctcgtgatctgcctgcctcggcctcccaaagtgctgggattacaggcatgagccactgcgcccagcctgatgaaactacttttattcaatgatagtgaacaaagtcacatgagtaccttctccaaatgtgaaacacatttttaattagaataacactcctttggtgctttgattatatatgacttaagtttacctttcccttgacatttgtaattagaactccactggttgaattataagaagcatcacaaggggtgtgtgtgtgtgtgtgtattctgaaagtaccacaagtctataaaacagtggttgaattataagaagcattgcaaggtgtgtgcgtgtgtgtgtgtgtgtgtgtgtatgtgtgtgtctattctctaagcaccagacttgcatgcaccacaatttgggcaagtctataaagcaatggtgggattagggaaaaacagtttgaggaggatattatcatctttattttctttcttcactagtcattgaagttcttctctgcagtacagttctcatagcactaagttccttgagccgatgtgaaattcctctgtccatgattctgaactaggctggtaacttctgttcaacctctaccagaatgattgaaccttatcaggaaagaggcagtggttgcagaagtgaaataatgcagagacagagaaaaatgaagagacactgttgaaggaaagggcactgagatattgttaaattaaaacagaagcttctattttgacctcattttcaaacaggtacatttaccaaaaaatattaataagaaacgtatgctgagatttccaaggttgttcaattatcaccaggaacaactatcttggtaaatgtgaacaagccagttttcatccaaagtcctgcacaattccattgtttttcttaaatttaccttaattaaaatacccatttttgttaccgttgtagaactcaatgtcagttaggttcaacaaaggaataaagctggtttaacatatttttaattttctgtcacagtactgacattgcttttttatttgtctataaagttgagattgcctactatcctcacactctcttcctctttcatagtcttgacttccatgtttagccagggcctaaaatcttccacttagcatagaagataaagttgttcctactctccaggggctcttcacctaacttttctcattgcagcagtcttatctctcatagctgagaacttttaatttcagttcttcctatcaagtccactaatttgattcttccctgttccctcagataacttccctatttctcaagggtcagaaattctcctaagcctagacatgggctgtttcgactgccctttcttctgagtcagtggtttaccctacggcaccatccttgcatgctctgaatcaggtttgccaaatattaagaaaatgacagcccccacataacacagtgctttaatcatggaggaaggagccgttgtcttttatatggtttggttgtgtcacctaaatctcatctcaaattgtaatccccatgtgtcaaggagggacctggtgggaggtgattggatcatggggggcagtttcccccaggctgttctcctgctagggagttctcatgagatccgaggctttaaaagtgtttggcaattccccctgtccctggctctctgtctcctgctgccatgtaagagacgcctttcttcccctttggcttctaccaggattttacatttcctgaggtctccccagacatgcaaaactgtgagtcagttaaacctcttttctttataaattacccagtctcatgttgtgtttttatagcagtgtgaaaatggactaatatggtctttgaccttttagttagttatttttagggaacagtttcctttccctccagagaacttggtatagaaggagttcactatagagttaggtaagagtgaaatagagatttctacttattataagggttaacagatgtaaacagggcccactttcataattcattactgtatagccagtgactcatcatgcccatattttttcaacttatttgtattcacattaccactgatctagttttagtcctcagtaccttttacttaggcaattgcaaactgatcttctgagactgatcttctaaccaatcttcctttgttaatttcttcttccacattaaatctaatctctacactgttaaagatcaatgtctttaaaggacgggcctttctacctaaatatttttaatgactcttgtttttcttgaatgtaaaggacagttggccctctgtatctgtgggttctacatctgtggattcaaacagctgttgattgagaatatgctaaacaataataataaatagcaatgcaacaataagaaacacaaatagaaatacaagatcacaactgttaatgtagcatttacattgtatttggtcatgtaagtaacctagagataatttaaagtatatgggatgacgtgcacaggaaatacacaaatactgtgccattttatataaggcagttgagtatctgcagattttggtctctgacaggggatcctggaactaatctcctatggataccaaaggataactttatagctcttttcacatggctttgaatatatttcttgattcctatttctctctctttttactatggtaaagtattatcactgtttttagtgtttctatttttttggtatcagttctgtagcttatattagtttgataagttgcatagatttaacaagattcttatcctccaacttgatttcaaattcctaaggagtttaaaataagttgatttgcttaaattattacaggagaaacaacccttgacatctcttggccagtgttgggcacaatcatgccacaaggcagttacagctgctcgaaaggagcctcatgtgagacttcagggagtacgcctaatcacagactcttgattgtatcatgcctgttagtcctcagcacactgtctgcagtcctcacgcagagcaagcacataatgtcctatgcacaaaggcttaatctagacagagagtttcttaattaggaaaactgttaaccacaaggccgccaactttctaaaacccatgaatcaagaagtggttgctgagccattagcttcctgtggtcaagaagactgcctatctaattttggcctacctccagctctctctagtctcaggagcacttgatatcttctctacttagaaagtcataagatcattaggttagcttttgatattaactacaaagaccagacatcagggtgactacttcaatgtgtggatctatgagacctcacaaccccagacccatttagtgggaaatatactttggtacagcatctatgaaattaagataaaatttactatctatattcccaaccaggcttagttaaaccatagttttcttggggtagattataaatagtttcttttaggcatattttattcctaaatttatggtggcaaaataatcataaaactgactcagaagattaagaaaatggagctgtcatcctgaagctgctaatagctcatagttcaccaagttgtagattggcacctttttgatcatctctctttctggcttgggtttatagcttaacattctttcttactgagtggtagaccataaacccaggaaaaaatatttgactattacccacggttgatcagggatactgtataagactcccccatcttcgggtaatattagaaaataggtccatccatcctcacacatatataagaaacctgatgtctattgtaatagaggccatcttctgagctttaggaggctgaccataaaaaagttattcccccaaatcacattttttacttccattatttaatagtatttaagaacatgaaacctcaggataatcctagtacatgtaagccaggagaacctccaattttactcattatatgaaaactactcttttattccttttttttctgagatggagtctcactctcactgaagcaggagtgcagtggcctgatctcggctgactgcaacctccgcctcctgggctaaagtgattctctcgcctcagcctcccgagtagatgggattacaggcgcgtgccatcatgcctggctaatttttttgtattttagtagagatggggtttcaccaagttgcccagggtggttttgaactcctgagctcaggcaatctgccaccctgggcctcccaaagtgctgggatgatacgagtgagccacagcacccagcatttacattccagatcaagatccctttcaagccacgatgcacacaatggttctactttggggaaggaaatcagagctgccatcaactctgacaactttcctttagccagttcctggcgctggagcgttccataatggatctacacagctctggttggcttcttagaaagggcctgcttttcctttcatctttaggtgactgccgataaaaacacactcaataggaaatttacctttccctgatttctgtgagccactaactcgacctcataatatttgagacgtactttaaaagaaccccaaatcacgcacttccaaaggactagcatttggtaagaccgtctgcatattagcgatataagtttcatcacacacccaactcccaaaggcagtcttttctcaattagaaaactaaggccatcaacataagcttaagcatagtactacttctatcccctcaccctcatgaactcattcacaattttttttctcactccagggtctaaatctcaagccagtgctggtactcacttctggctttgagtatcacaggagtgccaacttaatatggcagctagcggggccaatccagcctcagaaaaatgaaattgctagttaagaaacctgaagacagtatatttgttgatgagaaaaaagtattgtattgaaacacatttccttctctgtgttcaatttgcttattcaacatttatatattagtatacatttcagctctttatatatcagattcttaatcttgacccctaagtctctagggcttaaatttatgaggaaattaatgaatcttagctacatcagagtcaagcttaatcttctaatgccttccagatattcttgagtttgaagagtagcaaattaaaaccactgatacatcctttatgaaggcagtgtttgagtcgtcagtcttaaagtggtgcaagtttagtaactacagaaaatatcatgttacattgagcagaataatcacttgtgttagaaaattaccagctattagctgggaaacactgaaaataaccccactaaataagatggaaagtgtaagaaatgccatggtttctacacctactggttctttccaagctgtaattgataatggctgttgggcacatctaatatatataaaagtcttagagagaaaaaaaaaagaggaacactgagggtgataattgtattttccaatgaagcatatatagagtatgtttttaggtatcttttaatgaatgaataccttattccatgaaggtagatgacatagattccctcttacagacagactatatagtagtcagagagaacaataaaataatcactgctaaaaatgtgtgctgctgctgctataagcttgtaaataattactcacttcttatttaaagcaacaagtttgcttaatccatatactttcttaaatatgaaacaacttgctcaaagaactgcactgtaatccatattttcagatatgacaaaatctatctaagactagcagattaagagttcttagtttttagtctgtcttaacatttagaaagaatataaaataaaataattaagcaacactttagatgtcatttaaaaatggtatatctcaaattcataattattatgatataagtaatactttttgaaatattgtaatataacagacccatatctgagcattctttagcattacttcctttaattcttgtagcaacttttggaggtaggtatgataattattattcatattttacagatgagataattcagaaatccagacactaagcaaatatcaagatcagtgacagtatcagagctgagatttgaactagatctagctgactccagaatttgattgctttgcttttatgcgaaattgatacaattttacacatcaataatgctcatttctggatctgttctattaaatattgtactgtacacttacattatattttaaatttaacattacattatgtattggtctgaaaagatttctaagtatatgtaccaaataaatgtagatatatttctagatttcaaaagtatatttgcaaaggaatttcaggatatatcctagaaaaatatggcctagataaactagtaataggttgaatgactggacccaaggtgtgataattcatgattgatattgtactcaggggtggctcttattgaaatgcctcaggaattgcctttacatagatttctaaaaattggtatataatagaggtacatattttaggggtacctgtggtattttgatttattcatataacatgtaataattaaaccagggtaattgaaatactcattaccttaaacatttttctttatgcctggaatattcaaattattctgtactagctattttgaaatatataataaattatatattgttgtagtcactcaactgatttattgagcactaggtcttatttcccctatctaactatatttttgtacctattaacctctcttcttccccacctcctctgtattcttcctggcctctgttattcaccaatctactttctattggtattttgatacatgttgcattgaatctgtagattgctttgggtaatatggacattttagcaatattacattttccaatccatgaatatggacttagattgtttttaactggaaaagataaaaatataaaatacatacttatacaatttaagggtgacatatacctgggaaaataattagtatattaataatggaattaatgtctaaaagatcttagcatattacaacaatgagctgaaactaacaagatggagtataaatcgtatattaaccaagataacctaggttatgatacagtaattaacaactaccaaatttcagtatattaattaaataaaatgttatttctcatccatgcaacatttccgttttttccccttatttctcagaatttaagcatgcaacatatagatatgaggaggagggtgcactttgatcttcatagttgttcagggaaccatgctgacagaggctttgccttcatacacgctgaatctagaaaagagaaggttcaagtgagaattcatgttagaggtcttcaagtattcaaaagattaggttataaaagggactatattgtcctgagcttctcattggacagaacgtggatcattgaagaaattgtgtataggcaggcttctgaccaatataagaagatatttccaataataagaactgtctttgtaaatactaagtttcctactgctagagacttttaaataaattaggtgctcagttgttagaaatattgcaaaagaaatttaaatatcagatgcttgattatttaaaacctgttccaatcttaatgtcctatccttatattctatcataatatagtacctgtatcagttagacattgccatgtaacaaaccactccaaaactcagtggcttaaacaatgattccttgggtcttgtctacattcactcatgcatgtgtggtcagcccaacagaggccattgctcacatttctggaggctctttggctattctggagcgggggcatttgggctgttattcatcatccagctggccaaaccaaacttgattatatgatggtgacaggattctaaagaataagtggaagcatgcaaggccatttgaatccaaaactggaactgacacctatcacttttgccacattctattgtgaaaacacgtcataagtcccactgagattcaaggaatgtggaaatgaggctctgttttctttataagaggagcgagtgactgaggccatttttgacaatagagtataatcatgtatattcacaattaaatattcttcaaattatatattttccacaatttagagaaaatagaatatcatttcttatatttacttccacttatttgtattttaaataatggaaaaatagatattgccatgaaaacatcagaatctcattttcagtagtacctaattattctgttacaatatgggataaagagtaatgtactttccagatgggtgaataaaagtgttctgtacatttaagagaagctgcatttctgatttggagttctcagtgcagactttatggagaaggtggaattaaattgggcttaaatgtttggattcaattttgacacatggatatggaaaataaaatgcagaccagaaagcagtacaaaacatgagttgcatcataggcaagaaagtggacagtagtatgtccgatcatgtggaggaaagaagtggaaaatatgttgggaaatgtaagttgaaagtttgaatgcctgaccaaagatactaaatatattaacctttgaataacatatttctgtaatttgaaatacctacatcttgtgaaaaatgactcagttattctggtcaaacaataactacagggtgatggtgaaaatgacggggaagaaactgatggatttaaattcacaagattgtatgattttcattaactagagcagaatcatctgccaaagtcttaatttttagaaagacattagtctccagaagcaggtgcactcaggcatagcaggcatcttttttgctttgagaatttttacacaactctgtcaaccatgataagcatcactgtaacgcctactcattatcttgaggcttagactctaaggtgccaggtaggaaaggccaaaccaggggatttgtagaagccatcactgctgagaatcatctgtataaatctttttatacaagatgacatcatctgccctataatcttcacatataaagacctcttcaggaaacaatacttgaaacagttattccagagtcacagagtgacagctacagaatcttataatttagaaggttccccacgtttaacaataagttgcatttatttgtatcaagtgtgggaggcacaaagctgtagtgcaagtgtcaaggaaaacacggattacatgtaacagggtatcctttccaggctagagctgagactcagatttgtccagtgtgacatctgcaaaatctctttgcaatgtgtatgtttgctttcattggtttacacagagtctgagagtagagaagctggacggtgcctgcaactgtggttcaaaactagacatatttgatgaaagactgtgtcagtagcagtgaaattgatgggcaacataatttttgaaaggcacctaggtttcctgtgagaagtcttatcataaagaaaaaaaagagctgaggatggcaattcagactcagcagttagaactagacatcagaggaaagaagttctcattactctgtgtgtgggtgggtgtggccaacctggttgtataagtaacttttaaggagagagaaaaggactgtatgtgaacttgagctgtttctctgggatcagggcaaaactgctgagttcccctctcaccaattgagtacaagccagccataggttacaaattagaattaacactaagtgaaggtgaataatgtctttgctttttccatttagccaatgggacttgagaagggaacattcccacattgcttctgaggaaaagacacatgataatgtgatacactgacaaatacaaagaacttcgaattagaaggcctagttttaaatcttgactctattgcttagtagctctgttagtctgggcaagtcatttaacctgtgagtcttaatgctccatttgaaaactgtggattatactcataatcacattataatcgcaagatcatttagtatgttttacctttcttttcaaatctagcacacatagaaaataatagtttaataatacattattaaaaggtaaatccttgctcatggtgatcagaggtagggtttcttggaactggggagtttcttaggttgcagtagttttagtgctagaaccaggaaagccttgagcaaaccaagataagctggccactttatgagttttgagacactctagctaccccaacgggctactcaaagggttcttctgagaagatcagcatagctgtaaaacatgtatagttcactagaagctctcatttagagaattaaatgtcaaaacagcatggtactggtatcaaaacagagatatagaccaatggaacagaacagagccctcagaaataataccacacatctacaaacatctgatctttgacaaacctgacaaaaacaagaaatggggaaaggattccctatttaataaatggtgctgggaaaactggctagccatatgtagaaagagaattaaatatatttctatctactcctaatggtcttctgcctaagaaaatgtacagattcaagcttggaaaaatagtaattgcctactccagccctctacttggcatatatctttagccataattgtttacctcttgaaaacaagaaaatcatatctcaaggaactcatctccagaacgacaaagagacaaggaagagagaagcctcaggatagaatggtgagttctttctagaactgaattgagttgtgagaaggagcaacttttagaacagaaatttgttttgttgcctatttgagcaaataagtagacctcatcagagattcttccctttctaaaaactttgatgtttgaatgaatacctggcagatgctgccaaacttctttcctttccatgcatggtgcagtgtcatttactcttttttttaattttttttttgaaatggagtctcactcttgtcgcccaggctggagtacagtggcccaatctctgctcattgcaagctccacctcccgggttctcaccattctccacctcagtagcctggggctacaggcgcccgccaccatgcccagctaattttttgtatttttagtagagacgggatttcactatgttagctaggatggtcttgatctcctgacctcgtgatccacacgcctcagcctcccaaagtactgggattacaggtgtgagccactgcgcttggcctactctttttaatattagctttttttctttttattttttttaaactttttagaaataggatcttgctgtcactcaggctggagtacagtggcacaatcatggttcactgcagcttcaacttctcatacttaagtgatcctcctacctcagcctcccaaatagccgagaccacaggcgcatgctaccacacccagctaatttaaaaaaaaaattatgtaaagatgaggtctcactatgctgcccaggctgttctcaaactcatgacctcaagtaatcctcccgcctggccccgaagtgctgggaatacaggcatgagccatcacacccagccaatattagctttgttatctcctcagctgagaccagccttttttcttcctattattgcaaactgggacatgggcaggattttattttgctatctttggcaggggggcccacttttcattggagttagagctagatacagatcttggcactgcttagaaacttgacactttctgtaccacaccattaaacatctccctgctggcaatgtgtcttacttattatactttagctatttcatgctcactattgagcaggctacaatagaactgtcgagtaaacatgctgattcaataatttcgaagtttcactagcattcaaattcttcgtagaccgcagaccaggcagaatgaacacagtaaatatcttacacagactaaataccaaaggatgtgagtggagaggaaaactaaaggaagaagactataccatttcattcaaaaccaagtcaacactttattaagtgtgcaccaagtacaaaagcactgtttgtcctttgagtcttttttgattagaggatgcagatgcctaaggcactgtttccttgtgcatgttgtatttagctatgaagatagttaaaaggatcagacagacaagggaccacaggaactgcaaagaaaaaacaggtgtccctgtggctaaaatgtgtcttaataatctagagtttaagggcctacttctggcatgaagaaacacttggacattggaactagtgggtcaagtttggtagatgtataaggctcatggggataatactggcacaaaaggattttgaagataggtgagtgccagattggaagggccttaaacatcagctaagaaacatgagggttgtgcctatattttctaacctgcttttgtaacttcaaatacctgcaggatattctggtttaccattatgcagtagtgcactagagagaggattagaattgtgagaaggcaggggaagagtaatacataccttcctcttcccttagttactattaaattatctgcctatcctgtccttccttgggcaaaacatcaattgtatgcaattagaagtcagcaaaggcattcaagccatgagtttaaaaattaaacctttgttgtgtgaagattgaggtagaaggaatatatgatacatcacggaaaactagacaattggaagacttttggaatactattgacaaaaaaggacatagaagctactctgtcagaataaataatgatgctagctttaagcatgttttgcttgggaaaaatatgaaacggatagttaaatggaagtgttaggtagactgttagtgaggatctaggtcatgggagaaagtttaggattgatacagtgatttgagattcagatctacagaagtgatagctagatgaaaatgacaaagagagcatagaagcctagactgaatgattaagaaagaaggatgttattacaccctcctaacaatgcatactagattcatttatatcaagcaacagaaagctatgacacatgcttgtttcatagaaactatgataagttgttgatcactccaggatatcctttacttacttatgttctgaaaaaactaaattacaaagatccagagtcacttaaactcttttttgatttagaaatagaattcatgatcttcaaatctggtataagactctgatgtctggaataaagttcttgctaaatagctgttcaaaagtatagctgtggaaaagcttcctaatttctctaaaatgatttttatatgcataagtaaataattacaattttcaactcattcagttgctatcagtattaaatgaattgacatgtgaacatttaacacaatttatgacacatagaaagcaaatattttttacatgttggtcattagtaattgtttctggtttgtaaatatgttctaatatctatatctctaatatatttctgataattagtttaaatttttatgataaagctattttaatgagaatgtaagtaatatactctttcaaatgtgaaaaatctttaatttgcacatttcttttgaaggttgatatcttagcctaaaaggggttgggaaagctgttgtgagtaacaggacaacctcataattaaacaaaagagctcagttgatctacaatgagtggattgttgtaaaagaaatattaccttttttatttttaatttttttaactatttagaaataggatcttgctctgtcatgcaggctggagtacagtggcacagtcatggctcactgcagcttcaatttctcatgctcaagttatcctccgacctcagcctcccaaatagccgagaccacaggtgcatgctatttgttctatatgtagtctcaaagtttataagttgaataataaacagggacataaggccaatttggacacagagagtggagatcttgtgcttttatgttagtcataaagccatttctttctgccaggtacatggacatcgtttgacagtggtacaagtccgctatttgacagtggtaggccaatgattttgtctagtgaaatagtagctggccaatttaaatatttattaatttaattatattttaatatactgagagcattaataacaactgccagaatttctcttatattgggaataaatatcaatatttatttctataagttcagagttgttcttgttttggtgtttttaggttttgttttatattagatacagtaagccttttgtcagttatcattaaaattttgactttttcagctgggcatggtggctcacacctgtaatcccagcactttgggaggccagggtgggcatattacctgaggtcaggagttccagaacagcctgaccaacacagagaaaccctgtctctcataagaatacaaaaaaaattagccaggcatgcacatctgtagtcccagctactcgggaggctgaggcaggagaatggtttgaacctgggaggcagaagttgcagtgagccgagattgcgccactgcaccccagtctgggctacagagagggactccatttaaaaaaaaatggctttttccaagcaattacacagtctgtgtcacagagggatttgtgattttgctgaagcacaaatttatgttggtcatccagcattcttattttttggctgctttgctctctagtcattaggaaattacatataatagagtcatattgttgttactcataaattcatgtgcatgtgtgtacgtggctgatgtctattgtttaggatttgttttgctttttcttacagcagatgatctataactgcaaaagggttaaggtgaactcaggcaagtgactagatataatccccagtaatttgactaaaaggcagggactggtccatttccttgtctggttcactctactgctggttacctgtgattgcagaatttagagacctgattcctttggcttgtgacactatgcaatcatggatagacagaccagaaggcattcaaagagaatacctgggcagctcttgcaatcagacagagaacatatgaaatattgtggcctcatactaaaagatttcctggtaaggaaatttcaaaatctctctccccatcaaatacagtctgatattttgtcactttcactatctgaataagattctttccatcaaaaccagagtcctgcttttacattaatttagcctattatgtcctctatccattgagaccagctccaggaaatagacagttccttggctattagtgagaaagatttcctggaactttctccatctccttccattgcatacaatacaaactactttatactttagttaatatgacttttagtttccatttaattcattaattctctaagatcttacagaaatgtatttttttaaaatctcatgttggtttaaaatagttccctgaataatcccttgttaaaactcaacaagattaagcatgagggtgaaatcaagagataaacagatattgaataatgcaacatcactgagtttaattttgtttttttaaactatgttccctgaataggtgagacaaggtaactgtagataaagttgtgccgcgttttaggattttcttttcttctgtctcactccttgtggtagacagcataatggccctgcaaagatgtccgcatcctaattcctggaacctgtgaatatgttaccttacgtggcaaaaggcactttgcagatatgattgaattcaggatcttgagatagattaccctggattatctgagtggacccaatataattacaaaggtcctaatgacagaggtgtcagtttcagagaagatgtgatgatgaatgggaagcagagactggagtgatacacaaaggggctactagccaaagactgcaggtagcctcaacctctggagcaggaaaagacaaggaaaaaaaatctcctacaaagctgccagatggcgcagagccttgcagagaccttaattataggatttctggccagaattgtaagatggtaaacttcttttgttataagccattaaatttgtgataatttgttacagcagcaatggtaaactaatatattctccatcaattttttaaatgtgtctaaatcatttttaaactttaccaccagagtgctttgcatcttttggaacacccactgtacttctttttcattaccttcttctacctaggatgtttgttttataactagagcctgttgtgcaaattcactgccattacttcctgagaattgggattgcttttatcatcaatctaacagaagtcatttacccagtatctgctaggtgctttatgctgtgctaggtattattttaatgtatcctcttctctaagagatcaccatcttttttgtaatcatgagttgaagaataattttggagagtgaagttacttggaatcagaagaaataattatagtgttttcaattaactgatgtagaaaaaaatttctagctgaagaattatagttctcagaatgtaaatcataagcctgcctgattgtgaatttatgggatgaataagactagagaggtaatatgcagtatgaataatatggctgtaatagcatttggtatggtgggagtttgctaagagagtggattgtagatgctcttacagaaaaaaagggtaactctgcaaaatgatgcttgtgttattttgcttgactatagtaaccatttcattatgtgtaagtatattaaaacagcttgttgtatacgttaaatatgttcagttaaagaaaggaaaaaggagagctagctagctaaaggtaattacatgtaaatagttggaatttatgtgtcgtttaatttaaattatgtataatatatacacatgtaatttaaataacctaacttgaatacactttaaaatatgtttatgctccatctttttaaaaaattgtagtagctatgtagacataaaatttggcttaaatgtaataaattgtatataacgttttcctaattatactgtatatcatttggtataccaatgtaaaccaagttaaaaacactgtcttcatcttagacagtgtggcttggccaaatatttgtgtggatgctataaataagtaaaaaaatctaaataaataagtaaataaaacatcagtaggacagtgctaaaattaaaacaacagaacatgagccttacatctaggtgagaacaggtattgcaagtggttacagcatctgctctgtcagttcagccgggtttctagagccatcagcctctggcagggttgctttcactaaacaattatggaatgtaaatttgcagctcagtgtcaaatgttctggattgatgtaaacgatttgggtttaatttttctcagaaccatctggttggcactgaaggactagcaaaaaggacagttctatggcttctaaacattaaaaaatcacagacagctctagtattggaataatttcatcatgatattttataatttgaaattttagctaatgaagtaacagttggtttatctataggttttgatatgtctcattatattgtaaaataacttttattaaaatatgcaaaatataaaaacaaaatcacttgtaaaatcctatatccagaggtaagtagagtggacagtttgtgtatgtgtgttattttaaaatcaatactcattttaaaatttcaaagactcttgagagtgaagtaagtttaaaaagtcaccttccctttgcttctagtgtcccctttcccacttccaacagtgaaccactgtttacaattttttgaatgctctcccagaaatactttaaagaaatatctgtgtgtttgtgtgtgtatatatgtgattttcataaatatgaaatcatgttgagtacaatatttatagctctatcttcacctaaagatgttaataataaatcattactatatgtatatatttcaataaattctgtaacaatatggaaaaaatgaactgttataagcgctatgtgtcaggtactagtattttttatcccattatttcattgaattctcacaactatattaagtggttcccattgctgcaatttacagatgaggaaattgagggataaagatgaagtctaaggccacacagtgagtaaatgacagagctaggttctgattccagccctgtgttacttcagaacttaggtattgtagttcttacatcaacaaataagttatcatctttatatactatagtaaaacattcaaatagaataatataacataatttatttaatcagcattttgacatcaggttttaggttacttcatttttattattgtatgtaatgtgttttcaaaattattgctctgaattatttaaaatataattactgatttagtaaattgtcctcaacatacattttatttttaaaaattttggttcattttataattctctctgcttccctctctctttttctgttttcctttttttctccctccctccctctctttttctccctttcttgccaatctgaaaggtcaaaatgcatctcatttttaaaatttgtattatttttaacaggtgaattcaaaatgttttcttatttcttgccatttgcatttgttattttgtgattgttcgtctattgttctcattacatttatcttctgtgataaattatctttattaaggtttgtaggagttatttatgtattaagggtatttttggcttatgtatcaaagtcatctttccagtttatcacattttgaatgttattatagcattattgatcttgaacagatttttattttactaaatctatccatattctcttgatttctgcctttagataatgcttacaaaactattcccaacagaaaaattatgagaatatttgcttccagtcttcttagagcaaacattcgtatatttagcctgtattaatttatttgaatgtatgataggagacatgaaaaaatattacttattcaattatttattacccaatcatatcttaaaaatattatttctccaaatttttaacatttttattattatgtacaaaattatatatatttgtaaccaaattgtgtttagttatttctgaactattcattttctgtaaattttcagtccaattttacagctttttaaaacaagtataggcaattaggcaagaaaaatggcacaaagattggaaaggaagaaacagagctgtctttatttgcagacagaatgatgatttgtatggaaaaccttaagaattctgcaaaacaattacttgaactaatagtgatgttagtaaaataggtttcaaggttaatatatcaaaatcaatttttttatcagcaaacaattataaaatgaaattttaagaatttcatataattgtatcacaacacataacatatgtaggaataaattttaaatgtggtacaagttctgcagcctaaaaaacagaaacatttatgagggaagttaaagatgacttaaataaacaaatttgctatgttagtggattagaagttgcaatattgataaaatctcagttttctcccatctaatcgttggattcagtgcaatcctactcaatctcagcattatttttcacaagaattgacaatctggttctaaaatttacatggaaatataaagaacttgaatattcaaagtaatctttagaaagatgaacaaagtttgaggatatatactacctgactccaagatatattataaagctacaataatcaaacagtggtaaactggtatgagagtgaaagatatgaaagcaatagaaatacacccacataaatgtgggcatttgatttttgacataaatgataaagcaacccaataggaaaagagacggggccgggtgcgatggctcatgcctgtaatcccagcacgttgggaggccgaggcaggcggatcacgaggtcaggagatcgagaccatcctggctgacatggtgaaaccccgtctctactgaaaatacaaaaaattagccgggcgtgatggtgggcgcctgtagtcccagctactcgggaggctgaggcaggagaatggcgtgaacccgggaggcggagcttgcagtgagccgagatcgcgccactgcactccagcctgggtgacagagcgacactcgtctcaaaaaaaaaaaaaaaaaaagaaaagaaaaataagagaagatactcttgaacagatggtgctagaatgagtgaaatgagtgaaagaatgagtatccaaataggaaaaaaaaaaaaaaaaaaaaaagaaacaaaaccaaatctcaacctctcacaccatccacatacaaaaaaattcaaaatctatcatatttttaagcgtaaaagttaaaactaacaaaccttaagaggaaaacaaaggactggtatgcagggtatataaaaaaaatcctacaactccattaaaaaagttaaacaatccaataaattatggaccaaaggtttcaacagtcacatcaaaagaacatataggagtggccaataagcatatggaaaaatgcacatcactagtttttagaaatatgaaaatcaaaggcaccaggagacactactatgcacctaccaaaatgttaaaaactaaaacaacatctaattttggcaaagatgtggaacaaccaaaactctcctatggagaaagggagaactatcctttggaaagtgggatggttatacgaatagatacgtgatagagcaagtatagtaaaataattatagtagaatctaggtggtgagtatagggtatgcctttaagcatttgttcaattttgctgaatgtttgagatttttaacaataaaacattagaaaattatagctttaaaatatacttgactataaagtcagttcccatgttgtctttaaaaagttgctggctactttcgctggtttacattgctattctaaaaaaatatcactttgagatttgtttggacttcggtttactcagattagtgtgacaatttcatcgagtttcaacagttgaaatatagttatgcaatgtgtaattttatgtttacattcattgttaaatttgttgctagatattaaatatttctggttccttgtaagattgggatctcgctcatttttattgtaattggttctttctaatacagatgctcttttaagagttttcagcgttcaacttttatatgctactaagcaaaagtgaatcattctgtttattaatatttaatagaaagggtttttggccacggtcattttattcttggacagctcagatatgtcttgcttcctgttcttgattatttttgaggtagtttatgaatagtataacacaacgcgtctgttaaattcaacagcggtgtgagggtcaaaaaattaagaattttaaatagagttctaggattatattggaaataaaagtagaaaaaatcagcgaaaactaaaaataaaatacaattattacacatgcatatgatacatttttaacaaactgaacattaaagagggcataaatgaatcttgcaactcataacaagtgctgtgtctatgcaattagcaataatcaccaagaatcaataaaagtgattaataaaatggaaaaatgctaagggtgtgtctgaaaacatatttcaatttgatcacctatcaacctaatgttaactcagttggacaagtgtaatagatccctgctgataaagtttttgtcacatgttggataggctaaatggcaaggaaacattttacagggaactcagttattgaagaagtagaaccaggcagagaccatcaaaggaagcaggcatttgcttaaaagtttttcaaattagacgaaaattttcccttttaaaaagcccaaaagaatgttggaattactatagctgtttaaacagctttaatggaccatttcccaagcctatttgatagaaatgcatctgatggctatacgtttacatttctcttagtcattttgaatttttgcatttatgaaattatgaacacctttccagaatccaacctcttcctaaatatcggattttctccatgtagagagactattttcttttctttttagtattttgcccattactaaccatctactaagctctcttgtcaattcctacagtaattaattgcctactcgagtttccaggaggcgttctttgtaaataatggcaccttatgacacttcttagaattgaaattcaatgtatttaacatgacccagaaggcctgggctgcctctccagcctcatttcatgcctctctttccttcctttgctgcactgcccaccattctgacctgttttctttccttgaatatgaggattgccctttccagccctagggctttaagctttctgttcttgctgtttggagagccctttgggacacatcacctctcctcaacaactcctgtccgtactttacatctctgctaaggggaccttcttccaagaaactttccctggctctatagtttatattagttcccccaccacccacctgttctgtctcagagcagctggttctttttcttcagggaacatttcgcagtttatgaatctatcttttatgtgataatgcatttgatatctatctcctctcccacaaggttgtaagcttcatatcagcaaggacaatatcctttttcttttttttttttttttaaacatcgctatattcttaaacctatcatgtacagggtatataagagaaagagaaatttcataaatattatttaaacattgaatgctatcaaaatgggttcctgtttcttgcagataagaccttactctcacatatttgtttagaagaaaaaaagaaaagcttgtctctattgtgatacttacgtctgatagtgactttatagatttccatttgagaagcatttgtatatgagaaatatacaacgtgttaataaaatagagattctaatgatgaaattctcaaaaataaaactacagggcagtaaggggaaaaagatgaaaaaaacagaatcatttagcgtatagcacacaggtgattatcaactcctagctccacatttgggaagacaagatctaatacataaaaatatgaagggagtataaatatataaaaagagatgatctatatattctggggaatttcaaacaacgtcattatcattacgtgtggtactgagagactgtcaagttttccctttttaaaattaaaaacattagtaagtgtttttttatttccttttttttccttaaaatatcttatttttctgaggaagagacagccatttcatttgaacaggttaaaggattttatctgttatactatacatcctgtactttaagctatttgaatgttagattagagatggcgctcagaaggtacgatactctgctagagagaacgtggcaatgaaggtgccacaggtgattcctttttgtaagtatgttttggctgtaaagacccagaaatcctcattctttcgcagatacctaaaaagtaaactggcctagctatattttttaaaagtctgaagaatgtctgcctaaaggtataagccattgtttctgtgagagtctgcgcaagactcagatggcatccctaaaatggaattgagggggtttgtttacaaaaggactattcacaaagtccacgtgtacaaaaatcacaaggatgggcatatacattatatgcagtaaaacaagccctttttagtgtgccaattaatgagttttgtcaaatgtacacatgcttatataaccagctgcccaatagaaattcagaacatttccattattgctaaacattcccttatgtctctctataatcaatcccaaaccctaggttgcgagcactcactgatcaacttgcaattactatagattagttttgtctgttcttggcaaccaatgcaaaaatggacaaacaggatcagatcaacttaaaaagcttctgcataccaaaggaaacaatcagcaaagtgaagagacaatccacagaatgggagaaaatatttgcaaactacccatctgacaagggattaatagccagaatatacaagggactcaaacaacactataggaaacaatctaataatccgattaaaaaaatgggaaaaatatctgaatagacatctcttaaaagaagacaaacaaatggcaaacaggtatatgaaaaagtgctcaatgtcattgatcaccagggaaatgcaaatcaaaactacaatgtaatatcatcgcaccccagttaaaaggacttttaaccaaaagacagacaataacaaatgctggtgagaatgtggaaaaaagggaatcctcgtatactgttggtgggattgtaaattagtacaaccactttggagaacagtatggaggttcctcaaaaatctagaaatagagccaccgtatgatccagcaatcccactgctaggtatatacccaaaagaaagaaaattggtatttcaaagagatatctgtattcccatgtttattgcggtattattcaccatagctaagatttggaagcaacctaagtgtcccatcaacatttgaatggataaagaaaatgtggtatgtatacatagtggagtattattgagccatgaaaaagaatgagatcctgtcatttgcagttaccatggatgccagtggaggtcgttatggtaaatgaaataaaccaggcacagaaagactaagtttacatgttctcacttatttgtgggagctaaaaattaaaacaattgtactcatggagataagagtagaatgatggttaccagaggctgggaagggtagtggtgggggagtgggaatggttaatgaatacaaaaatagagttagatagaaggaataagatgtagtatttgacagcacaatgaggtgactgcagtcaataatgtattatacattttaaaataattaaaagagtataattggattgtttgtaacacaaagaaagcatacattcttcaggtgaaggataccccattgactcttatgtgattattatgtattgcatgcctgtgttaaaatataccatgtaccccataaatatacacacctactaggtacacacaattttttaaattgcctgttcttgaattttatatgaatgaggtaatacagtaaggattctttggctctagctcctttagctcagcataacgtggttgaatgtattagtaatttgtgcctttttcttgatgagtagtataccgttgtataaattataccacaggttatcagtcctctgctgaaatatacctggaatgtttccatattatttttcataaagcttctataaatatttttatatgatgcttaatttatgatgaagtcaaatatatatattaatttatgacaaagtcaaatacacacacagatatatatatatatatatatatatatatatatatatatatatatatatatatatatatctttactctataggtcattttgggtcttgtctaagaagtatatccctaccccatggttgtgaaggttttattctatggtgagctttagaatctttataatttcagcttttatattgagacttgtgatccattatagttaatttttgtgtacatcgtaaaggtaggaaataagatttacttttgcttatatgaacatacagctgttccagaatcattggttgaaatactagcatctccctcatgaaattatcttggcacttctgttgagaatgagctgacctaatatggatgagccaatttctgaactctctatcctgttcactaatctttgtgatgatgctgatatcacataatcataacttctataacttgataataagccttgaaaatcagagtgtatttctccaattttgttatctttttacaaggttatattgtagccattccaaataccttgaagtcccatataaatttttacaaggtctactaaaaacaacctgctgggattatgattgacaatgcattaaacctgttgattaattgagggttacattgtcaccttaaaaatactgagtgttctaatcaaagaacatgtaatgtgtctccatttatttaggttttcttcaatttctctctgtgctttttttgcgtgatttacattgtacagttactgcacgtttattaaatttatctcaaagtattttatagttttggatgctgttaaaatttatatctttaaaatttcatttttcagtttttttgtttctcataaggagagattaaatttattttgtaatattgatcttgtattctgcaactttgccagatcactaattttcataacattgttgcagattgcttaggagtttctatgtatatgcccttgttatccacaaatacagtttcattacttcctttccaaagtgtatgggttttactgtttcttttcttgccttaatgaactgactaggctctccagtaaagtgataaatagaagtgatgacaatggacatccttgctttgttcttaattttaagcagaagcattcaggcttttagcattcgtgaactatgttagcagtaggtgtctcagagttgccctttattaagttcagttctctacctaacagttttttttaatcataaatgtgtgttgaatttgtcaaatgccatttatatatccattgagattatcaggtgggtttcccctttgtttatatagggaattaaattgattggttatccaattgttgcatcaatattgtattcttatgataaacttcaataggtcatgatatatttccctttttatctgtttgaatttgctaaatgcaacttgttaatattctgtgaaggatatttttgtttttatgctcatgagggcaattggtcgctagttctcttttctattagtatctttgtttgggtttagtataaaggtcctgctgtcctcattaaataaataaagaggtattctttcttcctctatttttctgaaacattgttttctccttaagtgagattattttcttgttaagtgattgcaaaacaaaaatagttttcttttatacaaattacatcttcttcaggaatacgggttttcttccagtagtgagctggcttatttgcgtgatcaactttcatttatttgtggagagatttttcatagcaaatcttgtttttaatttttaatgataattgtgctgttttaactcctattcataaaatttggcaaatggtttagtttaggtatgatttaatcactgtattctcaactataacttaatgtagcatcaagaaattaaaaacaagttgattaaaaccagcttacccttagaacataccaagttctttgaacagtataattaaatatgattctatcttaatcataaattgttaaacaagcaaagcaaaacgaagcctggaccatataataactccaacagccccatccccacacacttcagaatcagttatttcctctaaagtaacagcattttataataatcatttcaaaagccctcgtttccttttccagctgtgaacaatttgggtcatgtactgattaaagcaggtaagaatggagatactcctcttgatttcaatttaattaagatgccagttatccaaagttcacaatctttgaatttaaactcaatcggaaggaacctcacatgagattaaattttgcttttgtaaatccttttgctgagctcaagcctattgaccccacatgtttctccttgcactcgcctaagcatgctatcccagtggtagtgagaagcagaataacctgcgcctttatctttctcaactccttaattccccagcctttggctacattcatgactccaacaggggcatatttcctttccaccacttttgttctccctgcagcagaaactaacttaccatggaaaagaaagccctaaatcttatctctccatcagcttttctttatgtaggattccaagcaaacaaaatattattttcttaatacccagaccgatgtttgatactttaaaccctggccaaggaaagactaaagaggaaataaagtttcaaaacaagcacaagaggagcagaagccatggtgtccaatctgtctccagtagcaccacgttatttgcccaccataactataaaacagtaaaccaaggtgagtcttccctggtaccaaatgaatcctctttccagtaggaaaagagacactttgttcccaaaaacactgttgttgtggccctagaattttttttttttttttttttttgagacggagtctcgcactgtagcccaggctggagcgtagtggcgcgatctcggctcactgcaagctccgcctcccgggttcacgccattctcctgcctcagcctcccgagtagctgggactacaggcacccaccaccacgcccagctaatttttgtatttttaatagagacggggtttcacagctccacagagaaatacacagaaactggtagtaagtttagaaacttttatagggatttggcattgctctgccattcagactcatgaggagtggacttattgaaagtgttatgggtcatgtggtggcacactgcatatttataagcagtggttataaaactggttatgaggttttaaaaccacatactggtctatactaaatagaaatttttttgaaaaattgcttttcagcatagtgtgagaagcactagtataaaacatatatttagtgtctaaaataatgcatctgtcatatataggatatctccttcctcatctctcacacttagtgtagatgtctactctttttttgttgcttgtggttttttaacatgcttctgcatttcaactttatgaaatttgttttaaaacatcctgaaaagaatctggaagcacagtgggttcaacattctttttaaccacaatcttcaagatcgtagttttttttttctctgctaaattttattaaggctgcttccagtggtgtataagaaagtgtctcccactttttagtagcatctctaaatcatattgtggaccagtggcttctagaagataggagccaattacagtgaaagtactgagattattatgttctattaaagaaacaatataacttttaacttaggttgtctgttctgttctgtctttattcctcaatctttctactttttgagatctggcttaccttggccctgtaatctacagttaccttttataatgtctccattagcccctgtctaacccttatgataatatttctacatatattacacaaaaaatgaagtagaaacaatgttgaatgactgaaatcctttatcaaaaagttcttaagtagcaaattatgattataataattcatatccaccttaaaaccagggagcatgaaacataattgagccaatagactcaatactttttatgaaagtctgacattgaagaataaatttaataatatcaaatagtaacttaaaagcacaaatttgacatgggtttaatatttgaagactaagatattaaaatctaatgttaaagttttggttcactatgtagttataatttctgccttgctctatggaacaaaaagatgaattgtttatagaagatgtcttataatgctataaaagaaacataaatgctactgataaagactcatcacattaaggtgaaaatagattaatattctttatcatgggaacaccagtagcattgagattgatgttatcaaactatcttcaaactggcagaccgcatatgtgattgggttccctgacctcccaaatgaatacttttctcttattatatagtctagaaatctgaaaacctaaagtgtttcaaaggcattctgaaaaaaagattttaaaaaataaagcagcagtatcaaacagcagggacatataattttaggactataccatgcgcatgtgtagcaggtaacacacttaaagagaattgatcctatgcaggtacaattttatcaaatactaccataactaaacaatagtgatggtaatagttaccagaggtactgtatgtatagactgagataatgactgcattgattcgttgggttctctgaagaggttctttacaagttaagactattttttaaacacacatacacacaaattagctaaggcaatttgcatactctggaaaagtactacatgtagctcactctatgaatacacatatgcatgtaatcttcaagtaaaatacaggtaggcattatatctccagcacaagtcagtagtctctcttcactaagaggttaaagagaggccataaaccagtggaaaggaataccagaataaaacaagcaaagctttatttttctctttgcttctttgattcagtgtgtattgtcttctgtgagtctgtttcctgataatttaaaatgaatttttatgtaggcatgatatgtataatttcaggtattgtgaattgttaaacttccaatcagtgtactcagtctcctgttgttatataatatatagctactactacctatctatagttgttactctgtatccatcatcttcctgagttagtaaaatagaacagccatgttatttccgtcccaataacatgattttctataacagataaaatcctgtgatatgttgtatgtaggcagtattattaaacattttttctcatttttttctctctctttctattgccttttcctttagtagtttgctgcctatgatcacacaggaatttattactcagaatttttaaaatgtgcatttttattgattttttataaaaataaaaacactataccctactttcctctatctttccctttaacttctatcatatttttcttttaagcaggagaattattctctatttttcagctacagtaaatcaagtgtttgatcatcaagcatggttttcaatctatacaatcctgtatttagggtctcattggctgtaagttgatgatgtaaaaccatttgaaacagatctgtttgtttgaagtggggtgtagggaacccctgtaaaaagagggattcctccctccccatatcttctctccacatgatctttctctgcccaatgcagaatagccttaatgagtttccacggtaattcttggttttcttatgaatagcttaaaaatcgatggatatttaagatgtaatccatcaatttttaagctattcatgaagtatctcaaattaaaaaacaaagaaaatatcagcagatacacagaagagtaactcctagcatcttaagtgaactgtgtttaataagtagttcctagaaacagctgtggaaacgaaaaggattaaataaacaaattccaagagggataagcctttccaaggtgcaaaacggatgcctgttgttttcgtccctggaaataattaccatttctcagtatgaattaagggtcaggctttgctcacacaaaggataaagtaaaataacaaaatttctgtgcagaacttgcacaatatttaagaaactcaaggagcccagaattctgtttgccccctcacctatttgccaaatctgggggtcatgctgaaggcctgggagctttacagagaagtctgacctgttcccataccttcacagaattaaggaaataaaatcccgcttgaggaacaggcctgcctcaaacacatagtttatcatcttctcatgatatctaccaaatttggaaatagcatggaatggaagggcaaacagaaaaacccaagacctacaaaggctgactgaattttcatagttatttagagatcaggaagtataaatctaccagtttccgaagaggaagcttggaacatgcctgaataacatgaatgaagcaccaacccagccaattattcactataatccatgattgagtagaagtgattaacacccctcacatgtaccctacccatcttacagaattcaacaggaaccctagaaaaaaggtaagctcaaccagatcctttatgtttccttaatatatgatatgcacatacaataaaaaattattgaaaatgtgaataagcaagaaaatgtggctgataatcaaaagaaacaaaataagcagactaacaatccaataatggatttagtctgtatctacagactgtaaaattgctattattaatatatcaaagggcagaagtatacatgcactaaatgtaggaatacatggagagtttcactaaagagttgaaatacgtgaaacaggttgatattctagagctgcaaaatacaatatatactattaagtccttattggatgggtttcacaagagaagggacatagagaagatactataaatataattagagatagttcaatacatctaaaggaagctctgaaagaaagaatactaattaaagaaaaagaaaatatcagtatatgagctacagcgagaaattcaaatatatgtgcaattggagtgccaaaatggagagcaaagacaacaggaaatcaatatttaaaaaccaaatcaatatttaaaaatcaaaataaccaaaaatgttccaaaagtaataaatggcatcaagttacgaattcaaaagtctaacagcacccaagcaggataaataagaaatgatcacaacaaagatcactgcagtcaaattattaaatatcaaagaaaaggaaaaaatatttaaaagcaatggtatgttcttttcaaaagagaagcaataaaacataaggttaattttccaatagtaactgtgaaagacaagagaaaataaaatgatatctttaagtgctaaaataaaaactagaattttattgactttattttactttcagggggtatacgtgcaggttcgttacctgggtatattatgtgatgctgaggtttggggtatgaatgattccatcacccaagtactgaacatagcacctgatagtttttaaacctttgcctcttctcttctccgctctgatagtccccggtttctattgttacatctttatgtccatgagtacccaatgttcagttcccatttttaagtgattacatgacatattttgttctctattcctggactattttgcttaggataatggcctccagctgcatccatgctgctacaaaggacatgatttcattctttttcatggctacacagtattccatggcaatatgtactaaattttgtttatccaatccaccgtggatgggcacctaggctgattccatgttgttgatattgtgaatagtgtgatgaacatgagagtgcatttgtatttttggtagaaagatttgttttcttttggttatatacccagtaatggcattgctgggtcaaatggcagttctgcttttagctatttcagaaattgccaaactgctttccacagtgaccaaactaatttacattcccactaagtgtataagtgatcccttttctctgcatcctcaccagcatctgttgtttttgactttttaatagccattctgattggtgtgaaatggtatctcattgtagttttgacttgcctttctttgacgattagtgatgatgaattttttttcatatatttgttggacactggtatgtcttttgagaatggtctgctcgtatctttggtccattttgatggcattattcatttttttgcttgttgatttgtttaagcatcttatagactcctgatattagacatttgttggatgtgtagtttgaaaatatgttttcctattttctaggttgtctgcttactctgttgatagtttctttggctgtgcagactctctttagtttaattgggtcctacttgccaacttttgtttatgttgtaaaattgcttttgaggacttagtcataaattctttcccaaggctgatatctagaatggtgttttctatgttttcttctaggatttaagaatcctagtttgaagtcttgcatttaaatctttaatccatcttcagttaggttttgtatatggtaaaaggtagggatacacttttattcttctgcatatggctacctagttatgcaagtatcattattgaatagggagtccttcatccattgcttatttttgtagactttgttgaagatcagatggctgaagatgtgctgctttatttctgggttctctcttctgttccattggtctatatgtctgtttttgtacaagtaccaagctgctttggtagttgtggctttatagtatagtttgaaggcaggtagtataatggctgtggctctgttttttgtttgtttgttttgttttgttttgttttttgtttgtttttgttttttcttcttaggcttgctttggctattgggacccttttttggttccatgtgaattttagagtagttttttctaggtctatgaaaaatgacattgatagttcaataggaatagcattgaatctgtagattgctttgggcagtatgaccactttaatcatattgattcttccaatgtatagagcatggtatgttttcccatttgtttgtttcacctataatttcttttagtagcattttgtagttctccacttacagatggtttacctttttggtttaaaaaaatttttttatggctattttaaatggtattgcactcttgatttggctctcagcttgaatgttttagtgttgtatagaaatgctactattttttgtattttgactttgtatcctgaaactgtactaaagtcacttgttagttccaaaagccttttggcagaatatttagaggtttctagatatatgatcatattttccatgaagagagatagtttgagttcttctttgcctattttattgccttttattttttctcttgcctgattactctgaccaggacttctagtactatgttgaataggagtggttagagtgagcatccttgtcttgttttagttgtcaatgggaatgcttccagtttttgcccattcagtatgatgttgcctccgtgtttatcatagataactcttattattttgtggcatgttccttcgatgcctagtttcttaagttttttatactgaagggatgttggattttattgagagcttttttctgcatctattgagacgatcatatgattttcatttttaattctgtttatgtgatgaatcacatttatcgatatgtgtatgttgaaccaaccttgcatcccaggaatgaaacctacttcatcatggtgaattaactttttgatatgctgttaaattcagtttgttagtattttgttgagggatattggtctctagtttcctgttttggttgtgtctttgccaggttttggtatcagggtgatgctggcttcatagaatgagtcagaaaggaatccgtcctcctcagttttttggaatagtttcagttgaattggtaccagctcttctttgtacaactggtagaattcagctgcaaatctatctcaacctgggtgttttcttttttttaacaacccacgatttatcctccaggaaaatatcctctaaaaaaccctgaaataattcatcagcatatctttactacaagacatattaaaacattgttgaaattgaaggaaaataattccaagaagcatggaactttaggaaagatagaaaagtaccagaaagagaaaatatctaggtggttataaaggaatattgattgttaaaaagaaatgatatacagcctataacatatgcagcaataaaataaatgaaaacagtaatggcataaagtattgagttaaatattatgtttcattcattgttcaggaagctaaagtactaatttcatttgactttagtaagcgagtattcatgttttaatatctagaataaccactataataaaatagatgattcaagctagtagaggagaaaaataaaataacaaaataaaaacattttacaaacccgaaagaagttaaaaaaggtgaaatagggggacaaaagcagagatgggaaaatgaatatcaagtagtaatacatattgcttccatttattattgtaatataaagttgataaatacattctttaagtttaaaagtcagttgagtttaagaaaaacattaaataaataaatggtgctgattgtacataggtgacagaaatttggaaaatgctggcacaataactactacagggaagcagaagagaatgttttctgaatttaggcaaactagatgcagttctgactatgctattacttatctaaataaccagcaaatagcaacttgtctttgcaaagcaaaagattatttttcaaaaactttcatatatatatgattttgattcctcaatcactttttattgaaatgattactatttgccatgtgtgactatttacatgtgtaggttattaagggccaatatatatttttgtttgtgttaaaatgtccaaaagaaatttactcacatagggcatttatagaactgaaggaccatggattatcgaaacgattttggagaatatgagtgatggaccatagccattcatgcaataactatttattgattatgtaatatatgttagtctttgtgctaggctcagacattgtgagacagaaaaaaaaaaaaaaaaacatgggaccagtcattgcagacagtattaagtaatagaataaggctaagtctcaaactgagcagtggcacagggagaggaacaatttgttttactagtgtgagatcctgaaatcttcacaaaagaccagacacattagctatgccttaaatatttaatagctcgcttacttggggaaaggacattcaaccagttttgaaaaaaaaaattgcaaatagattcacacttttaaaaagtacaaaaattacttgaaatggatgatttaatttgtttagcattataatttctgaaatgcagactgtacattcccttcacatgaattgttacatctgatttagtatgtttttagattggttttgttttgaggcaactgatgctaataagaaacttaacaagaaagaaagccaaggcattttcctttgttaaagttttaaatgtttctctattagattcattatccatttgctttgtagtttatttttatttatttatttattttattattattatactttaagtttcagggtacgtgtgcacaacgtgcgggttttgttacatatgtatacatgtgccatgttggtgtgctgcacccattaactcgtcatttagcattaggtatatctcctaatgctatccctccccgcttcccccaccccacaacagtccccggtgtgtgatgttccccttcctgtgtccatgtgttctcttcgatcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtccatcatcgttggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgagcaattgccacaccgacttccacaatggttgaactagtttacagtcccaccaatggtgtaaaagtgttcctatttctccacatcctctccagcacctgttgtttcctgactttttaatgatcaccattctaactggtgtgagatggtatctcactgtggttttgatttgcatttctctgatggccagtgatgatgagcattttttcatgtgttttttggtggcataaatgtcttcttttgagaagtgtccattcatatccttcgctcactttttgacggggttgtttgttttttttcttgtaaatttgtttgagttcattgtagattctggatattagccctttgtcagatgagtaggttgcaaaaatttttctcccattctgtaggttgcctgttcactctgatggtggtttcttttgctgtgcagaagctctttagtttaattagatcccatctgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtagaaggtgtaaggaaggaatcgagtttcagctttctccatatggctagccagttttcccagcaccatttattaaatagggaatcctttccccattgcttgtttttgtcaggtttgtcaaagatcagatagttgtagatatgtggcattatttctgagggctctgttctgttccattgatctatatctctgtttttgtaccagtaccatgctgttttggttactgtagccttgtagtagagtttgaagtcaggtagcgtgatgcctccagctttgttcttttggcttaggattgactgggcaatgcgggatctttttggttccatatgaactttaaagtagttttttcgaattctgtgaagaaagtcactggtagcttgatggggatggcattgaatctataaattaccttgggcagtatggccattttcacgatattgattcttcctacccatgagcatggaatgttcttccatttgtttgtatcctcttttatctcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttccaaattgaatgccctttatttcttctcctgcctgatttccctggccagaacttccaacactatgttgaataggagtggtgagagagggcatccctgtcttgtgccagttttcaaagggaatgtagtttaaatttcctttgctgaaagtcaatgaagaaaataaattctggtatatacttgacactttaaaaattatatcttaagccacaaaataactgtatgtaatcaattggtatatcaaaataaaatattttctacttaattatatacttcaggattctaaaaacaaatttatcttttaatttcacatcatacagtataatttttcctccaagtgaagaatgtatgttattattttaatattataacagaaaaaaatccacccacactgtgggaaatatttaattatgaattgtagtaagaatggatcaatacccactccatgtaagaacaagttaatatttctgagcttctagagaaaaccttaatcatgcagtggagaagtaagtgtgtccctttggcttacatattacttaatgctcactgcccttaattaccacattatcatgtccactgacacatacaaagaacataatatatatgtatatatatattttgttttttgagacagagtcttgctctgtcaccgaggctggagtgcagtggcacaaacttggctcactgcaacctctacctcccaggttcaagcgattctcctgcctctgcctcccaagtacctgggattactggcacatgtcaccatgcctggctaatttttgtattttagtagagacagggtttcaccatgttggccaggctggttttgaactcctgacctcaggtgatctgccctccttggcatcaattttacacataaaagttggtatgagctcacacgtatgcatttcctgagagtaattctttaaattagatcaaaattataatgtttaataaaatataatatctcctgaatctctcctcttcatcactactgccttaccctgacttggacttttaccatgctgtcttaattggcatttctacatccattcttgctccacaagaagatgttctccataccatagccagagtgggctatttcaaaatgtaattatgatcaggtgatcctactactcagacttctttaataactttccattgctcataaagatcaaaaccattaataaaaaggcctgacccttctcaataactctttagttttgctctttgaattccagtcacactaggtttcagtttctaaaatatgaataggtttctctacagctggcccattgtctctgatacccctctgctcagagtagcctttctacctccctttgcatagctaactcctcttcactgaatctctcagtcagcctgtcctcagaaaaagcctttcctgacctcggtgacaacatgatttttttctataaaaatttcttctggcatcatatctttatagcactcaagcagctgtatttataccttttaatactttgattaataatgtcttatctgttcactaaataataaggcctaccaggattcacactgtatgttttgtttttttgttttgttttgttttgagacagagttttgctctgttgcccaggctggagtacagtggcacaattttggctcactgcaacctccacctcccgggtgcaagtgattctcctgcctcagtctcccaagtagctgggattgcaggcgcccaccaccccaccaccatgcacggataatttttatattttttgtagagatggagtttcatcatgttggtgaggctggtctggaactcctaacctcaagtgaaccacccactttggcctcccaaagtgctgggattacagccatgagccttcgagcccggccacactgtatgtttttactcaccacctgctcctcagtatctagaagagtgaacttggtacataacgggattgaatacattcttatttcatattcttacattatttaaactaagtagaaaaccataacatttgaagttaattccaacagcgtaaaaaggtacacactgaccttgttttggataaacccaaaatgtattaaataattttctagttgtgattataaagaggtaaactacttgtggaacacatatgctggcaacaggcaaataataattatataaagaattttatttttattttctatatgtataattttaattgaataattacatacaaagattttatgataatgataattgggtacaacaaactacatttattttaaattcattagcgaagtgggacgctgctaaacagttttcaaatattaccttattttgtcccgataagagcaatcgcaaatgattttcaaagccggattgctttacttcagagcctaagttcttaataagtacactattgccttgctgtggcaattttatgtatgctgtatattagcccttatttgttaagcatctgttatgtgtcagacactctaaaagtacatgatctcactgatcctcacagctggataggtacgtatcatgatccctatttattagataccctatttgaggaattgcatttattggaaatttaaaattgatgattacaaataggggcaatcactaatgcttagatataattatgttttccaaatcagagcttatcttaggaagaaatgcaatcttactcttccattgttaccgtttccaaattttctagaaacaatgcgtatgcttacataataccgttttggtaaaaccacattaaaaataaggactgttgttgctttgaatgctggtttttaggtgaatgatattctcctacaaaagtcaactactggtagataattcagagatttatgcaccaaaaataataaaatagcaaggataactcattgcctattatgagtactagacatctgtattcatatgagactagatgaaaagctcattttctttgtcccacaggtcagcgtctggaataaaattaaaatgtgtaaaagtggttcataaaattctgtctcccagataaatattccctgggcaaaagggagaaatgaattggaggatatgggtgttaagtttgcctgcacatattctactcagaatttcttttcttataaagtgggccctctgatggtacgattttttttaaattcaatttattttaatagttcttccaagaaaaacaacagcgtcatgacaccagttgcctgctgaatcttttatagctattaggaaaatgagctccacaagtaataactacttcaatagaagttcttaggaaacttggagcatattagagtgtggagctgtgtctgcagaggcagatgaaagagacagctgaagcaattatgtagatatttcgggaaaatggaaacaagataattaagataatttgattaaaaattgaattttttaatgcaacacaaatggaaacaagataattaagataatttggttaaaaatgaatttttttaatgtaagaagttgcctggtcatgagacagtgttagttgtggcaaagcttatagggccatgttcagatcaagtttccataaaggagagaaatacatgccacaaacagctgcttgattgcggcggcatcttgattctttgatgccacttaatacccattttggtaaagattctattttggaaaaatgtcctactgtaaaaaaatagaagtgatttaggtaattcaggaaaaaacttagaaacatattatgtaacatgttaggtcaacagtcctaattttagcttaatgttttgcatttataaaaggttttagagactaaactgattctacaaaattgtccagtgagggaatgccttactcttagtacaggtttctaaggtaatggataaggtcacaccttctagtgttttggtccctgcagatggcttaaccaaccctacaagttggttaatactcttacctccattagggtgataaggaaactgagctaagctagcaagcacaaccaattaagtggcaaagccaagactaaaaaactcagacatacaagcttttctttttctttttttattttttttgcttaaaaaagtttaacaagacaggtaattcctttggacaataaaaattcaaaaagcaaaaagactacatagcaataagcaaatctccctctttcctgtacttctcgccacccatcccttttccttagggagagctcactttacccatttaattttgtatctttttagtgatgttctatgtacatcaagcatttttatataggtctttatgtatgtaaataaacaaatgatagattatgcgccattcttcacccttttttcagtttttaacataacatataggtctttacctacaaatatagagtcacttcatattttctagaagatatattgtattccattgtataatgtatcacaatatccatgagggacagtaagttgtttcccatcatattttattactaaatatactgcaaaaattattattttttatgtgtcccatttagtaattttgttttaggtgtgtatttatatataatagataaactttgcttttaaacgtaacattttattgtttgaaccatttacacttattgatataacaggcctagttctatcatttttgtttgttctttttataatctgttttgttctctagtccatctataatttattttagtaatttagaaagttgatctttttcatttataatatatttattcatctcatttttgagacattatgtatgcactttccgtaataagcaatgataaaattagtttagtccatattagtttagttcctcaattttttagtttagttccttaactttttaagcatttttaaattatgctttaagttctgggatacatgtgctgaacatgcaggtttgttacataggtatacacgtgccatggtggtttgctgcacccatcaacccgtcatctacatgaggtatttctcctaatgctatcgctcccctagccccccaccccatgataggccctggtgtgtgatgttcccctctgtgtgtccatgtgttctctttgttcaattcccacttatgagtgagaacatgcagtgtttggttttctgttgctgtgttagtttgctgagaatgatagtttccagcttcatccatgtccctgtaaaggacatgaactcatccttttttatggctgcatagtattccagggtgtatatgtgccacattttctttatccagtctatcattgatgggcatttgagttcgttccaagtctttgctattgtgaacagtgctgcaataaacatacgtgtgcatgagtctttatcatagaatgatttataatcctttgggtatatacccagtaaatgggattgctgggtcaaatggtgtttctgcttctagatttttgaggaatcgccatactgtcttccacaatgattgaactgatttacactcccaccaacagtgtaaaagcgttcctatttcaccacatcctctccagcatctgttgtttcctgactttttaatgatcaccattctaactggcatgagatggtgtctcattgtggttttgatttgcatttctctaatgaccagtggtgatgagcttttttttcatatgttttttggctgcataaatgtcttcttttgagaagtgtctgttcatatccttcaccctctttttgttggggttatttttttcttgtaaatttgtttaagctccttgtagattctagatattagccctttgtcagatggatagattgcaaaaattttcttccattctgtaggttgcctatccactctgatgaagctgtggaggagctctttagtttaattagatcccatttgtcaattttggcttttgttgccattgctttttgtgttttattcatggagtctttgcccatgcctatgtcctgaatgatactgtaaaggcaatttctttattcctgaattagtttttgagtgcaagataatgtgtttgtcacaatttatatttcttccagaaaaactttttatatttagggaatattctttcttgtcatttgttttttcatctcttctttgtttttgtagtctttgtgactatcatgtattagtttcctattgttgttgttgttctgtcatttttttaaaggagatgggtttttcttgtgtcatctaataaaggagcattgcaggcaaggatagattctccatgcttcaaagtagtgcatttggacacagggtgatatatccatgaatccttttagcctttatgtctttccagacaactgtgattggcagctgccagactcttcacaatacagcccctttcctccaccctggttctctaacatcttactcatcacattactgtatctggatagttcctttgtttgttggttcttccttgatttattttactgtcataccatgttcaggacatatctttttcatcattccaaataattattggttttataaatcagaatgggatctgtaatttcaattacagagttctgttagtttcacttgagatctgtagctgtagcactactcggcttcccactgggccttcagtcttcaatgtatttgccagtcctttctcatatattgtgttttgaattacagacaatagtttttatctaagacaagtttggttttatctaatacaggtttctctctctttctttctctttctctgtgccacacacacacacacacacacaaacacaaacaataagatgaaaggaaaaagaaagaagtgagatttatttttattcattttttaaatggaaactcaagtaactcaaagctcacacttgaacttactgtacattaccaatgccccactattattttcctaagaatctagcatcttagattcattttcatcacaactgaggcttcaggtattcacaaagttgttttcttctactttataaagtactaagtgagatgatatttactatgttgtaaatgagaaacaaggtgaaagatttgggctttaagacaattttttaaagttctgttaagagtcgttacatatctccttatgaatcataaattcaccctcaattactactggtcacttatgaccatgtgatatgcttggagacttcctgaatccctgctctaaaaagcttgagtgtatacacaacacatgttttctatctttattcagtatgtcttgacatctcctcatttaggaaatagcttctttctttcaaaagtttatcctttttattttttgccctaaaggcaatcaccttttactacttccttattctctttttctccttcccctgtatcttagaagcttccatctctgttgagcctccgatcagcttttcaatgttccctctggtcccacctaccaaaaagtctgcactcacacccccagcccttcagtcaactctgccattctgttttactcttttcaaataaactaattgaatagctaggcaacttaatgttattgtttctattttactgataagagattgaggtgataagatgttaagtgatctagacttgtactataaggccatctcttaagagaaaatcatctccctacaaagatttccctgttacctgcatagcactgattgccaaatgtacaaatatggatttgatttatcacactgctagagagtgccagggtagcttttatggaataattttcaaagtgacatctgaattaacacctaggtaatgagatctggagctacgaaggttctactgaagagaacagaggtaggaatgagcttggccaactagaggaactgaaggaaggccagtgtagtccaaatgcagtgaaccaagggaagagtaggtaaagatgaatttataaagatgcaaaggccatatctctgagggccaagtgggccttcatacaggatgtggacctccttttaaatttagtaggaagcaaggtttgcagagatcactctggctgctccgtgtagaccagtttggagactatacaatgacccaagttagacggggtgatagtttagactagagcagtgatatgtactatagatgatcatattttgaaggtacttcaaggttcttaggcaaatgctgttttatcaatatctcttgttttccctgatgtatgctcttaaattgcacccttagctgaaggagtgatttcttgtgtgtggtaacaataacatcctccgtttgtagaatattttttattcttcaaagttcttggacattatttgtggcaaggacaatactgatccatattttagtcataaaatatttaaatattaaaagacagtgttaaatgaagttttaaggttgacacccaacctatcaaatttaagaatttgataatatagtttgagtctgtggattaaaacaacatgatataaaactctccattgaataaacgttgcttcaaagctactttatgaaatttaagtgcgagatctgggtaaaaggacatgagctgcattgactgctgaagtaggactcaggagtggagtgggtatgaagttgaaatggagggggataccactaggagtataagaaaggacattatctgagccacagatcagccagacagacaggtctacacagacacagctgaaggcctctgagtgggcttctgatattaggtacaaaaatttaaaatatttatttttgaaagcagcattaaacactaaacatgtttttgtgagaaaaaaataagacaaaaatcctcagtgaaactcaaacaggaaaggatcaaagaattcataatttagactctatttccatttagtttgtcatcttttctcaaaaattacatttacctcctggcattccacgaatagaatattgagttgggttagcttttcaggatcggaagttttgtgtggaagtgtctgcagtttttttggttcttccccatgatctctgatactgcacatacaaaaatggaatttcaatccccatgatctctgatactgcacatacaaaaatggaatttcaatcctggttattctccagctgtaccataaacaactctggtagcagaggaaaaaagcctacactctaagaaggagccaggtttatgccctacacccctgtttacatcattggctggcagataaaatgtatgctgagagaacagtcgttaatttaacaattcaaacactgccattccaagacatttttgcactgtagctttgctatggaacaaaggcataatgaataacatttgttttggaaagagctgtggggatgcgaattcttcctttattcattcagtaaatagtattgtgtggtcaaccctgtactgtttggatagcgaggtggtagagtagcaggacagaagcagcgccttttgcaccatagatagacaatgaatacagcattaatgtcatgaagttcccaggtacaaggtaagccacgctttatataacctaaacttctctgaatattgaggatcccctaatacttgctctttcgtctctatactcttacagatcatctctcattaccattttatttgtactttctcttcagcaatgtttagcaaagtggttttgttgtaagtggtataatatgacattgcagagaagtgcagccaggagagagtgctaatggttgcaatgaagacatcttattgcagttggttaaaattgttcaaattacctgttacttgataatataccaaagctggtatattaatttaaattaattaaaatcatctgcccagcttactttaccacaactgtgtcttattctgtctttttactgacaccttgaatatgtgcaagttctccccctttctcatagaaccaagtatctgtgaccatctttatctcatgccaaacttatgaacactgaaacagttccctgtagtcatccaagcagattatgttttaccatgtgggaaagctcttttatgaataggagatgaggtttatttttctccctactaaaagtataacacactcttattttctaaacaaaatataatctccttaagtatataggtgaatttgcaagaaaataagggaactttttacaggtcaagcaactagtgaaagtggaaatgcagagagacaagcaaacagctgtcaactgttctggggcaaatgctgatctcacaagcccagatcttcagctttagcagcatgcaggctactggagaaaaaaaaaaaaatcctgcaacctccagaaatgagactttatagtagagatccctgcaaaaagtgggacttttggatctattccacattcaattttccatataatagaaaaagagaaaacattctccaagttattttatgaaactggtgtaaccttagtacccaaatcagataaggacagtacgaagcaggaaagttgcagaccatgttcactcatgagtttaaataaaaaattaataaatggaatattaacatccaacaattgtataaaagacaatatatcatgaccaagttaagttaaatccaggctttcaagtttaacttgacttgcagtcagtgagtaatgtaccaatctacagtagctgattaaaggagaaaaattatgtgatcatttcaatagatgaaaagtcattcaagactaaaagtccttcataatttttgagaaagaaattccagtaaattatatggaaaatatcttaacccgatgaacttatataataaaaacctaaaggaacagtcatgcttaacagtaaaaaactgaaatatttactttaattccagggatgagaaaatgtatctattatatcatcacctctgctcagtattgttttggagattctaaggagcaccataaagcacaccaacatggcacatgtatacatatgtaacaaacctgtacgttgtgcccatgtaccctaaaacttaaagtataataataattaaaaagaaaaattaaaggtataacatttggaaaatagaaaacaaaactttcattattagcagatgatatgttctacatagaaaatgcaaaagaaacttcaaacaaattattagttttaataagtacatttggctgggcacagtggctcacgcctgtaatcccagcactttgggaagccaaggcaggaagatcacctgaggtcaggagatcgagaccagcctggccaacatggcaaaaccccatctctactaaaaatacaaaaattagctgggcacctgtaatcccagctaagtgggaggctaagacaggaatcacttgaacccaggaggcggaggttgcagtgagccaagatcacaccactgcactacagcctgggtgacagagtgagactccatctcaaaaaaaaaaaaagaaaaattaataagcacatttagaaagacgctggataggtttaatatacaaaactcaattgcatgattacattttaagcacatctctgtaaggaggctttgagaataattgagttgtggatgcaaactttttcacatttaaaactttgcctgaagtgcatcttctggctgtaaaaggaacctttaaaaataaagcatctgggggacatcagattaagatggaggataggaggcaggactggcttgcagctcctgctcagacagagagagcaatatgtgaatactcacatcatgaacttttgctccaagaactagtgcaggaacatactaggaaagtcgagagagttcacagaccctctgaaggaactggatcactgctgcaggctccctgagacaccaaaaatctgtgtctttttgcattatcaacaaggaggctcatggtctgaggcaagtcctcagccctggtcaccagctgcctggaaatagactcggtgctgttggaggggtatgatgggagtgagacaggcctttaggactgcaggctgtgtgggagtggggtgaggcttgtgactgccagcttttcctcacttccctggaaacctatatggcttagcagaagcagccataatctccctgggaatgtaactccattgaactgggaaccacacccctatcccacacagcacattcatcaagccctgccgaaggaggggctgagctcagacatgcctatccctacctccacctggtagtctttctctacctgccctggtagccaaagacaaagctcatgatctcttggccctgcccaccacctgagaaacctgaatacttaaccagatgcccctaggggaagtttgcatcctccctgtagaaccacagctgatgtactcttgaaaacaccacctcctggctagaggccaatcaatacaaaaccagcatactaaacaaaaacacaaccaaggatcctcacagtgtccacttcactcccctgctacctccagtggagcagatgctggtatcaacagctgcaagagctgaaaatggatcatatcacaggacactttgctgacactccccagtaccaacccagagcctggcagctccactgggtgggtagacgcagaataacaaaaacaatcactatagtttggctctcaggaagcccctctcctaggggaagtaggagagcaccacatcaagggagcactccgtgggacaaaagatctgaacagcagcctttgaatcccagatcttccctctgacatagtccacccaaatgagaaggaactggaaaaacaagtgtggtaatatgacaaaacaagtttctttaacacccccaaaagatcataagcagttcacctgtaatggatccaaatcaagaaaaaaatctctgaattgccagaaaaagaattcagaaggttaattgtgaagagaaaggtgaagtctaacttaaatcaaaaatgtgatacaggatataaaatgaaaaatctttagtgaaacaaaaagcataaataaaaaacaattacagcttctggaaatcaagaacacactcagaggaatgcaaaatacactggaaactctcagcaatagaatcaaacaagcagaagaaagaacttcagagctcgaagacaggctttccgagttaacccaatccatcaaagacaaagaaaaaagatttttaagaaatgaacaaagcttccaagaagttcaggactatgttaaaagtccaaacctaagaataattggtgtttccacagaaaaagagaaatctacaagtttggaaaacatttttgagggaataattgaggaaaccttccccagccttgctagagagccacacatccaaatataagaagcttcaataaacctgggaaattcattgtaaaatgattatcccctaggcacatagtcatcaggttatctgaagtctagacaaaggaaagaatcttaagagttgtgacgtaaagcatcaggtaacctataaaggaaaatctgtcatattaacagcagatttctcagcagagatcctacaagctagaagagattggagtcctatttttgacctccttaaaaaaaacaattataagccaagaattgtgtattcagcaaagctaggcttcacaaatgaaagaaagatacagtctcttccagacaaacaaatgctgacagaatttgccactaccaagacagcactacaaagactgttagaggagctctaaatcttgagataaatcttctaaataaaccaaaatagaacctacttaaagcacaaatctcacaggacctatataacaacacaatgaaaacaaaaaccaaggtattcagtcaacaaatactatgatgaatagaatagtatcacacatctcaatagtaacattgaatgtaaatggcctaaatgttctacttaaaagatacagaatggctgaatagatgaaaatttactaagtttttgctattttcaggagactgataacaaataaggactcatataaacttaaaggggtggaaaaagatattccatgcaaatggacaccaaaagtgactaggagtagctattcttatatcagacaaaacaaactttaaagcaatagcggttaaaaaagacaaagagagacattatatgatgataaaaggactaatccaacaggaaaatatcacaattgtgaatatatgtgcacctaacactagaactcccaaatttataaaacaattacttctagacctaagaaaggagagagacagcaacatattagtaggggtctttaatactccactgacagcattagatgagtcatcaagacggaaactcagcaaagaaacaatggacttaaactataccctacaacaaatggtcttaatagatacttgcagaactttctacctaacaactgcagaatacacattttattcatcagcacatggaacattctcctggatagaccatatgacaggccacagaacaagtctcagtacatttaaaaccattgaaattgtgtcaagtactctctcagaacccagtggaataaaataaaaagaaaggaaccctcaaaaccgtgcaaatacgtggaaatgaaataacctgctcctgaatgatcattgggtcaacaatgaaatcaagatgggaattaaaaaattctttgaactgaacagtaatagtgacacaacctatcaaaacctctgggatacagcaaaagtggtgctaagaggaaagttcatatcattaaatgccaacatcaagagtctgaaagagcactcagacaatctaaggtcacacctcatggaactggagaaacaagagcaatccaaacccaagcccagcagaagaaaatacataacaaagatcagagcagaactaaatgaaactgaaacaaacaaacaaaaaatacaaaagataaatgaaacaaaaagtttgttctttgaaaaggtaaaattgattaactgttagtgagattaaccaagaaaagagagaagatccaaataggctcagttagaaacgaaacgtgagatattataactgataccacagaaatacaagatattcaaggctacaatgaacacctttatgcacataaactagaaaacctaaaggagatggataaattcctggaaatatacaaccctcctagattgaaccaggaagatatagaatctctgaacagaccaataacaagcagcaagattaaaatggtaataaaaaagttgccaacaacaaaaatgtccagaccagagaaattaatagctgaattctatcagacatccaaagaagaattgaaaccaatcctattgacactattccaaaagatggagaaagagggaatcctccctaaatcattctatgaagccagtatcactctagtaccaaaaccaggacaggacatatcaaaaaaagaaaactacagaccaatactcctgatgaatatagatgcaaaaatcgtcaacaaaataatagggaataaaatctaacagcatatcaaaaagataatccaccaagatcaagtgggtttcataccaggaatgcagggatggtttaacatacttaagtcaataaatatgatacgccacataaacagaattgaaaacaaaagtcacatgattatctcaatagacacagaaaaagcattcgatgaaatctaggatcattttatgattaaaatcctcagcaaaattgttatagaagggacatatgttaaggtaataaatccatctaggacaaacccacagccaacattatactaaatggggaaaagttgaaagcatttcccctgagaactggaacaagtcaagaatgctcaccctcactacttctattcaatatagtactgaaagtcctagccagagaaatcagacaagagaaggaactaaggggcatccgaattggtaaagaggaattcaaactgttactatttgctgatgatgtgattgtatacctagaaaaccctaaagactcatccaaaaagcttctagaactggtaaatgaattcggtgaagtttcaggatataaaatcaatgtacacaaattggtagctctgctatacaccagcaatgagcaagctgagaatcaaatcaagaactcaacccctttcacagtagctgcaaaaaaaaattaaataaattgttaagaatatacctaaccaagaaggtgaaagacctctgcaagaaaaactacaaaaccctgctgaaagaaaccttagatgacaccaacaaatggaaacacatctcatgctcatagatggatagaatcaatattgtgaaaaggaccatactgccaaaagcaatctacaaattcgatacaattcctatcaaaatgctaccatcattcatcacataactagaaaaaaccattgtaagactcatatggaaccaaaaaagagacctcatagccaaagcaagacaaagcaagaagaacaaatatggaggcatcacattacccaaattcaaactatactataagccatagtcaccaaaatagcatagtactggtataaaaattggcactagaccaatggaacagaatagagaacccagaaataaacccaaatacttagagccaactgatcttcaacaaagcaaacaaaaacataaagtgagggaaatcatcccattcaacaaatggtactgggataattggcaagccacatgtagaagaatgaaactgggtccttatctctcaccctatatgagaatgaactgaagatggatcaaagacttaaatctaagacctgaaaccataaagattctagaagataacattggaaaagcccttctagacattagcctaggcaaagatttcatgaccaagaatccaaaggcaaatgcaatgaaaacaaagataaatagatgggacttaattaaactaaaaagcatcggcacagcaaaagaaataaacagcagagttaacagaccatcaacagaatgggagaaaatctttacaatcaatacatccgacaaaggactaatatccagagtttacaggaactcgaacaattcagcaaggaaaaaaatttctatcaaaaaatgggctaaggacataaatatacaattctcaaaggaagatataaaaatggcaaaaataaaaaaggccaacaagcatatggaaagatgcccaacatcactaactgtcagagaaatgcaaatcaaaaccataatgcaataccatctcactgctgcaagaatggccataataaaaatatcaaaaaataatagatgttggtggggatgcagtgaaaagggaacatttttacactgttggtgggaatgtaaactagtacaaccactatggaaaacagtgtgaagactccttaaagaactaaaagtagatctactgttgatccagcaatcccactactaagtgtctattcagaagaaaagaagtcactataccaaaaagatacttgtacacgcgtttatagcagcacaatttgcaattgcaaaaatatagaatcagtccaaatgcccaacaatcatgagtggataaagaaaatgtagtgtgtgtgtatatgtgtgtgtgtatatatatatatatatatacacacacacacacacatatatatgtatatatatatacacctatatatattttatgactgagtagtatttcattgtgtgtattcgatatattttatgactgagttgtattccattgtgtgtattttataaaatggaatactactcagtcataatatatacattttctttatccactcgtgattgattggcatttatacatatatgtatatatacacacatatatacacatatacatatatatgtatatatacacatatatatgtatatatacacacacatatagatatacacatgtgtatatgtctgtgtatatatacgtgtatgtatatacacatacatatacacgtatatatacatatatacacagacatatacacatgtgtatatgtatatgtgtgtgtatatacatatatgtatatgtgtatatatacacacacacacaatggaatgctactcagtcataaaaaggaacaaaataatggcatttgcaacaacctggttggaattggagactattactctaagtgaagtaactcaggaatggaaaaccaaacattgtatgttctcagtcatatgtgggagctaacctatgaggacacaaagccataagaatcatacactgaactttggggactcgggaaaggttgggggtgtcaagggataaaatactacacattgggtacagtgtacgctgcttgggtgatgggtgcaccaaaatctcagaaatcacgaaagaacttattcatgtaaccaaacaccacttgttcccaaaaacctattgacataaaaagattaaaaattgaaaaaaaaaaaaaaaccaaaaccacctcaattccgtttttacatactgtcaataaagataaatataattcaataaaaaagaatttgcgatattaacagtagtataagggctgtaggcataaactagattgtggttgatatttatgccatttatggaaaaaaattaaagattaaacaaatggagatatttaccatgtttatagataggataaccagatataaagtatcaaattctctctcaatttgtctacacgtttaatgtgattacaattaaaatctcaacaaattgtttttattcactcaagaaagttgtaaaacttttctgcaaaacaaagcaaaaatagctaaaatcttaagaaaaagaacaaggtagaagtacttactttaccagataagtaacttatttttaagctaatgattaagacagagtcatgttgaggaaagcaaaagaattattatcacaaaattcaggatagtagttaactttggaggagagggaaaaagagaatatttgggaaagtcgacagtattggaaatcttttttgaactgagtagaaaatacatgagtgatttttattattgccatgcatatgtgacctacatcattacatataagtcatttaatcataaaacagtttcaatgtcatgttaaaaatcattttaattctaaaatatgttttattcttttaatatgtaccatcagacttccgtaatcccataattgggagatattataagtaatggtttcctaatcctgactgataatcagagaactgaaagagttttaaaaatatagattttatgactccctaacggtctgttaaatcagaatcttgctaaatcatatcttgggtcagggaatatggtgaaagaaaaaatgattggtagtgtagtactctgttttaaaaatcaaacatccactcctctcccatttgttattgtttctgtttaattctcctggtgagtctaatgatcaactagttaagagaaccactgattttctagtttctcttgtcccccaatgtaagatttttctttctgtgctatcctaaaagacaatttgtctcagcttatgtatttctataggcgacaagctcattaagcaattcttcaactaatatcaggttcttattgttcaaaagtgttaatggtaaagaaaaatgagcgagatactttttgtataactcttagcatcccgcctcatacctgccacacagtaaaggctctataaatattggctattttcatgtttattataaccatagtaatcgatgatgggtcaaatcctagctctctgttatttccaccatttagccccagttctgctgtctggagcaacagaaaacaggccccttttttctaccatgggacttgatgtttaaaagcattgtcctgtcatcttttaagcttctctactttttgcagaatttatgaagttcttataagtgttcgaagtataaattgaaaggcaaacacctcacttttcacagcacacatctcagagtttattgtaggacacaacagtagtgtgtctacaaaactggttacctgtgagttaataaggaagtaatccagtcagctgaaattacagctgggcttctgagattttaggactgccatgggattacattcagcacatctaagcacacatttctctagctgaactaataagttgttactttgaagagattagggtataatttagttttaatcaaggatttcctctctttaaaaataatataatgaaatcagtaattttatagtattaatgcataagagattgtggatttgtagtaaatatttaatcctataaagaaattgttattcctgatgttatgcacatcacaaaaactcagaaattaccttcctaaaaatatttatagatgattatttttgtttttctttttgtcctgtaacagtttctctcccttctctttgcactagtcacttacaacccattatcgcctgcttaactgatcttcttaaggttcctatccctcatcctccaatcaagtcaagtgataatttataaaaataaaagttttgataacagaaaaggtttggagattttttcccattggaattattctgaaatcagctccaccttcttgaagtagttcagggagacttagcatttcttaaagaaaatggttgacaaccggaatattaattgttttgttttgacttttaaatggctaatggttattacagaatgaaccattaatcaatgcacatactatataaggattctatcaccttgcttctgcttccttagacaaaacagatcatcctcacagctgggcagtaaactaggatcaggtgaaggaaatatctgaaggatatagctctatctaaaccagacagtaaattgtattaaagatatttgtggcactagtcagcaagtacattgtgaaaatgggagcctcatcgcacttctaatagatatactaagagtgaatgtaaagagtcaactcagtgtggtcaagcaatcttagtctagaaaattatagcgaagtgaaactgtacgtcaacagctcttggcttatgaaattgctctggcaagaacacaattcatgaatgtcagatgtctataactttggcttgtgtttagatcgccaaaagaaagcactgtgctgaggttgttaaaatataacccattcctaatggaagataaaacccaaggtaccctaagtagcaaaaataccgtgggccctaaataaaagtttggatctcacagtagcagagaggaagcatcctcatgcaatgcattgtaccaaggtaaggtagcagtggcactttattgatgatgatgatgatgatgatggtgatgatgatgatgatgatgataattacaaggatttgaatgttggttgttccgaacaaaactcatgttgaaatttgattcctgatgtggcagtgttgggaggtgggatccggtgaggggtgtttgccatcataaatagattaatgctctccctcaaggtgagggagttcttgctttcctgagaatggattagtttcagaaaaaagctggttgttaaaaatattataattttcttattttctttctctcatgtcctcagttgtcatgtgatctctttgcactcctttttcatgttctgccatgagcaggaggagcatgaggccctcaccacacatagctgcccaatgttgaacttaggggagggagaggaggagaagaaactgtgaaagtagaaataagcctactggcattttacaattaagtttttgagggaatggaataattcatctacgttaattatccagataactgaagtacccattaaagatacatataatggggataatttggagataattttgattagatatttttctaaaaatttgtacatctctgacttcttaaacaatattcagaacacaatatatgtcttttcttaaaatgactcaatgcctgtcatgaatatcattcactactgtagtgatcaagagaagcactctgaaaccagactggttgggttcaaatgtaagctttatatgtgtcagttgtgtgattttggaacaaaatacttaacatctctgtgttttagtatgctaatgtagaaaataagcataatagtagttccatttcataagatttattgtatggctttgtctcaggctatttttagtataaaagaatacttaaactggaaaattattttaaagaaagaggtttaattggcttacaattctgaaagctgtacaagaagcatggcaccaacacttgctcagcttctggtgagggctttgggaagtttacaatcacagtagaaggtgatggggagccagcatgacacatggtgagagcaggaaaaagatagaaagaggaaagaggtgccacatactcttaaacaaccagctcacatgaactcagagcaagaactcacttatcaccaaggggatggtgcattcatgagggatgacccccgccctgtgatactaacacctcccacaaggccccacctccaacactggagattacgtttcaccatgagattttgaggggtccaatagccaaaccatagcatgattcagtgaattaatgtgcgtatgtagctataacagtacctgccaaataataagggctgcataaatgattattattgaacatgtcaaagttgtttactcatttattcattcccgtaggatttattgagcagctactatgtgctaggtgttattcaaggcatttggtaataaaggcccctgccctcacagagcctgaattctaagtagaaatgatagataataaaataaacctaagtacattatgtgtatgatgtgtgtatgatggtcataagaactatgaaaataagaactaaaccagaataaagggaattggaagtgctgaggcagggtaaattttggcagggaaggagcagtattaaatagaatggtaaggttatataagtctcattgaaaagatgagtttttaaaaatcttatgtatcacatacaataaatagccataaactatagtacttttgaggtaaaataactttttagttctctcacttatatattattttgcccccaatacatttatgcttatcccatttgtcaacacaggcaagccaaaatgacgcaagaacccttcctctgtgtgacgcaagtctccaaaagagaaacattaactcctttatgcaaagcaagtccatggctaacaaaccatgtcacctaaactttgactgccttgccctagactttatcatggctcagtgctcctgtcctgaaaggaagtctctcttgggtactacaaactagtcttttaggccctctgctcctcctcccactctactgtgaatgttcagctatatggagatttaagcacctgaggagggaggatttcagagtagaactggaagcacgatggggtaaatgtcttagaaacccaaagaagggaaaagggctcttgtatttgaagttctgtattaactttatttgatatttgcgaggagagtataagcaacttgcaaccacgattctatactccagttataaactaacccaaatggtctagggattcaggcatagagtgaagtgtatcctgaactgaccctttacattttagtgttttctttttggttttttgtttttttttgagacagggtctcactctgtcactcagggctggagtacagctgcacaatcacggctcactgcagactggaacacccaggctcagatgatcctccctcctcaatctcctgaatagctggactacaggcacaggccaccatctctagctaactttctgtgtttttttgtagagacaggattttgccatattgccaaggctggtcttgaactcctgggctcaaacagtcggcccaccctggcctcccaaagtgctgagattacaggtgtgagccaccacaccaggcctacattttatataaatgttttatgtgtacaaatatctagaaggttctacctcttaatatcggctaaacaacgattacacattttgattttaatgtcaacatgatccaacaaactagtgcaacttctttagaattgggatagtcaatttatctattaggttgaaataaataagataaaatgagataatacaggcaaaaagtatctggtagatgttaacatattttatttaaggtgtgtgtaagacactgtttcataactactgaatatttttgaatcaattttctctaactatattaactttgaacaaattatttaactgctgtgaaacacaatttcctcctctatatgttagaaataattcctacttgaaaagttattgtcagagttacaaagaatactcatgaagaatctcgtatgctacctgacatatagttgttgttccagaaatgaaataaatatttattatattatgcaaagaaaacttactatatataaaatatatatatatatagttaactgcattaatatatatatatatatatggtctaacaaaaccagtgttaatttttcttgtttgttatttagagttatttctatattagctctctaaatcagttactttgtcactaattagatgattaatgttcccatataacaagcatggtcataaatgaggattgtgtggcacaaaatatttatttttgtactgaaatgcaatgctatgtcaaaattacttcatgatgagagattcaagcatttattataaaaatctcttcctttttgaaccattggatatagttttatatattttggttatatgaaattcaattatttataattccatgcatttatgcgtcatcacatgtctctttatatgtttatatgtctctttaaggtcaagaataaacttattttatgttctctactttaagaactatgaatttctgatattttaccctacttaaaagctgactagttagtctgccacagttgcatggatgctggcagaaaataccataatcctgatacaaaggtcagagacaaaggattttgttattcatggcaaagcagacagcattggcttcttgtttgcaatggtttcccttgtcccagttcccacaggatgacttggaggtgggcctttgtggatgcaggacacgcggtggacttaagcaagtcaagccaaactttgcttcacggggagacattatatttattacactgatcagcaaacaaatctgtactctattccacaggagtagatgctacaaaaggcagtcagagcctctactagcaagacgtaaagaaatgcagggcattcatgaagaattgtctggcagcactctatagcacttagtaggctaggtatcatagtagaaactcagtgaatgctgaagtaaattaatttgaccagggaatcatttcaaaggagcactgaattgaagtcatcactgtaaattacgcagctatttatgtgaacttctatgctggcttccctttcaactgaagttctaagaaagatactgattttaaagaactcaaatatttctataaatgttatgtagaatgatgctaagggtccatggcaatcaaagatagagataaaggggaatgaaaattcaattagtgaagtgacaaattataggagttccttactgggatattagcaagagttatgattagttgtgtgctggtaaatgtttaatacttgtaggttttattcaagtaggaaaaaaaagtcctacttggtagcatttgccttttttcctagtatcaagttatcctactatgaccagtttcaagctatcaatgtgattatctctgaatgcggagttagggaaatatgtctacagttttctcttcatctagaaccgtgggctagctccagtgcaccactggttgtggtgtacaaagtggaagtaataacaccaaaagttcactccccaacaaagctccatcctttgtcccagtgttccccatcaatatgaacagtgtcaggtgcagtgctagtgggatttcatgggatatccatatttggcagatctaacattcattgcttagtctacagaagaatcaaaggaaatgagcttgtatgacaactctcaaccctgtgagcaggactgaggtcaggatgcagcgttatttttcaacccttccaatgctatcattattgatgccaaagtcttctcctccctcttacattgtccctgggttgtaaggtaagaaacaggagattccgttttgctggcttattcactcccacgacccatttattttatatggggtcctaattgtcagtagctcagatgctttagcttacacaaggaggctaagtgaccaagttatgaacactaacatattttgggaccagcacttgctgactggtacaacattgctacctttgttccattatcatagtgcttgaagtttacaaacaaacttgacatgttctctttacctcatttcccaaggtgaaataatcacaaaatggtaagtagctaagctttcatcatgccaaactgctgaggagagatccatgggagaggtgttatggacaaacaccaagcaggcatgcgcccaaaggaaaaattcaggtagatgtttgtatcatttttatgttactattttcagaaacatgcctgattttaagtgactctacttacattctactgttcagatgattcttatctaagtccagagaatcatatacagtcactggaaacagctcccacatcaatgtatattgaaaaatgactgttaaattatgtacacaataccgtgctccttgtgggatctgggaagaataaaaaaatatgtacacaataccgtgctccttgtgggatctgggaagaataaacaaagtcttcttttgcttctccagccagcacaaccaaatatcccaaatctacatagtttttctcccttcttctccctcaacctcaattagatctatgtctgtttgtttgttttaactactggatttaaaaagtgcttccagaatacagtactagtttgacagtcgctagcagagttgattacacattaaactaaacatagatggatatgtcctctttcagacagctaaaattaccttttggttgggtgtctgttttggaaagctcaatttcagttccagcaactgtacacctgaaaatgcaaggcatacccattaggaacaaacagtactttttctctatttaaaccctgatggccttgaggaggcaaactgccactatgctaagcacagtaagaacaacattttggattagagacataatgaatctatttgtttttcaatttttagagaatcataccggttagaataataacctttgcttcaaaccccgaggcagaaaagaaaacttggacaatcttctaatttctaattactcaagaccttcaaatgtgtgtctatatgcttgtttttgctttagtaagaagtgttttaaaagatgaatattccacaatgtttacatatattgaagcattaggttataccctataaatatatataattattatttgccactttaaaacttttaaaaatgaaaagaattctttcattcattaatttcattacttatttattaagtatttaatatgtgtaaaatcctatactaaatactagagaggaaaagtatattttatatagttcctattttggaagggtttttaatctagtgaaagtcaaacatgtgcagacagctttagcacaatttttaatgtgtattataaaaggaataaatgtagtgcaatggtagcatggtgaaatgggttctcaactaattgatagttacttaggaacatgcagttaagtcttgttaactttgtaagcttctaatcatttgcacaatcctgggaaattacccctctgggtacattcatgggttgcaggcaaattatttttacatggagaacatacatttattcttgaccttaaagacgcaagttgttgaagagatgtgtgatgatgtgtaagtgcatgtaagcataaagcactgaattgcatgtaaccaaaaatagataaagctatatcaagcagttcaaaaggggaaagatttcttattttgtagcagataggtagattggggaagacattttgcaacttgccaacctaacaggtagtattgctggaaactttcagaggtgagggaattttctctaatccaatggcaccagaagtttaccagccaaaggcattgagatcacatatccaaggaggcaaaggcacagacggagctaccaagggagagaaataacacattgcaaattgatggtcagagaaacttttaaaaattgacactacaaattattatatcttatccttgcctgtgtggatcaattggaatccctccaatacccattccctaattggcagttcattaaaacagtacctgatgtacagttgttgcttttttaaaaattatattttaattataccctaaaaattccataatttcttttaaaataatgagacaacaacggaataacaaacaaccagagcttggctctagttgtctgtgaataggctacttcctgatgagatacacagcccaggagttttctttattcttttctttcgctagtctttaaaatgagcaggacctgaaagggcattcttggtactgtctatcaaagctaaactactcggtgagatgtgtctttagtctgagctaaagtctgagttatgtttttcgttgcagtcagctttgaactgtgaaactatataagaggatgcaagaaacattgtctaataataagaggggtgggctgtgaaagtctgacaaccacttaatagtgttagtagtctctgctgtcaggtactgctaattttcattagtgatagaagagggattattaaacattttagggtttatatatgcagcatacttctaaaggatagtgtgattaaaaggaataaagcgtttcagctttaagaaatgtagtttctttgctgttggagatttgattctacttaatgactttaaagtaagctattaagaagttggtctttcattaattatgaatgatcatacttttaaaaactatgtgtaaatggctgctgagattttcctgagattactacaaaaattagcttcaaatcaaggaacattaatgcacacgatttcatatttactacagctttgaaccacagaagtgtgacttagatgtttaaaagctaacaccctaaattgagaccctaaatagcatgaattttaattaaagggattttttttcaaaaaaatagtggatgctattattatgagaaagttttggggctgcattttttgttttctgttctgtagcatgtaataatgtctgaggctaatttaggtacacagaacattatggagggagtaaggtttttggtataggtaattgcaagctctagaaaagtctgtattttctatttgacaaacaatgtgtaaagaaaatgagtcctagaaggtacatattgtaattgagttgttaaaagttaatccctgacactgacattgttcccaagcctaccattgagaaaaccttcaggagactgttgaaagctgcatttaggcttttttacttcctcaactcattataccaaaaacctaggaccatttggttatttgtttttctctgaaaaatatttttcattactggaaatacaatttgaaattccctctctcatcaggatagtgtatcattcatgtcgtctcccactctttgaaaactttaaaaaatggcattagctttaaaaaataatgtaaaggtgaataatgaggtagtcaccacttctgaaaccatgtttcaaaggaacaaaggtttgaaagaaagcctgcctaaagtgttaaggagcattattgagctttaataggtcaaatgcacaagaaaagagaaagtaatttagtagaatacaaagcctctccttgacagtgaggccatcttatctttaaaatattatggcagtttgaattgggacttttaccagagttcatgaagtggcatggagggattgagaaaaatagtggtgaaattacctcagtcaagactctcattaagaagcccattaaggaatccaggattatttcaacaatctttgagaccacttctctgtctcctttatttgtcctccaatccatcatgaaaagcactgccagactagtcttcttaaaacatcattttaatcatgtccgtttcatggctaaatacctacagaagatagatgcagccattttgtccaacataaattgaaactgggataagctggagatggggaaagtggttattagaaagtcaacaaaaagagttccaggcataacacaataaaattcacaacaaatgtacatggtgatccaaatataaagatgcaaatgagagaggatgtgaggatgagagacagtgagtgtgtacatgaaggaaagtggacaagattggatatctcttggatactagaggcaaaggaggggtaaaggacaggactgcagcgaaagcctggagccccgattatgtctagcttgctgccaataatctgggtatcttgcacaagcatttattttcttcgcagctcattttccacatccttaaaatacaaaaatattggaatatagcattttttaggttgcttcaattctataactcagattagctgttatttagtattttaaacctctttgtgaaattgatggtaatacacaaaacagagacgaggaaacagctaaaaaatgtcagggaaaataattggttctggaatggatatattgtcttgaaattgctggcatgtttgtgaaactatgtgaaaacttttaaaaaatcgtttattgacagccagtgtgttccaggcactcagcagaacagacatactccttccctacttcaatggagtcacttcctatacaaatttactagagagaaagcaagagagggcaaatatgacacagagagaaataaaggaaaacatttaaaaatgatgggcaattcaacatgccacttagttcagtattttattaatacatgcccagagtgagcgagatgaaagacattaatattctatgccctatttaagtttcatttttcccttgcctcacaagcgtgaacattgttgttccgctgagggtaattttatatatttttcatgcaaccatgatctctgaacttaagccagttacatcatcttatgttcaaccaagggatgagtgatcatgacaacacaagaactatagccatactggtcttactgtgagatggcatgttggtttctaatgtggttccctccaaagagatcatcaggttactttagagtactatgtgttgtttccaataaagaaaatcattctgctttacagcaacagttaaggtatctaggagttaatggagagaagatgtgagagtctggaacaattagtactgaggaggagctttattctttgaagtttatttccattttgagatggggcttagaaagatatttgagaggatcaaagtagtgtttttcagatattagggttcatagaaaaatgaacttggtggagtcatctgtgagactcttgtctgatgtgaaattaaataactgggactaggattgtggataagggcaaggcaaggaagtagctcaaccaggatgtggcatcatcagagctaaggtgccaaccaaggatcagtagaggaaagaaagtctggaacaaagcgtagtcagaagaggaaattaacagagccaaaaatacaatagggggtatgatcagaactttgtcgacctgcccttctattcttttaactctctatgcagataggtacctacaagttcatgtctgccagaggctctttcattaatctgttccttagtttggatgattgtaaataccacagggcagcaggtgggccagcacacattcaatcaactttaattttgtttctgtctacacaagtctctgatcaaataattgctaccagtaatacataatctacttatctgtattatctccatcagtgctcccaaagatgctttaaggcaagtaatttttttcattttccgcagtagatagattcatagaggataaaaaatacttactggcctaggaaatttcaggctcttatcttcttccctatgacttaagttcttgctgactaaccctctttagtgtgaggtctctgacttctgccaggtccgtaggcttccatcttgctctttccaggcatcatttctgggacaaaaatctaaattttaaaacagaaccatggactacttaatgtcacatccctctaatgtcaagacctattcacctgaacctcaacttttcattcatccttgctacatgccagaactagttctaggaaagtagagatgagtaatatcattttattgatttttaaaaaatttgtattatagtggagacattccctgtgaacaaacaaaatgcagttttataggggatatgacagaagacttaaaacaattgttctcagacatttttctgctccagttcaaccaaaaagtaggacatcctcctgtcagtaacaagtgtttacctttcaacccacacatgtgctggcaacacatttgagggaaaacagacataattttctcctcctctttctcccctcattccccatctgtttccactgagaaatcctgaagttaagggttacagagatagggaagagggttacctggggatagggaggagatacttatggatcagtgagtgtgatattactgtcttacttgaatggtaagtaggtgttagcatttgctactcagtgaggaggccagtaccagtagagggaatggtggagtaaaaacagagaagtgtggaatagtatgatgcctcccaaaaacctacaaggagttcaggatggctggaacaatgaagctcaaagacagaagttgaaagagatgagctatgagggggcaattaagcctcactgggatgtaaaggggtttgttctatatcctgtaagcaatcagggatactgaatataaaaatgacatgcttagattttgtgttatggaaaaatcactctgttggcaatccaaaaaatgggctggagaaaagctgggccattaggtcagaatgcaagaagtggaatagggcactattgatgaggagcttcaggagggggacagatggcaaaacatcctattgtaacaattctacaacatacatttttaatacattataaaaaatagaaatgcatcttaatgggacgtaaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaatttgaaaaaactactttaaagttcatatggaaccaaaaaagagaccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaactatctgatctttgacaaacctgacaaaaacaagcaatggggaaaggattccctatttaataaatggtgctgggaaaactggccagccatatgtagaaagctgaaactggatccctttcttacaccttctacaaaaattaattcaagatggattaaagacttaaatgttagacctaaaaccataaaaaccctagaagcaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgtcaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacagtgagataccaactcacaccagttagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttactgcggcactattcacaatagcaaagacttggaaccaacccaaatgtctaacaatgatagactggattaagaaaatgtggcacatatacaccatggaatactatgcagccataaaaaatgatgagttcatgtcctttgtagggacatggatgaaattggaaatcatcattctcagtaaactatggcaaggacaaggaaccaaacagcgcatgttctcactcatagatgggaattgaacaatgagaacacatggacacaggaaggggaacatcacactctggggactgttgtggggtagggggaggggggagggatagcattaggagatacacctaatgctaaatgacgagttaatgggtgcagcacaccagcatggcacatgtatacatatgtaactaacctgcacattgtgtacatgtaccctaaaacttaaagtataataataataaaaataaaaaaaattaaaaaaatgcatcttaataactgatggtttattaaaaatattggtagccaagcaaatgttgtgagtttcattgcctgcacacttgtaaatgtagttaaaagtacactgggaaagaatcactttttgactgttttagtggtggcattgctaaacaactgcaatgtcttattgtttcattaaaaaaataaggataattaggggaagggtaggaggcttgtttgcctgttttggtgcttttggtaagattgagaacctatcaacatcaaaacctgtagcatagtggtttgctacttgggatgaaaaagacaataatggtgtattattttatgtaatactaaaccacagatgctcttgctggcttagaggacaatattttggaaaacgtcccacacgttgacaattctgatgaagtctaattccaaagatttagactctgaatcagaagtttaagaaataagttaacaatttattttgtgtatattttcccttcatgtattgacaaaaatggtagataaataacaaaagtctatgtcatacatagatttttcgtgtcagtttatgagggacctaaatttaaattctaattgctaagaaggcatagtgtcataatttaattatttttttcacaatgttgtataaaataatgaagagagatggtgttatagctctgatgaaatatgaaatcaaaaaatcgttaggataaattgtatgtggaaagtgaatcaccaattgtacaaacataaatattcattcagtgttgacaataattgaaaagagaagggaggataacacactctgaatggctaatatttagcaggtggaaattatatggagtctataatagtcatcaggaaaattatattatatatataaaatacataacgttaggcaaaaatgcaaataggttttcataggttatcatcaaataactaactaaataaaaagagttgtttgtaaaagtctaacagaataaagttgtattaaagaagagggatttagaatgattggttatcttataccttgctttaatgttccataatgctaaaaaaaataagattaatcacatagccctatcgaacaattgttttggcaacacagaaataaacagaaacactgcattttctcagacccacagtcttcaattaattcaagaactccttcagatacagagtatacaaattttctgatttgtaatagaaaatagccagtctgtgaatattagctaaataactatcaactgtcctcttgtggaatggcaaactgttgtcccaaaatcagaaagatttttatttgaaaaatttgcttgatagttttttgggaatttttgttttattttaaattttaaatttttgtgagtacatagtaggtatagatattcacaagatacatgacatattttgatacaggcatacaatgcataataatcacatcagggtaaatgggatatccatcaactcaagaatgtatgctttctttgtgttacaaacaattcgatcatactatattagttatttttaaatgtacaataaattattgttgactgtagtaatatgaaatacaagattttatccattctatccattatatttttgtacccattaaccattcccccaaccctcctccacccacccctacccttcccagcctctgataaccatcattctattccctgtctccatgagtacaattgttttgatttttagctcctaccagtaagtgagcgtatgcagtttgtctttctgtgcctggtttatttcacataaaagaatgacctccagttccatctatgttgttgcaaatgacaagatctcatttgtttttatggctgaatagtacttcattgtgtataggtacacattttctttattcatctgatgatggacatttaggttgctcctaagtcttggctattgtgaacagtgctgcaataaacatgagagagcaggtatctcttcagtatactgatttcctttcctttgggtatatacctagcagtgagattgctgggtcatatggtagttctattttcagtttttgaggaacctccaaactgatctccatagtgcttgtgctaatttacaatcccaccatcagtgaacaaggattcccttctctctatatccttgccagcattcattttgcctggtatttggataaaagccattttttactgggttgaggtgatatcacattgtaattttgatttgcatttctctgataaacagtgatgtttgagcacattttcatataccttcttgccatttgtatgtcttcattgagaaatgtctattcagatattttgcccatttttaatcagattattagatttttttctatagagttgtttgggctccctatgtgtattctggttattaatctcttgtcgcatggatagattgcaaatattttctcccattatgtgggttgtctcttcacgttgttgattgtttcctttgctgtgcagaagcttttaaagttgatgtgatcccatttgtccatttttgctttggttgcctgtacttatgggatattactcaagaaatctttgcccagaccaatgtccttgagagtttcccacattttcttctagtagttttatagcttctggtcttagatttaagtctttaatccatttttatttgattttcgtatacggtgagggataggagtctagttttattcttctgtttatggatatctagtttttctagcaccatttattgaagaggactatcatttcccaatgtgttttttggcacatttgttgaaaatgaattcactgttgatatatggatttgtttctgggttctctattctgtttcattggtctgtgtgtctgtttttaggccagtgccatgctattttggttactgtagctctgtagaataattggaagtcagataaggtgattctttaagttttgtgtttttttgttgtttgtatgttttgtttttgtttttgtttttgtttttgctcaggatagctttgcttatcctgagtcttttgcaattccatttaaattttaggattttttattctttttctgtgaagaagggcattagtattttgatagggattgtattaaatctgtagattgctttgggtaggtagtatgggcattttaacaatattagttcctccagtctatgaacatggaatatttttctgttttttggtgttctcttcaatttcttgcatcaatgttttgtagttttcattataaagatctttcacttatttgattaagttaatttgtagggttttattttatttgtaactattgtaaatgaggttactttcttgattttgttttcatattgtttgctgatggcatataaaaatgctactgatttttgtatgttgattttgtatcctgcaactttactaaatttgttgatcaattctaacagttttttggtggaggctttcggtttttccaaatataagatcatatcatgtgcaaacgaagataatttgacttcttcctttccagtttagttgcactttatatcttttgtctgattactccagctaggacttccagtactacgttgaataaccgtggtgacagtgggcatccttgtggtgttactgatcttaaaggaaaggttttcagtttttccccattcagtatgttactagctgtgtgtctgttgtatttttggcacttttaatgtgttaaggtatgttctttctgggaatttgaaggcttttatagtgaaggaatattgaatgtcatcaaatgctttttcgatatcagttgaaatggtcatatggtttttgtcctttattctgttgatgtgatgtatcacactgactgatttgggtatgatgaaccatccttgtgttcctgagataaatcatcttcggttatgatcaatgatcttttcaatatgttgttgaattcggtttgctagtattttgttaaggatatttgcatcaaattagtgttcatcagggatattggcctgtggctttcttactttctttttttgttcatgtgtctttggctttggtatcagggtaatactggtgttatagaatgagtctagaagtattcacttctcctacattatttctcagagtagttagaataagattggtattagttctttttaaaatgttttccaaaatttaacaatgaagtcatcaggtcccaggcttttctatgctcagaggcactttattgcagcttcaatctcactacttgttattggtctgttcaggtcttgaatctcttcctggtttaatttttgtaggttttatgtgtttagtaatttattaatttcttctaggttttccaatttattggcatatagttgctcatagtagcctccaatgatcctttgaatatctgtagtattgtttgcaatatttcccttttcacctctggttttacttgtgtcttctttttttttttttcttatttagcttggctaaaggttgtaagttttgtttatcttttcaatagctttttttcattgatcttttgtattatttgttgaagattagatggttgtagatgtgcagtcttatttctgagttctctgtctttttttttttaactagtaccatgctgttttagttactatagccttgtagtatagttggaagctggttagcatgatgcctccagctttgttcttttcgcttaggatagtcttggctatttgggctcttttttggttccatataaactttaaaatagcttttgctaattctgtgaagaatgtcaaagatagtttaatgaaaatcgaattgaatatataaattactttgggcagtatgcccattttcacaatattcattctttctatccatgagcatggaatgttgttccatttgtttgtgtcctctctgatttccttgagtggtggtttgtagttctccttgaagaggcccttcactccttgttagctgtattcctgggtattttattctcttcgtagcaaatgtgaatgagagttcactcatgaattggttctctgcttgtctgtcattggtgtaaaggaatgcttgtgatttttgcacgctgattttgcatcctgagaatttgctgaagttgcttatcagcttaagaagcttttgggctgacaagatgggttttttagatacaggattatgtcatctgccaacaaaggcagtttgacttcttgtcttcccatttgaatacctttatttctttctcttgcctgattgccctggccagaacttccaatactatgttgaataggagtggtaagagagggcatccttgtcttgtgccagttttcaaagcaaatgcttccagcttttgcccattcagtataattttggctgtgggtttgtcataaatggctcttattattttgaggtatgttccttcaatacctagtttattgagagtttttaacatgaagagatgttgaatttgattgaaggcctttttgcatctgttgagataagcacatggtttttgtttttagttctgtttatttggtaaattacatttattgatttgtgtatgttaaaccaactttgcatttcaggatgaagccaagttgattgtcatgggtaagctttttgtgtgctgctggattcagtgccagcattttattgaggatttttgcatcaacgctcatcagagatattgacctgaagttttcattttttgtcatttctcttctaggttctggtatcaggatgagagtggcctcataaaatgagttagggatgagtccatccttttcaattgcctggagtagtttcagaagaaatggtaccacctcttttctgtacctctggtagaattcagctgtaaatccatctgatcctgggcttttattgatttgtagtgtcacagggtccttggagtgtcaatttgctagctggaaacctctgttgccaccaggaccttctgcttgagtattgcttatgaccacttaccttgttccatccacttgccccagccaactgtgcttggcttacgccactggcccagatcctacaccagccaaggacaagccaggtgcagagtggcaaggggtgtgttggagagcaagcctggggtccagccacggtgtaaaaccaagctgaggctggccgctgaggcagggcaggcagctccaggcaccagcacacatgttggctctgtgagaaggtgcagctggaccagatgtactccatgtggcttgcgctgtaggcacctgtgtctggacagagggatcatggtggtgcctggaagcttggagacatcagaaactgcagaactccttaaagtgtgtcagacccctggctcagggagtccccaggtctgggatcctggagggcagcagctcttctccttctcattacccacagcgtggcaagcagggaagggtagggggcatgtttcagccctgtttatgttacaactcttttagtctcaccattcagtgggtcctgagtccttatactttgtccaggaagaatgaggcacgcaaacagctggagggtgagcagagaagagcttcgtggaatggcagaattgttttcaggagacccaaagtgggtagctcctttcctcaggcagatcgttcttatttctgtttaagtctggctgagttcaggtttttatgggctcagaagggaggaagtgtgtgctgatcggtccatggatggccacgggcgggcctggaaaaagcaccataagttctcactcctggctgtggactccacccagaactggcagcccagtccccaggcttcaagccatccctcgcttgaaggtggggtttcaccacagacccaaccctttccaccatggagcctgcctgctgccatcaacgtaccattcatggcacccaggctgcttgtgccaaggggcacctgccagcccatgctgagccacctgcagcaccccctccctcccttcctgagctctttggtgcctaaatcttcagagggagaccgagggggcaggggggtagtgtgtcaggacttccctgagtgcacacacaccagccaagtcatgacagcattccaggcttggcttcagccttgttccaaaagtggccccagggagtgagatcaggcacttccaaacctgtggggacaagggggcttcccgggcccccaagagctcagggatgcccatgtccagcaccacagcttaggtgagtacagctgtgtccagactaccactggtaatgtgctgggtcagtcttgaagccggtatagtactgggtcttgcccaaggcctgtcaaccactgactggctaccacctatgttcacttaaggccctgacgctccacaataagcaggtggtaaggccagccaggcttgtgtccttcccttcaggatagtgagttcgctctcattgctggtgggtccagagatgccatccaggagctggagtctgaagtcagaaactttaggaatctacctggtgctctattctcctgcagctgagctggtacctcaaccgtgctacaaagtcctactcactttccatctcctttccatataagaagacgtgtctctccccatagtcaccactgccctaggcccatagtgagtactgcctggctacagtcagcgttcattcaaggcccaagacctctttcgtcagcttgtggtgaatactgccaagcctggagttcttttttcaaagcaatgtgctcccatctggcccagggaaggtccagaaatgctgtccaaaagccaaggcatggaatcagggaccccaagaactctgggtgctgtaccccactgtggccaagctggtacctaagctgcaagacaaaatctccttcacccttttctctccgtttctcaagcagaatgggtctctccccattgccatcacagctgggaatgtgcttggttacaccaaagccagcatgtctctgagtctcacccaaggcccatggcgagtactacctggctacggctcctgattattcagggacctagggtattttagtcagcaggtaatgaatcctgccaggactggattcttcccttcaaggcagcaggttcccttctggcctagggtgtgcctagaactgttgtctaagagccatggcctggaatgggagtctcagaactctgattccttattctgctatggctgtgctgggttccaagttgcaagacaaagtcctcttgctcttccctctcccctcctttcctcaagaaaagggaaagtgtctatcccagacctgtgagctgtgctgcctggggttggggaaatgggtggtacaaagtctccctgagccacctagatggtgtatctctagttcatttgcccaagtccactggctctaagcatagcacagcacgaggattttcagtccttgtacctagactgcctttcaagtttatttaggacccaacagcattgtagccttttagtggtgaggcttgtcagaactcaggatccaactgctgggatgggctagtccccacttgctagggctggtgtaaatgctccttctgtgggcactggctgagttctgcctgttgttgctttctgctgtgacaggacagcattgagttccaatgttccaacgcaaagtcctgcaattactgcattctctctccctcaagcactcagattctctttccatgccatgtggtcactgccaagggatcagtgaggggtggcatcagtaattatacggtgtcattccgattctctccagtgcctcttttagtgatatgaagttaaaaccaagtattataattgctcacctgatttttggttcttatgaaggtgttttttggtggatgcttgttcaatttggtgttcctgtggagaagatgattgctagaggcttctattcagccatgttgctccacttccttgaaagctgacagtctttttatttttaatcaccttaccatttgtttattattatttttaaatgattggaataattgtacgtatttatcatgtacagctttatattttgaagttcatttacattgtgaaatggcaaaatctagctgattaacatatgtgttacctcacatagttatatttatggggtgagtacacttaacatccactccattagcatttttccagaatacagtatattgttatgaactatattcaccctatttacaatagatctcttaaactcattcctcctgtgtaactaattttctgtatcttttgaccaatatctccctaacctccccttccctgccatccacctcttgtaactaccactctattccctagttctgagatcaacatttttaggttgcacatgtcatcaagatcatgtggtatttgtgtttctatggatggcttatttcacttaacataatgtccttcaggttcatccattgtcacaaattgtagggtttttttttaagactgactagtattctattgtgtatatatgccacattttctttatccattaatccactgatagacacttaggttgatttcataccctggctatattgtgaataatgtggcaataaatataggagtgaacatattttttcactgttggtaggagtaatgaattatatggtagttctgttttttacttatttgaggaatctacacctcattttccacaatggctgtattaatttacattcccaacaacaatgtgcaaaggtccctttttctccatagcatcaccaacacttgttatcttttattattttcatgataactcttgtatcacttgtgaggtgatatttcattgtggtttaattttgcatttcagtaataattagttgtattgtgtatttttttatatcctgcttgatagttttcacgtgatattttcatggtgtcttctcaaatttcttttgcaatctgtatatattcaatatgttatcagtcaattttgagtgaaaataataattaatctctacttaatcagtaaaatcaacttttattttctttatctaaatatgaagtgtcttaaaattacagaacatatgtaatttgtatactctattttgcatttattttataacaagacaattaactgaacctgagtcaaggcacatagcaatatactgtacatctcagattttattaaattcagtaaactcattttaatatcattatggaaagaactgagaaacaaaagaaaaccactgaaaatatttaaagtatgttggctaagagtgtatattttaaaggtctcgctacaaaaaataagtgaggtgacaagtatgttaattaacttgatttaatcagcccacattgcctacctatatcaaaacatcacattgtaccccataaatgtgtatagttatgatgttaattaaaatattaataaaaactttgtaatagagctgatattgaatttgagcatgcttgatttagactttaaaataatatccattttgtcattttatgcagccattgactttccaactacttccatcgatgtcttcagttttttatcctgtctgtaatgcctatagtctaataagtctttattcctaagaagaacacttgaatacttgggcaggggtcatttgaggaatactgaggctattttgtacaatgaaacagggttgtgatctgaagataatactttcctgaaatacattgaaaaaatatccaaatgatggcaacatccctggatcaactggtacatgtgtcttatttcttcttagcaaaatgcttattgattattaagaacattaagtctgaggtaaaatgatcctgcagtggaaatcaatctctgcaatatattagtttcattaaatacaaaataatattaattgtagacctcagttcatatgagttttagagatataggatatcccaatcagataagcagtggagcacggtaagtcataaactgtgggctcaaaccttggcactgccatttcagatcttaataatgaccttgggtatgattttgaaggattctgtcttcattttcttatttataaaatgagagaaataattgtacctatacctcataagatttaaaaaaataaaatgagttaacataagtaaagtgcttagaataataagcactctgtaaatgttgggtacaaatattagcattatatctgtcacctaataagcaccaaaaaaaattagttatccttagtgagttttctgtctacagtcaatgacatcttaaaacaatcaactatacctaaaagggctgaaatgaaacagcttcttttcttatcagaccttacctttagagttacttgtctgctatggtctgttctgataacttcatctgacttcttgttcatcaagtctagacagtttcttctggattttaactgtggtgcatgaacttaagatcttgcctagaaagtaaatgatttatttatatatgaatatttctactatttactagtttgtgttacttaatctctccaagatcgctcctggtaagaagcctcccaataaacattacaaaaatagtttgcatttatgtagaccttatctatatttatcaagtgcttctctattcatgaggtgaggtcagtaaggtagactgttttcgaagtcatggtttgtgataaaattttatattattacttgatggataggcttatcaaagtttcttgtagtaatgatgaaaatataaaagtataaggaaacataacctgagaaggctatgttttgaggctatctgtgaaggttgagaaagtgttttcattgtcttgcaattttccaaattataaaatgtaagttcagtgaaattcagtggtaaactcaaaagaggcagagatgaattttggatacatgtctgctcacttgggcttgttattctgcagtgctcatatttgtcctaggtccttggatatctctgctctgatgagataagcataggagtgaagtgtcaggcccaataatgcacatgcttataactgattcccaaatttgtgggtaaataagttcgattcaagattctgggtgtactttgaaaatttgaattaagtttcatggaaaggaaaccataaaagaaataatggttactgataaaagaaaattcacaactcatttatataacactttgcagtttataaatcagtttctcaaccatcatctgaattgaatgtgtttctttacatagctatgaaagttgcattatttagaagtcaaaacatttcaaaatacttgaaggtttatagttaacatgattaataggtactgtaatgggaaaatatttattcatgcatgttttagttcattattgatactgttcacagaggagagaaagtagaaactacttggaatgatagcctaatattggagcacatgaaactggaagaatccttctagatacccattcacttagcctttttccatgtatttgatgttttgaatgtggaagggtcaagtatgaattggcagggggtgggaaggaatatggaaagatgacaggagggaagcaagaagttactgatggagtagtgctgtgtattctgaaggtggggcttaagaaaaaaagtttatcattcttttcccttttctactccacagtctcttgacattcaaaagagtatgtcaccaatgattctttcttgtgatgtacattctcaaactttgactcactgtgactagcacagcccttaacctagagagtgttaattgtcattattctgggcaatgagggaaatcatattagctattttatcatagaattagtggagaaaggggtcttttaaatgtcacctttctccctgaacacattctcttcagttcttttcttctctcttttcttccatctttcttgacctctgcttcacacgtattctatttctttatgatcaaaattaagggggacatttagttgaagtgcacgactctgaaaataatttgctcatccttgacatctttcttacacatttgcaatggttttaatatttcacgctcactgcatttgatcctcacttccaaatatatgttatggcatcattactatgcatttattaattcattttatctttattactactttgttttcatttctattgacatgaattttatgacacatttagttacttgttagtagtaccatgttagtagtagtggataactgaagaagtgttggagttaggctcatgacgactaagaaaaatccattaagactaagtttccttatattaagctaagcagcaagaacatagaggccatctctctgctgacggaaaactggactataaaatgctattaatctgtcattagcctttgtagcctgttgcaatgacagagatgcctagctattaccgaggggcatgaactgtgttgttcatggtgaataagctgaccatgggcaagaggtcagcaaggggttttgtagttcaagtaagcataaggagaagctatcatcagtaatattagcatcttgttggttatattaaatgactggatttaatgcaataaaaagtcaaattcaatgtatcaaactcattccagagaaacaaatgttaatacctcttagaaaattattttaattgcaaaataatacatgcctatttaaaaactgaatattatcaagtttataacagggatttttctctttctctcacccattttcactccacagaggtaactacagttatcaatttcataattatttttctagatattttatgtgcgttcataaacatatatatataagtttagtacactcccatgtcagtatatatatatatatatatgggagtgtactaaacttactaatacgcaaacttgctttttttcactaaacatcttatgggtattttttatgtatgcgcacatatatttacctgtttcactttaattattcttcccattgattcatttaatcaatatgctattgatgaacatgtaaataacctagcttttattgctattatttaaagatgcaataaacatcgttctacaactacttattttaattctgtgcatttacctgtaggatgaattcagataaggggaacttgcggtataagggtaattaccaatatcttaaatatgtccatgactccttgagacattattctggagtttaatttgtgaagcagaagcacacaataactggtatttttataatgaaggtaatttatttagcaccatagccagaccaaacttgcaccaaaaatggtttgcttctgtttcctcctggaggtaagaagttccacagatcttacattttgattctttcctctgtgatactaacaggaaacagtgtgtccatccaggccatgtatatcttaaattttcaactatccaagaagatgagtcgtcagcaaatgtggtagctacagtcttttttcctcactcaacaaagtcctagaagcttgtatctttgcagctttgtgaatcgtttgaaaactatggtatccaggtcatctttttcacagactttataccatgaacagtggatgtttttcttacaagaagtcattttacccattgcaattattggttttattttgtctttcagggctggaggtggactttatggtattgacagcatgccggatcttcgcagaaaaaaaactttgcctattgtccgagatgtggtaagttacaactgtttaattctcttcgattgcatgtgtggtttttttccttactaaaatgtaatgtccttctcattcactgtctagcctgtaaatattccatggaataaaaatatatgaggccagatgctacctgctgttatatttattattatttctttaaaatctattagatggaggagataactcaaacctttgatagcttttgatataagtggaaattacaattaagtgactatgaccctaataattggagcaaaaagaaatcacacagcataccaagcaagtgaataggctttgatgtgtttagtgttatgaatgaccagaagtttaattcacaatgcttgaggctttatttaaacttcttcaccttaatacagtggacctgaatactttatacagcaagcagataacattaatcaactcttcattttattatattaaagtcaattctagctaaattaataagctcttctatttaaagaaaatcatggttcactttgggaggccgaggcgggcggatcatgaggtcaggagatcaagaccatcctggctaacatggtgaaacgctgtctctactaaaaatacaaaaaattaactggagtggttgtgggcacctgtagtcccagctactctggaggctgaggcaggagaatggcgtgaacccgggaggcggagcttgcgtgagccgagattgcgccactgcactccagcctgcgtgacagagcgagactccgtctcaaaaataaaaataaaaataataaaaaagaagagaaaaccatggttttcaagttattaacatcattattacttctgatcatgactctgaataaatctgtttcctatattgaaatatgctgcagccaccttgataaatgcaaaaaattgaccatggcctacattagattgtaaaaaaaaaaaaatcatcgtgaaaaagtgtctcttctatcatccaaaatatcttcacattttatgggcatatttttaatattatatgtgatatgaaaaatatattttcccccataaaaagtaaattttctttcagcaacaacgtacataactttttacatcagtaatttttaattttgctaagaaagccttcatctgaaggccaccactttggttttaaaatatgatcctgactgaaaagatcttatactggaaagtataacatgtcagtacatttagttcaaatttctgtcttcactatgtggaaataattgtaaagtgttaggctaatttaacattgttatactcttttcctacctttcatgtatctaattatttacattttgtttcctctcacttctggaatcttcaggccatggtaagtgctttgctatttatttaattaatattttgcagtcttctcaaacatacactgcacttactcatggggtaaaagagggcaagaatggagaaatgaaaagacagacatacaagaataagaagtttgttctgcaagaatttaacctctggttcaattctgaaagagaaaattatgtatgcaacaggtgcaaacacagaccaaaataggatacaagtatagttttagggaatatatttttcaaagatgaaacattttcttgggtaaactcttggaggtaagtcttcaaggtaaatgtggagatgagtggagagtgacattcttactcaggtgtatgctgaattttatttgagttaatgactttgtaatgctgaggagatatgtatatgaccagatgggtctcaggtgatcaagaatgcattattccacaatgacatccctttgctcctaatgggataacagttttactgttcccatatggaggttctgatttccaacgttctccatagcactgctgagtttcttgtatttcatatattttgggtaggagtagatagtggtggttatggttctattttatgtggtgaggaaactaaagggacttgactcttatttaagatcactcaagttaccagcatcgagtgaagaaaatgaatctggatataacaattctcggtaaattaaatgaacacttagaaaaaatatcttgaatagatatggaagaatattctagggaactatgaacaactcaggaaccatctaatactaattatgattcagggccatcaccaaagtcaggctggctctctaccaaaggttatgtattctgaatgaatatatcacaaccaccttgaggaataagaaagtttgagaagcctcttgctagcctgaggtggttgagggggctggtcatcttaagactggtcatcttgcctttctgggcctcagtttcatcatctataaaatgtaggggttgggtttgatgagttgtgggatcgttccagttttaatattgtataagtccatattctgggtgaatcggctgattaccaaaatggcaggtccttactaactaaaatatgaacagtgatagcccatattcttgcattttcaccttctgctgagcagtatatgcacgtcaacctccctatgtattaataagtcataattctgtttgttttagaccctggctgcccggaaatctggactctccctggctatggtgattaggacatccctaaataatgaggaactggtaagtactagatattgctcataatatctaactagatattgctcataatcacaagggagaaactgttctgcttgagctactcatctgtgatgtttagtccaatgttccagaaataactgggagcatgaggaaagcctgactccaaacaaacttcctcagggactcagccaatcattgtcttctcctcaaatacttataaaccttcctatctttacaaatgctgttcaattctaacatagcttccctgttattctccctgtggaaaagtcctactgattttttacatagtttaagttttgcctcttttacgaggttttccccaaacatcttccatcttcctccccttccagctgaatgattaatttcctcctcaggacttttataggttttttttttttttttttgagacagaatctcactctgttgcaggctgcagtgcagtggcacgatctcggctcactgcaacctccacctcctgggttcaagcaattctcctgcctcagcctccctagtagctgggactacaggtgcttgccaccatgcccagctaatttttgtatttttagtagagatggggtttcaccatgttggccaggatggtctccatctcttgatctcatgatctgcctgccttggcctcccaaagtgctgggattacaggtgtgagccaccacacccggcccttttatagcatttattcataacctccatagggtcatatgattacgagtgaagttggcttggtatgagtcccatctgtgccacttaactagaattattatatcccacaggttatgttacttcttcaagcctgagttctctcatctacaaagagaggtgacaaggaaactgagaggattaggaagtagatacatgcttaacattcagcatagcttaggttataataagcaatacatacaagcttctgttttattatttttattacaattattttgattattttgcatacaccttttcttttaaactctgatatccttgagggtggcactataacttgtttgttgttcttgttgaatgattctaccactatggcttagcacactgtctggcatgaggtggatgtttgtaaattctgattgaatgaaagaaccacactgataagaagatacaagtaggctgtaattatttaggtcagggattcttaaatccggctcactggaactcttgagggagctttaaaacatacagtgatggggtctcattctcagccactctgatttaattggcttcaggtgtagtttgggtgaaagcgatttttaaaaaaaattcttgtgtttggtgcctggcatgttctgttccggtaaatgtgtcttgcacattctgctggggatttacttgagacagtttatctgtgtccctccctatgcctggagactaatatatcctacctccccaattttagcaactttgtcattcttgtagaataaaaattctgccacaaatattatattacccattttaactttctgtaacttaacatttaaacaccatttttatgtctatatttctcattcccttccttcttctttctgtcattgtcatctttcatccaaatgtcaatctttcctgggtttttccatcagcaagctcccctacccagtacatatcagtaaaacaaaacatattcgtttgactatgtggaggctacaacaagttgatacattttctattgtgccacaggagaaaaaatgtaattgcattctcagagtattattctttctttctctctttcactctttttgtttatttattttttgcagacagagtctggctctgtcatccaagctggagtgcagtggtagggtcatagctcactgcagcctcaaccttcagagctcacatgatcctctggcctctgccttctgggtagttgaggctaaaggcatatgccaccacactcagctaatatttccttttttttttagagacagggtctcactctgttgcccaggctggtctcaaactcctgggctcaagcagttcttccacctcagcctcccaaagtgctgggattaaaggtgtgagccaccatggcccccacctccttattcttatctgttagatttatgatgccatgtaatattttgagtatagtttgggcacaagacaaagcagacatcctctggtgtaggagaaagctgcatattgcttgctgaatctcaaagcatctagtcttcttttgagtaaataataaagtctgaagaattttattgataaactcctacactgtacctttcttatgttttaaaacatggtatttgatttgaactatgaataccaattcatttgacaagttaacaggaaagcatagaaattagtggaatgctagtgtattttctgagtcctggacagggaacatatcctcgctttaaggttaaattagctattgatctgcttttcaacaacttaaaaatatcacctttactcctttagtttcagaaggcttcagtaaaaaaaaactgtgttggtgttgaatggatgaacagaatccatcagttatgtctcagattcgtaaagcccatttccctgggactcatgcctcaaaaagtaaatgaactatgacttctgtacaacaggcatattaaatgtcactattgacgagctgtcgcattcagtcattacacaggcaactaacataaatgctggagcaaataatttgcacttcttggtgctgaaaatctttctaggcacacttgatacaaaagcataaaatatttgcttttatgtgaagggaaatggcttggtgatgtggaaaatatcaaatggtaccacttctattttaattaaagaaatgtacactttgaagctcagtcatcttttccaaggacagaacagacactaatgcctgatgcaggatgacagtgggtcacctagcactgcctccttcactaacgctctgctggccatgggtgaagcatcgccagtgcccccatccatcaccaactccaccttacccatgaggcgctattaggactgattgagaatctcagcttaataagctgttaaggattatgatttctgaaaatttccatctagcttagtaacatagggaggaccaaccaatctagcatctaaataccatagcagtagtctccctagcactccgctatccatctctgttttagtttcacagactgataatttcttaggtgtgaatctgacagtggggcaatcaaagtatatccattcggtaattcaatacatgcttattgactatctgctatgtgtcaggtgttgtttcagactggaaataaagtagcgaacaactcagccaaaaatctctactttcatgaggcttaccatacagtgggagggggattgagatacttaattttgtatccactcttgctgcaagtcacatggaagcttctagtaggcaagatcgtttaaaccaagatagtctcagatgaggtttatgggaaaccaggtagagggagaaatgaaaatgactaagcataagagggatcctagagccctgttggttctgtctgggttgatgggcatgttaaggctggcaggcttctaggaagtgttcattctcagtaaggggaagtttgtctaggattcagacttcgtgaaagggactgaaaagaactagatgtggaggtaatcaggagatcaaaccggagccctatttctagtatgacactagaaagataacatggaaggagaaaactgctcagaacacctctctgagacttcaacttcaaccagagctgtaggcttacagcacacccaggtacttcagacccctgctcaggaacaggaacactttcaggccacctggataagttttgaagtgaaaggggcctgaattagaatctcaactccacctctcactagctttgactacttgtttcttctcaatattcttcaccttcctgagataactttgcttcatcaataaaatgaaagtaataatagttacctcacagtttgtgagaattaaaagaaatagcttatgtagaaagctctttgtttagtcaaacccttcccattcccccttttctctttatacagtggccggcatggcaggtggccatcagcgcagtagggcaggaacttgtgatcggggctgcagaatacatgctgagtctaatgcctccctgccctctttgcacctgagggtaattttcctttccaggaagtactgacatggaagccagcaataatgacaccaaagtaaagattatctcttgtctgcaagtattgctgttggttctgttattcttcataagcacggactttgacttgagatccatgttggtccagttctacaatttaccttctgtagggcctagggcaagttatggaaactttcatgtccttgattttcttatatgtttactaattatatcatatttttgcatctactttgcatcataaggtaaaaatgactatgtttttctgtgttcttgaacaattttggcatcattattaaactagcttaataagataagtgaggaagatttcctttttttccttctctgggatggtttctataaaataagttctgtatcttgaaggactggcaaaacttgtcctccaaaaccacctgaatatggtacttattttgagagtaattttttgactgttgaatcaacttatttaatatagtgattatgttccctaagcattcattcttgagttagtctagacaatttatattttttcagcaagttgtcttgtttttctaaatttttgaatttaataccatcaaattgtttatataattatatcatggtttatacaaaaatgtgtgccattttatcctattattatttatgtgtattttctctctcttttgtaaaattaaaactgcaggaaatttctctggctttgctttgttgactccatattatctccttgttttctatttcatttatttatgctcttgtcatttttagatttttttattctttgttttcactctgaaactacttttctaagttatagagttgaacatatagttattgattttaatggttcttattaactattgcatatacacaaagtaatatttacaacataagtgaataatagtaataataataatctaaccatgtatccatttttgatgcataagtacatactaaaagttagttaattttgtgattaacaatttttcaccacacaattttccatggttccctgactgactttgattggttacataaaaggacagttacatgggatctatttataggaatggtcagccccctcctcacctttgttttataaaatccgaaacattcttctcttttttttccgtcaacttttattttgagttctgggatacatgtgcaggatgtgcttgttacacaggtaaatgtgtgccatggtggtttgctgcccagatcaacccatcaccttggtattaagcccagcatctattacctattcttcctgatgctctccctcctcccacccccaccccgacaggccccattgtgtgttattccccgccgcatgtccacgtgttctcatccttcagctcccactaataagtgagaacatatggggcttggttttctgttcctgtattagtttgctgaggatggtggcttccagctccatccatgtccctacaaaggacatgatctaattccttttttatggctgcatagtatttcatggtgtatatgtagcacattttctttatccagtctatcattgatggacatttgggttgattccatgtctttactattgtgaacagtgctgcaatgaacatctgcatgcatgtatctttacaacagaatgatttacattcctttgggtatatacccagtaatgggattgctgggtcaagtggtatttctgcctctagatctttgaggaatctgtcttctactatgattgagctaatttaattcccaccaacagtgtaaagcattcctttttttctgcaaccatgccagcatctgttgttttttgactttttgataatcaccattctgactggcatgagaaagcatctaattgtggttttgatttgcatttctctaatgatcagtgatgttgagcttcttttcatgtttttttgactgcatgaatgtcttcttttgagaaatttatgttcaagtcctttgcccactttttaatgagattgtttattttttttcttgtaaatttgtttaagttccttatagatcttggatattagacctttgtcagacagatagattgcaaaaattttcttccattctgtaggttgcctgttcactcttattttagtttcttttgctgcatagaagctatttagttaaattatatcccatttgtcaatttctgcttttgttgcaattgcttttggcgtttttgtcatgaaatctttgcccatcactgtgtcctgaatggtactgcctagattttcttctagagtgtttatagttttggggttttatattcaagtctttaatccatcttgagttaatttttgtatatgatgtaagcaagtggtccactttcagttttctgcatatggctagccagttctctagcaccatttattaaatagggaatcctttcctcattgcctgtttttgtcaggttttgtcagatggttgaaggtgcatggtcttgtttcttatttctctattccatttcattagtctatgtgtctgttcttataccagtaccgtgctgttttggctaccgtagccttgtactatagttcgaaggtgggtaaggtgatgcctacaactttgttatttttacttaggattgtcttggttattcaggctctttttggttccatacaaatttttaaaaagtttcttctaattctgtggaaaatattcatggtagtttaaagggagtggcattgaatctataaattactttgggcagtatggccattttcacaatattgattcttcctatccatgaacatggaatgttttttgatttgtttgtttcctctctaatttccttgagcagtagtttgtagttctccttgaagaggtctttcacttcttttgttagttgtatcgctaggtattttattctttttgtagcaattgtgaatgggagtctgttcacaatttggctctctgcctacctgttgtttgcgtatagagatgctactcattttttgcacattgattttgtatcctcagactttgctgaatttgcttaaaagcttactcttttggactgagacatggaattttctaaatataggattatgtcctctgcaaaaataatttgacttcctctcttcctatttgaatacactttatttctttctcttgcccaattgccctagccggaactttcaatactatgttgaataggagtggtaacagagggcatccttgtcttatgctggttttagactcataagaatgcagtctccaccccaagcagtaaatcttagactttccacattaaaatggctaaagtttcccccagtgtagaaatccatagtatttttagtttcatgtatttatcaaattaattatctcataccactctcatcacttgtatacatttttattgaaagtttgaattgggaaaaaagaacatttatagtgcataaaatctatcatattttgttttcagattatgttctgtgtcataacaaagggcttatgttatattgtgctctccttgaattaaggaatcatctacgttattgttctgccctctttatttggactcaccccataagtttcttaggacaatgttaatttatatctgttataaagcaatagaagtgaaagaaaactacttacattctcacatagataggatataacttttagtctttgtttgtactttctgctacaaaaaaatcacctgaataattttagctcctatagtcaatcagttttataggatgattacttagatgagcaaatcagcactgaaattatgtctgtttttatagtcaggattttatcctagcattgctctgtcttcatgtttataacaaatttcaaaaagatcatattatacctaatgtttggtctgcaaaaattctgatgtttttgtccagaaaaaataacacttatacttcaccgaagagtagatatatttttttctggaaagcgtacatcaagtatatgaaaaatggctcaaaacaagaagcatttttttttcttgaaagtatcaaaatgtgatatttgggggtataggaaaggtgtggcttacataatatcacaaggaggattatttcctccacaggatgaggagggaaatagaacttcataggttagtcactggttaaaacagaaaggaaaaaggagagaaacaatgtggcaaatggaggcagacaagctttgttcatgttataattattaacagttggtagattagaatattgatggtctgaaaacactagtcattgctcttggcaggtagcctgattcctttaaatctcaggctctttttagtttcttcaggtagtaatcaatagaaaaggcaattcatttccttccagtgtcctaattgttccaaaagtgacatattagtgcaacttactttaaattcaatttttggagaagaaagttctaacaaaatatttctctagggtgtgagcatcctccccagtgtagtctatatgttgtgcttgcctacaaaggcttatcagaatgtgaaaacattccttactcatttctacaggtaaacaagatgtctataacagcaaaaaaaattgccttcttttttggaatgacttaagcaatgtgaaaataatgtttttttttttttctaattgcaagagtattacgtcctgtctatacataaaaaagaatatgggaaggatatgtatcaaataatgcctaactttaaaaagctaaattgaatatttttattatttatatcagtgcctttgtgttttataaattatttttacaatgagcatgcactttattataatcttaaaatacatattttttagaaaatacatttttattgtagaagatttgcaaagttgtagaagatttgtaaagtttagaaacatttaaaatagactagcagctgatgagaacacatggacacctagaggggaacaacacacactgtggcctatcggagggtgggggtgggaggagggaaagcagcagggagaatagctaatggatgctgggcttaatacctgggtggtgggatgatctgtgcaacaaaccaccatggcacatgtttacttatgtaacctgcgcatcctgcacatgtacccttgtacttaaaataaaatttggaaatttaaaaagttaaatagataagcagcaagtcactcattttgccaaatcctgctgtccttgggtcctaattctattaattaggttttgcttgttctaggaatctccatgtgtctgattccaagttgtttacctaggccagagaccctctcttgataacatactcagttccatccttctccttcagctcttatttacagctgattattaatctgcctgcccttagtgttacttttctgtttaatggcttttcatcccttcaatctgattcctaatggtaaactatagactttcatttgcttccatcaatagcaaattttggggtttccccttattttcccctgccatgcttttatttaatgcttctcgctcttttcaccttattccacacaaaaacccacactttttccctcttatagtcttatttcatcttgcctgattttgctgctgagaaaacatcttgctccaagatgcattatccccctgaaatacaagaatcctctattatgagattatttttatatgcttttcctacctattaatttcatgttcctaaactatcaactcaacatatactttgctgaaaaaagagtgttttcgtatggcatttatttcagagtaattttcagctttgataaatacatgcccatacccccgaaagtcaagaatgaaaaggactcatcatttccctaaaatgatgagatcttattaaaggggatatataccctctagtaggttgtctaatgttttaatgtttttctctaactttaatagctcttaaatattgggatttgtttcagtgccccattcaattgcttttcaatgggctgtctagtaaatgtttcatgttttttttttttatttttggaaattagctttactctccctttacatgaaatgaattatggctccttagccaaaccaaacaaaacattttaatgaaatctgctcagctgtttattcagagcttttacttgttttcctgcagtatgcttaattttttagcagagttacttatttttattactcctactataatctatggacttagagtactgactatcacttgacttcagtaaaaggaaagtggacatagggaattagatcatatatattaatcatttacttaatcttgaaatatgtgaataagttcatgttcaaaaacaaccttattcccaactctactttctaaatttatgtaaggtacattacttacttttcttcctttcattagcagattctgttttattcccactcagtattccatgtaattagaatattttattattctatttttattattttattgccattaaaacaaacgagttgcctgatgcaattgcaagtatataaattagttcccttcctaatttttcttctagaccacaaatgctacattacgcacacaaacacacacacagcccctcagcccagttagaacgggagactctgtctgtgggtagctaatgaaaaatctgttatgccaaggattatttcatttattttaatgatagtgaagatactcactatgctagatattaaagaggaggcaaaggtgaataatacatgcttctaattctcaaagaactcttaacagttctttataagacatctttattatgaaatgaagccaggagatttacttgcttcagacactctttattgagccaggagatttacttgcttcagacactctttattgaaaagtgatggatccagtttttctatctgaataaaccctaatattaggatcttccacttgagtgatgcccgaatttgaccatactgctgctctgtagactcacttgaagtataaagagctctggattgtccagccccttatctaatagcaaggatggatctagccattcaaaattagaaacatttttactgaggctccgttccctggtaggggacctcctagtaccattaccaaacatattctgggaaaacacagagtgagaggaatgtagtaataaagggaaatatgctgttaccatactgtggaattgaaagttagtcatttcaacactgtgggaaaatattctgaaatgagatttaaggataattaattcaaaatataaatgcttcccttctagtatgacttaccagctagactcttcctacagggtttatgtaaatatccattcattatgcatcaggcagttgtgtgaaattatctgtaaatgtaacctctaagagtgctggtctttctctcaggaagtcacctgctttgtgggatatgagaagcatagaaaaggactcatttaaccaattctcttttctattggcctgtgtttattgttgttggtggtttgtttttttttttacatccagcatcaatactaatactaagtgcttatttggtgttttgaagcctgtagactacttctgttatcattatataatttgatcttcaaagtaataccattttaagcagagcagaggaggagggtgagtcttagagcccttacatttctccgtagattacaagattcataagtggcagaacgtttattcattaaaagaaatgtacctctactatgttccagggacagtgataagctgttcaggcactaagaagaaaaacatggaagacagttcctgcttatagaggccccttttaaatatcatgtagttgggcctaggagaactcagatctcctacctacttgttcaatagattttttttcacctcactaatgacttgtcattaaagagtccttccatatgctattagaaattatttccttttaaaatataaatcaccatgggagagtgcctcatttgaccttatctactactgatgctttcttatgaattaggtgataagatccttccccggtgataggtactgaaagcaaatttcctgcagattgaattacagaagtattccttggggctgaggaggggtgaagtgtcagggaggacaagggggtcaggaaataacggcctgggtagaaagtaaaagaggcgttgggtttacagcatagcagggacttagacattctcaactaattagacctgtgtgctgctgggaaagaagctgcagacagtgaagcccagtccagtctggaagattagggagttctttgtgtacagataactgaatagggccctaaaacattgagagaagaataggttagcagagttattatgcttactgtcatcatgacttgaatcagtgatccaggggctctctcaaaataccattttcagagaaaagtgataaaatggtttgttttattttgaaacaattcaaatccactgacttggcggtgcattggtaacttctctcatgttcacagaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagtgagtacttggtttggctgaaaaagtggtatgcagagcctgccttattccatctgtttcatgttagatcacttcaactcttgctggttgtcaagaaatcctacccgctcccctcccaccacttacacaaagatacacatactgtccatcaaatcacagttgatgatgcattcttacagtgtggagctaggtgctattagaatcctcagggtgagtacctggagtgaaattgcactctcatccagcataaaccttcaaagtgacttcctatctattttcttttttgtcttttctttctttctttctttttttttttttttttttttttttgagatggagtctcactctgtcgccccagctggggtgcagtggcacgatctcaactcactgcaagctctgcctcctgggttcacgccattctccggcctcagcctcccaagtagctgggactacaggcacatgccaccaagcctggctaattttttgtatttttagtagagacggggtttcatcctgttagccaggatggtctccatctcctgacctcatgatctgcccacctcagcctcccaaagtgttgggattacataggcgtgagccaccgcgcccggcccctatctattttcttactcatacatcataatagttccatgaggtaagtgggaatatgtaaaatcaggttccccaaacagggatcaagatatgcttctgcatttacagcaactggaattcttttttcgagcctatctggtgcctgcctggcaggatccatgtccttctacagttcctgcacaggccttggaaatgggatgtcttgggtttgaatgtcaacaacatatgtaacttaccagatatgtgactttgagaaaatattttaacttcttgaggctttatttttctccactctatgggcaggaataacaaaatttaccttagagggttattggaaaggctaaatgtaatagtctctgctaagagcctggcacacggtagatgctccataaatattaatgacctttccatcctttcacactcttgaatgagtacatgccactttggtttttatgacaagttaccttaaatttttcatttccaaaaaaatcctttatttgttactttaggtctagaaatgctaatgcatcacattgtaaaatacacataattgacttttcactactttatttatttggtagtgtcacttaaaaattgccaaaaagttatatttcaacatgatgttcatttgcaaatcatattttttcacatctaaatattgtgccctctgtttgttgtttatagggatgtagtcaatgtaagatatgtggattgcttgacactgaagggagaagaggaaaatgtcaaagattaaattagaaatgctgtcacagctgacttgttgtagtcacgatcacatacattcttaagttttctctatctgattagtattctccatacaagattagatcagattgaggctgtgttaatggtaacaagtgcattctttaagcaaaagaagtggtattctttatttgaaaaataagaagtatagttaagaataattattttaaaggaagggggattgacttgatattactcatttaatttacatgcaaaatctcataatctgattaaaattcagcccaactgtttaaaaagtgaattgcgtataggcatcttaagaaataagcatattagggcaatgacatttaagaaaatagaaaacacactgtcatctaagaacaaatggcttaaattccttagagaaaaaaatgatgccactcatacctacgaaatgaattcttcttctagtctttcagaaaggacagatgctacccattcgttaaactgtagaaacatgttcataatctatttccatttcttaaaacaacatttattattttatatttgttaaataaattatgcaatccaaaattttcattgatgttattcattaaaatgcacacataaattggaagaatcaaaaatagtgcagaacaatgaaggtgggtatgcatgccccagggagggtttttataaatccatttttacttttttcctaaaattgacactctcatattgatcagaaagaggtcctacaagtatgtatacttaacttcataactttccatgataactatcaataaaatttgaaattctccctacagaatcagtgacattaccttaagaaattgatcttcttcattgttttaagccaaaaaaatggcaatggtgacactatatatgagataatttcatgaatgccaacactgaagaaaaggaaagaataaaaagctaagaaaatcagagttagaaggtatagctaattcagccccctttaaatgtaagacagttctatgattttctttataaaatggccattcaatctcgtaacatttccagggaaaatttcaacccttggtaggcagtttaactcatgactttagaatgctagttcataaattaaaatttaagccaaggagtctttccttgtaatttctacccattacgccatatcttacttctggtgaaaatatttaatgaattctattaaatatgacagtttttcaagtacttaaattaattatctagttttctataggtttctagtactctttattttgctaattcttttctgagtaattacagtctatcaacacacacatgctaaaagaaattaaattctctacatgtggtctgaccaatggcccatgcaaaagagagagtatgtcaagttacttcaaattgatttaagttaggtgtttccttaccatgaagtcttgggtttgtgacttgtgcaccttcagtcaagtggaattagaccaggtgatggtgaaatccaactcactgctccagtgcttccttgtgggttcagagatgcatggaaatgtccagtcaattccccaaagagcttcatctaacaccctctctagctaattgtacttgatggtagttcatagattttaccaccttcttggcccaaaactcatagacacagggtggtaagaaggagaccaaatggaaacagggagaacaatgagaaaagagacctgatttatactccttcaataaaatcagtggcagcagccagagttcacctgctttttctttaattagttcatttgcgtctcgtcgcctaaaaagacatttagaattcttttttggaaaaagcatttggtggtgaaataatttaattataataaatggaggagcaggttgtgaccctgaattacgttaacataacgtgtaaggaacttgctgtagcacctcagtggtggttttaaactagaaaaaggccgtgttggctgggatgagggttgtgtgcagagtgagtcatatgtaaaagagacatcatatgtaaaatattttccttgattatgttttcagtgtagaaaaaagacagctacagagattggaaaaaaatgcaaataatcatggcactttccttacacatctccaaagaaggaatcccagagtcttactgaataagcattctgcctacttttaattcctaactagaaatttcaagcacctgcataaggccagaaaatatttcacgaaacgctcagcaaagaagcattttgtgagatgtgttctttagttctacgtgctttctactgacattatgttgaacttatatgtcctaagacaagcaattaataaattcgtagcattaataaaacctgtttaacatactcttgtttgcaaattagatattgattctcctttctttgttgccctgttatcacattttgaaatcacattttaagacagtcaaatatttgcatatattgagcaactattgtgggtaggagttttattctgggctctcagagctgcaaagaaagtaagtggtatttttcctggactcaaccttattttctaatacataacttagatgaacagatgtgaacatgtatcttggaaagttttgacattttactctttcaataacaattttacaatatatgtttaagtaatgagtactcaggaaacttggaagtaggattccttttatccactgctacttaacacacatttaagcaaaggagctgcttagcaaatgtggttaaactaatgaatgaaggaacaagaactacaactagaaataacctgttgtggtttaaatatcatctttccatataggcatacgctattaaaggagcttcgagattagtgagttaggaaactcagtctactgctttggctgagttcagaagatttagtgtctcatcaaaaggatcaagcgaatagcgtaagcaggattagaactcaggtctctgaactcagcctggtgttctttcctaacttataaataagtttgcaaagtcaatcctagggggaagaaaaggaaagttactgcattttattttcagtgctgtctcactttttattatgggagaaagcacatagggtacccctgaatttgagacattctatgctgcctgctgtagcctccaagagttccccgccatgataactcctcaggacccgccatctacagccaaccgccaataaatcctcaatgctcctgaaataggaaaagttcccatgtcctccttgcagggcgtgtgatggggtgtagctcgcttcttcagtgccccgcttctcagacttctaggggagtatacagatgggtagggagccccacggcagtgtctagaggtgaatgtttatagctgaagccccagtaggcatatgttacagggtgctctttaagtttagcttcccgtaggtggcctgtgttagtcaactcaattagacccctcccttatcgcaaggacagagggctttctgtatcccagggttcttgctttggtgtactggaagaattggatcacaggtgggcttggagaatgagtgcaaggttttattgagtggaagtagctttcagcagatgggggagccagaggaaatggttttccctggagtcaggccgcttggaggcccaggctgtcctctgactgccctggccaaactccaccacgttctgttagttgatagtctgccgacgtgacgatttctgtcctgtgctcttccactcggcatgctcccattggtgtcctctcaacatccagccacttgtgtctttttctaccaatgtgttcgtctggatgtccagccgcctgtgtgttcctctgctgatgtgctcctctccacatcccgctgcctatgtgtttgctggctagagcattagggtttttataggcacaggatgggggcgtggcaggccagggtttcttgggaaatgcaacatttgggcaggaaaacaaaaatgcctgtcctcacttaggtccctgggcagaggcccaggcgtggagccctagccagagaccaagcccttccccttcaggcacttccctgacccccttccatatcgctaccacctctctcccagcatgttattgcattgacttttcaacaacactaaaagggaaatgaatgcaatggtcagttccttaacccaaaggaatagactaataatggagcattttcaggtgatggggttggctgctggagagagactaagaggatgaatatgctttgcataatgccgtagaggtattctatataacatactcaatggatatcaatgcatgttttttcatagtattgagctatttaaaaataatctgacttccagtcttattgcaactataatgtttttaaaacttccctgggcatcattttcctcatctgtgaaaacagttaataatacttgtcaatgacctccagctagagaccaccaggaacacacccgtagttttaaaaagtgtgttttattacttattactgtgagggagaacatacaccaggatgactatagggcatctcggcaagatcgtgctagaaaacagaggtgtactctggatggggtgttatgtggaagtgaggacaattctacgatattgtgtctgtaaacatctaatctagaaggaaggcaaagtagactgaagccacagctttacagtagtcccaccttattcgtggtttcactttccagtttcagtcctccgcagtatggtccaaaaatattaaatagaaaattctagaaataaacaatgtataaattttaagttgcacaccatttttagcagcatgatgaaatctgccatccttcttggaaggaaagtcatccctttgtcagtgtatccatgctatagatgttactcaccccatagtcacttagtagctttcttggtgatcagattaaaataaaataaaacaatgacaacgacaacaacaacgaaaacactatacaataaagatagagtttggtactatctgcggtttcaggtattcctgaaggctttggaatgcattccctgaggataaaagagaacaattatacttcctaaagcaacaacaaccactcatattaattaggaaagggaatatttgatattttgtggtttacgcagtgctatgtttttgtctatgcttaggaaaaataaggaagcggccttgtttgtcttactttaacactgttgcagggtgaccacgtctaagtttggcgctctttgaaattgtttacgtccaaggaaagaacaatgtagcctagctatgagtaccaggccagctctgaacaacactgtgaactagttgtgttagcaaagttcctagaagtcagagtctagttatgaaaaaatagaaataaatcttgttttgaaatttttggtgtttaattttcttttgctttgtatttttttgaaaagtatatgaagaaatttatgaaactaaatgtgatacaaagaaaaatatcttcctcctgccatcactctcttggtttcttctctttccttgcttagtaaaaatattttgaaaattgagcacattttgaatcataattaatttgttcccctaaacaatatagatagcttttgactctgtgatgactgggcaacctctagaaaatgctgatgagatgtagtacctttaacatactgttatgcgagcacattcctgattttgtattttcaaaacatgcttgttttcgaacttgttctaaaagtatgcatataccaataatgagatgattgaatatggtggggatggtacaggcagaagagaaaaaacagtttggcagttttttgtaggctcttggtgccaggcttcctgacactggtcattttagagaaggtggtagttccttggggagtgggctaccttcttgtattttcccactgtcagtgatagagttacctacaggctctcacctacaggaatgggagatgacgctatgttagatctgtgatcctccaattacctactgttaaatgtcagtcctttgttgtttgcgaaaaataaggagtgtgtggctttgattctacaagaaaaaggagcctgctaacttgaagactgggggagttgcaggtctgttccttgaaaagactgaaggcatgttaaaagaggagggttcgtattatcttggatataaaacatctaaaagaaatgggtagggaatggcaactgaatgtccacccacatgatttcatgggggcaaaaagcagagagacaatgaaagcaggcccacctacatgtttttactgggaaataaaagaaaagcagtaaagacccatttcccatgtcagagaggctcctggagaaagaaaggaatacaaaaatccctcaatatcagaccctctgaatgctttcaatggatgttaaccacccactttctttgggtccatcagtctcaaatgcaggtaaggctttatggatgtcaaaaaaataaataagttattttctctagtttttttaagctcaaatttcttttatctttaagcccttccttggccctcatctagcaaatagatatagagcatccagcatactgcagacaccgtccgcgtgagagttttccagttgtttcagaggtcaagtgattatgcagctcaaacccctaaaatttcttactaatgtgaaattattattatttttttgagacaaagtcccactctgtctcccaggttggagtacagtggcacaatctcggctcagtgcaaccttcacctgccgggttcaagccattctcctgcctcagcttcccaagtagctgggactacagatgtgcaccaccacatccggctaatttttttgtattttttttagtagagatggagttccaccatgttggccaggctggttacgaactcctgacctcaagtgatctgcctgcctcggcctccaaaagtgctgggattacagatgtgagccaccactcctggcctgaagttctttaataaatacctatatcttcacctttttgacatgctgaaatcactatacttattccattactattattaaagctatatgtgttatctcattgaatcctcatactgttaagggagacactactactattcctatctgtttttcagatgaagaagctaaagttgagagagataaactaacaagctcaagactaaaaggttaggatcttagtctgtttcagctgcataagaaagtaccataaattggggggcttataaacaacataaatttattacccacagttctgaaggtagaaagcccaagatgagggtttcagcacagtcagggcccatggagggcgatcttccaggttgcagactactgacttcctgctgcatcttcacatagtagaaggggcaagtgagctcccttgagcctataaggccactaatcccattcttgagggctctgctttcatgatctagctacttcccaaaggcctcatcttttaacattatcacatcggagattaggtttcaatatatgactttcaatgggatgcaaacattcagactacgccagttagttaagtggcagatcaggattcactcaagattttctcctctacccaagtgtattagtacattttcaggctgctgataaagacatacccaagacagggtaatttataaagaaaagaggtttaatggactcacaattccacatggctggtgaggcctaacagtcatggcggaaggcgaaaggcatgtcttacatggcatcaggccaagaaaaagaataagaagcaaatgaaaggggtttccccttataaaaccatcagatctcatgagacttattcactaccatgagaacagtgtggggcaactgctgccatgattcaattatctcccaccaggtacctcccacaatacgtgggaattatgggagctacaattcaagatcagatttgggcgaggacacagctaaaccatatcactgaagcattgataggtactgtgcacttttaccttatttaaaagtgatactctttatatatttcttccatttatagttggcattcatgttcttgctttatgctgactatgtaagtgcacgtggcatgtaggttaaccaaattctgttatctaatgatgggaatacagcctctgttttcaaagaattgcaaatccaaacccaagggccaggtgtattttgtcttttcataagatttattccacaggatatttatcattttatattcaatttattcctgtggttttttttttccagaattgtggccttagggcaggagtttgcaagaatttcataacacattaaattaacccagagccaaagtaaatatccaattatgccaatcattttatcttcggctcccccaagaagtatttcctctatttattgagtgtatgctagtttccaaacagtgtgtgagacacttggaatacacatttaataaaatttgggccttaagaggtagcataaggaatggacatatatgcaggtagctatgtcaatggtgattgttaaatatgaaagaattttgtgaggcatttgcttggaatcagctgttagaaatatttacaccacagaaatctgctaatactacaaatcaggtttgggtttttttgtttgtttctgtaggagaggagagaaaatgtgactgttgagtttaaaagacctctatttcctgttgagataagatcatatgctgagaatggagggtaatggaggtgaggtaggtgactttagagtagaaatgttttggaagagctgttgagaaaaatagcaaaaggaaagaactgagaagaaggaagaacactgaagttattatatacatatctatgtgtatacatagatatgtatacatatattctatatataataaacacacatatatgtatatgtatgtatattatgtatatatgtgtgtatgtatatgtatatacatacacacacctgtagttttcagtttttatatatataactttatatatgtatgttttatatataaagaagttatatatagtcatataatcaaaatatatatataactttatatatgttttatatataaagttacgtatataacaacttcaatattcttccttctatttttagattatatctataaattctataattatttgtagatactatctatagatacttcttcagaaaaaaaacacaaaaattgtaaattgccatataaagatggtaaaattgttaatttcacctgaagtttagatgttttgtctgataaaaattaaagaaaaatgagttctagttaattgtcccattaaattacgtagaagagaaccagtttgcccctctgtctaaggttgaattatggttgtgttgtccataattatattgtcttatctgtcaagtaattatttttaaaagtatcaatgatgcatttcatttggatattatactctataaagtgcttttagtttacattatctcttttgatctcatcaattgttgatctctggttggcatattactgtatttcaatgacactgctagaccttctaccacacgctttgaagaaagactcatgtaaaagcaaatttaaagttatctctgatgacttttagataaacaaataagcctgaagaaaaataacccaaagggctggaaattcatggcaaattgtaactatttaagaaagagtttcattagaaacataagatatgtgggtttgataaagcatagggcaatggaaagtacttgtaaatcagtgacaaaaatttattatgaatttgtctctatctctgagctaaacaatctaagatgaataattttcttctgatcaaaaatgcaaaagtagaaatttttgtttgtttgttttgttttgttttgttttgttttgttttgttttgagacggagtctcgctctgtcgcccaggctgcggtgcagtggcgccatctgggctcactgcaagctccgcctcccagattcacgccattctcctgcctcagcctctcgaggtagctgggactacaggcgcccaccactacgcctggctaatttttttgtatttttagtagagacagagtttcaccatgttagccagatggtcacaatctcctgaccttgtgatctgctggcctcggcctcccaaagtgctgggattacaggcttgagccaccgcgcccggccataagtagaaatttttaaaagctacatattttttttctagaaataacagagaaaatgcttaaacatatgtctctattaacctgctgtccaccgattggcaatttcagtttattgctcttgtctgtacatattagaatagatattctataataacagcaataatacataagaataagtgaaatttgaaagctaatgctcaagctttcctaattatttttttaataacaagaggcagtcgttaaggacagaagtctgattcctttagatgaaaaatctctttatattctagctttgaatttggcagctattgtttgagcatttattgtgtgcatggtagttagatgggctcttcctgaatttagaaaaataatccaaagtatatttaactctccatgactttagcactccttcctagagcctttgagagcattaatagcaaaaataagaatagctgtttggaaatttgggagagagtcaacatttttatgacatttctaacctttaggacattccttgcctggctgtcacagaccaaacttttgagtcactttgtgtcttgcagggaacattttccagtcaccactgtcctttccatttagtgaatattaactacttgaataaaatatgcctatcagatagtttcaactatttactccagcctaagctaattttactatttaagaattatggactgtgtaaaccaatattgataaattaaaaacatattaattgcatgcaatttacaaatttgtagctattctagggacatgtttcaacagtgtagaccatttacaatgtccttttaaatcatctttagtggaattcattcttttttttgtcttccttttttttaaatgtcgtttaggtcctcaaagtttaaaataaaagataaagacaggtagactgctctttctaccactggaatattcatatcttttagcttcctctattcacactcattattaggaatatatttttccactctaggaaacaggtattacactttcaaataaatgaacatttacattaaattattgctgtcaaattgtatatgaatttatcataagtaaagttaatagttgacctttcatctcttgtcttactttctatacttaaattgggctcaacattcacaaattaggttcaaagaacattactgatattatcttttattgtagaaattgtgcttgcctataaattatcccatttaatctctaaatagtttatgagatattagtatgcctatctcagaaatataatagttcagaaaaaaatgagaatacaaattaggcaaacttacagtcatgtcaaagaaaattagagcaattactacctatgaacacaagtctttcgattattttcactgtatttcagttgcttctgtaccaaaaaaagtttgattttagcagtggcagttcctgtagacactggtacatgaccttttgctttcttactttaaactcactaaggaattgtggaaattgaaatcatggtccgttattaacttgtgtaatactgggcaacccagaaggccatacagaacaataagactatctagccagtagcttaaggttagggatccaataatggaattttagaaatctctcactgacagaatgatttgtgttacaaacaaaaatgcccagaaagttgagaccagtcatgaaaaacaatgtcccagaaataaaaaaagtttttagtggaaaatgagtattcagtcatttaaaagctctggatatattagagaaagagagttcgagtcggtgttctatcagttacattataggtcatttagtctagtagtgtccaaatcttctttaaacagctcaatcattttcttcccaagtaaaatcttacattctattttaatgtttagcaaataacagtgatgtgtttgaattattgctttccaagtgacatttgccacttatattctatctatttctcaattttattttggatacccattgaagaaatatgtgtggtatgtaacacatttgattgtgtctgttctgtttgctgcttttgaattctttttagaaaatttaaaccaaatttttgcacaacacctaatttagttcagtaatacaaaagaaaagcctgggaatcataggaggtcaatttacctgccaataacacaaaggagtactagttgttgtgaatctcagcatagcagttcattatgatatttttctaaaaagccacctgactccacagaatgaaagcactcattcattctcacttcctcctccttttcctccctcctttagccatcaaaaagtaatggcatttccattcacatcaccattgatgtttccatcataggagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacaggtaaaaataagtcttcttaaaaatttgtattgtaaattgagatttttatgtgccctagaaataactgctaataataattataggtaaaataaatggttattttttgaatcatgttaatatgaacaagactagttggtacttcacattttgaaaatacatactagataagtgaaataattttagtctgtgtcttgttctaatcaaaatttctttcataggaaaaagtttctgtttttcaatatattcacctgcagtgtacaagaaatgagcatttttgttgcctaccagtgataaattataacagtagctaataatctgttcagttaatctttttaaatgagaaaagcgatgttattttacttactcctggctcaacatccctcatccatttggtcctcgagtcaggacaatttgagtttaatgatatctagtaaattggacttctgaagttgcttgtaatgtcaacagcgagtgactgtgcagcctgttaacatttaccaagactcttcacttactcattttgtatttacaagataaagaaagatgctttctcaactatgtagagttgatcaatattgacggcagactcataaataaatcagtttggattacaggcctttgaattatgttgggtaatttttcatataagtgtaggtgtatcttcctcattcctctgtacatgtatgcagtaatgtgtatgagtatatagctaatatgtatatgcatgtgtatgtatatagctacttttcattaaagacaagggcaaaaattacagattttaatgttgtatatttatttttattaaatttttttaaagttctgtgagtcatgagaatgaaagcaatggggatgcatctataagcccaaagaaccaaatgacagaaaaattgtctttgttattattattttttgtttctgaggactctgtatgttaaaatgtttattttggtttatttcagtggtttctgcacagggtctacaggcaaaagataaaacagggtctagtgatccatatgttacagttcaagttggaaagaacaaaagaagaacaaaaaccatttttggaaatttgaatccagtatgggatgagaagttttatttgtgagtatataatgtgaaacctttacaaatattaaattatttaacaatgaatttaagacaggcatacaaaggatgcaataattatctcattttttaataatctcttacccaaaagtaataaaaaagtaaaagtaatgttataaactccttcaatactctcataatatttattatttatccttcatctttggaagcaagtgaataagaagaatacttcaaatcaaaaaaagatggcatgactggggtggctttgcaggagataaaaaaagatacacaacatgatctataacttgcgatgacccaacatagccagaaatgtaatcttgatttaacagtatcttgacatctgaagatttatatctaaagccagtagacttagagcatctcctggcccatcacttggggtggaaccatatctacattagcttatactattgagatggttgatgataactgttataaccttgcacattccacgagggcatttatttttaaacctcttacatcttttactgaaaagcagaaactcatttttctctcaaaagttcttttttttaacactcctttgtaaaaaaatgaatttcagttgttatttggtagaagtaaaaattcctacatgagttaaagacagtcttttttctttagttctctctttgcaaatgctttaaacaggaatctcattaccatggtaggtaaatacacccagaacatatagcttatttgggaatgtgggcaatattgtgtaagaagtagagtttcttgcatatatggcctgatgaaggaagtcttaagaaataggtttggaaaatcaattggaaccaaataacagagggtactgtagaatgaactaagggatttggaggatttctcccttcagagttctgggagagattagtatccctttacgtgttaaaatagaagacaagaaatcaattggaagttaaaattaaatttcctgttggagtcacgtaaatgaatatagcaggaaaggaacaacaaaggggagggatgaagactatggaaaactggaaaacaggtgattcccagaaaagaaatggcttccgttgccatgcgatcatgtagacaagatgcagctagagcttccagtttttcaggaagctggatatctgaaaccttagaaacagttttattgaggtgtaattgacattacataaaatctacacatttaaagtgtacattttgttaagttttgacatatgtgtacctcctgtcactacagacaagataatgaacatatccatcagtgccccaaaatattctttatgcctcatggaaagtcatcccttctgacttcccgtgtgcaaaggcagtctctggtttgctttctgatgctataggatacttttcattttgcattttctagaatttcctataactagaacaatatggcatgtaatgctttgtgtggttctattcattcaacgtaattattttgagatccatccaaattgtagggtatgtcaatagcttatttctattgcttgttagcattccattttattaatatatcacagtttattttactattcacctcttgatggatattttggtttgtttccagtttttggttaatgacaacagagtgacccatatgttaaatgaatgactcatgctaaaactgacatttgtatgtaaatatttgtgtggacatatgtttttatttctcttgaataaatacctagaagtggaatgaatagctgaatcacgtattcggaatatgtttattccgaattaatttaggaattgattcatctttttttaacaaaacaaaacaaaacaaaaaaaccctgatggaattttggttgctttaaagcactggctaagatttccagtatgatgccaaatcagaggtaagagcagacatcttagtctcattcccaatctcaagtggaaaacttcatttcttgattaactatggtattagctgtagctttgttgtagatgccatttatccagttaaaaagtgatttttctattctcagtgaactgagagttttgaccagaaatagatgttgcattttgttacattctatttctgtatctattgagatgatcatatgattctgactgtcattttaatttttttttgctttttcaataacaaatctgcagttgtccacatttttgcttctctgtgtataacatatctcccctactcctccaactgcttttaaaatattttttcaactcatttgtacaattggtttatgatttcacatggtgtaatattcttcctttttctagtgtttagggtttgtttagctgtttgggactgtgggtctacagttttctttcaaatttggaaacatttggtcattatttctttaaatattcattctgctgtctgtttggaggctctacttgaatacatattaggcctcctgaagttgcctcatagctccttgacactctgaggacttttctttctttctttttttttaaattttactttaagttctgggatacatgtgcagaaagtgcaggtttgttacataggtatacatgttccatggtggtttgctgcacctatcaacccatcatctaggttttaagcccagcatgcattaggtatttgtcctaatgctctccctccacttgcgccccaccccccaactttacttaattttttttttcttatttttttcttctgtatttcactttggattgcttccattgtgtgtgtttaaattcactaagctttgcttctgtaatgtctaacctgctaaaatctaagccactgtaattttcatattaggcattttcttttccatcctaggaaatcctaactgggtctttgcatcttccatgcctcaacttaaatttttgaaaacatgcagtatttatgataactgttttgatgtccttccctaccaattctaacatctatgtccaatcttggtcacttttgattgatggatttttctcctcattatgcattacatttttctgctactttgcttgcctggtaattttagcttgaattgcagacattgcaaatgttactttgttgcttgctggatatcgtagcatcctataggtattattgagcttagttctggacatacttaagttacatggaaatatttttgtgctttggatcttgcttttcaaatgtgttaaatgggaatgaaatagtgctcaatttcaggctaattattccccatataatgaaggcaagactcttcagcatactcttcctactaactcatgaattaggaggttttgtcttctgcccagtagaaattagtatgatttctaggactggctgtgtgttgggcactattgcatcaaacttttaaatcttaatctggccttgggcagtttctttatgtgcatgcacttatcattactcaactcatttctcaaggggacccctgtgcagattgttgaaatcttccttctgttcagctcttttatttttgatattatgccctgtgacctctagctgccttggtcttccccaactttcaattctgtctttcaactcaaagagtctaatggactctaccttggtttctttttttttttaattttttattttattttattattattatactttaagttttagagtacatgtgcacaacgtgcagcaaactatctaccttggtttctattccttgcacaatgattggaaaactccctcaaggcaataagctgaagtaatcatagggctcactttctttctttctttgtttttctctctctcagggatcactgttcatcactgacatatctccattatattgaaaaccactctttgatatattttgctcactgcttgatttttttatgtgggagggtatctctggtccctgttaatccctcttgactagaatagaaagtctggaaacctgaatttgattgataagccaaaaacaaaataaaacagtatgagagccaacatagggcatgtcaaagagaataaaatttctagaaatattgatccagttgtaatcagtaaaataaaatagaaatatttattgtattattttaatccttcaaagggtcctccttgagaaatcaactgagtaatgataagtgcagccaaataatgatgcatgtgataaaactacctaggaccacccaagtacttgatgtgacaattcgcagtgctcatccagaccagggctagtgcttgttcccaccagactggctaaaatgcatcatagttcatggggaaagtacacagaagtacacaccggaatggaccattaaactatgaattatctgtattattattggcagttttcatataattttccatgttgtgtgcctggtttccttttgataggaggctctatctgtactggcagtaacaatatatgtattttttaaacatcatttcaaagaagaaattcaaatttaacactgtacctggccatgcatgaactatatataagtacataatatttcaaaatattttccactttactgataaaatatttattaactttaagtgaagctacacttgtaattcttttctatttgtctcctttttaaatgccaacttttttaacattagttctttctgtcatcagtttcctgaattctgagattttattcttattatacaggttctatatcactggctccagaaatactattttgaagctaccagtgcatgttttcatttatcataaaaatggcatgagaattgcagagttaccttttctttataaacggttctcttttgcagaaagaaatgagttcacagtgaatttatgttcagacgttgaaaaatgtatacacatcacagatgaactcatccataccttcccctcccctgacagttctgccctgtgaactggggtggaaaaatatatactgacattctgaaaataagatgttttattaatagtgtgactttaacttctgagctttagcttgtctaatatgaaaaatagggataataatacatacctcacagaattgttgtgttttttgaggtagatactatatatgaatttcatagaacttgttaagtgttaaaaatgatagctgtattattattagcattaataacatgattatatctttgtgctgagcttcaggtctttacactaaatatgacagtaatagtcccatgccaaaaaagttccaacttgaatagtgaggccaagggagaaccaatgaataggttgctgtaaaaagaaaaaaaaaattctactaaaataagaatcagagaactgagactgggaaatggatctgagagatagttttgtccaacttgctcacttcactgatgagaaaatcaaagctcagatgggttgtagtacattcgacactacaaagtagtgccctgttgtgaagccacaaataagatacaagcagaaattgggaagtgtgattttttttccccctacatccaaactcttcacttgaaaaattgctgcagacctaaacaaggcaagcaatcacaaaactggtaaaatgaaaaggtagttgaaataatttttcaactttgggatttggccttaattatccccccattaattgcactttaatgccctctagagattttaatgctaaataatttcaattttaattttatttatcttactttaaaacaaagagtttgaatttataatctttaaaatactatagatgttgtgtgatttcagaatggggcactctggacagcatttggagagaacagaggcataaccaattaagcccttacagaaatctgagttacaaggggttgtaaacaaatgtttaattcctaaaatatcacgtgaagattaattaagataacacatatgaaagcactttgaaaatgataaagtgtcatataaatctaaggtgctggttatctttgctctttgatactgaattgtatagttgatcatttcataattaattatgaccttcaatttcactttcctttgctactgttaatgaaatgtcttatgcttatcataaaccattccctcaggaggaaaacaagtaagtctctctcagtgagttatagagagaaaatgccagtatggtctgccagtttgaataagaaatttgagagttaggagatgacattttcttcatatgttgatgctgttctctgaggactctatagttgaggccttggtgcctcctttttgcaaacttctgaaataaaaacaaatttcatgctgactccctgcaagagttgaggtaggtcataaagctgatagtagatatgtgttacttaatctgtttttaatagatattaaccattggagtaaagaattaagttaatgaaagtctagtcaacaaaatgcctgtgataggagtgcaaatgtgtcctcatttatagtagcattgaataggcatgggaatggtagttaagtattctacgtatgtaaccgactggacaatcagctccacttacttcttggagtatccatttaattccacctaatttcctgagtgaccgttatatgtaaagcactgtagttaagtaccatggaaagtattgacttaaagagtgattccacgttatacaaaaagctctctggccaacaagattataaacctgaataccagtactattctgggtctaacatgtttctggaccaatccttaacctctttgaatctcagtttcgccatgggaaatgtgctaaaagttattccccatcttgacagacagtaacactaaactcataatgctgtagtttagaagcatgattgttttggaccttttgaagtatatggcagccacgttcaattcctagctacccagatgtggtgcgcagagtgcctcaggcccatggctctccaccgtgccatgtgctgctcagccggggctgagtatcagttaagcataaactaagctctataaaagataatttatttaataccatatttaaaatattttgatagcacagcagactaatattttaaaatgacagcctgaacataatcatgcatctgatttattgcctagattaccagcagtcttttcctaggctatgtgggaagggagtatttcctcagttgtctgagccattttacagtgatggtaccaacatcagcaagtcatttgtcacagaagatggttccacagtttctaaagcaaggagtttagtcacactttatgggattagaatttatttatttatttatttctcttttttttctaatcattgcctacattgtgattatgtctagcagcaggaaaataataataaccaattctactgttcgcttgctaaatgagattgagccattacctatccacatacagcgaagccaacagaacagaatttacattatcactgcttctcactagaatctaagggttttataataaatagcggaaggagttatggagagatctaaattgaatgtcataaaatataaacttagggtcaccaaagagaattaattcacagtcagtaaactagaaaatatcaaatcaagatgcatgtttagagctatcactgtaatattccataggcaggggtgcaaggtgctatgaacttgacttagttttaaattgagaaccaaacagaacttaaataaaatctcccagatctttagggagcagttgggggtacaaacagcaatctttgtgggtaaaaaggactgttctgcaggaatctgtctcagtcagaggaaagagaaccctctacaattaaactagtacatggaaaacggattaggtgaggacaaattttaatatatgagaacagaaagtccttgcagaaaccaggaaaagccaaacaaattgtcccaagggcagaaatgattatgcttgtttattcctctcttcttctctgagagtttattcacctatatctgtttttccatctttccatttgcacacacactcctttcactgtgtccctatctccctcctttccccgcttttccctttcctcgcttctctgcacactgatctgattcttgatcactactcaatagattttcttgtttttcacttccccatggtatatcatagccttggccatgtgtttcccaactctagcactcagtttgctgctggaaacctatttgggtttttcaataattagctcagttcatctttacaaagcaccatacaagtcctgggttattggtctatcaatgattggaacatcttaaaactatcacttgtatgtttcatgtgtggaatggagaccagggaagtcttaatggggcatgctagtcactcatttgtgggttgaagcaatttcccctgagtgtagtattacactacaaccaactgatctagcagcattttcaagatccgaaaactaaaatgccaatctatctctacttggttcattccctcacttcttggatgtaccccttgtgtagaccacctattttgaaagcagaaaaagatcaacacgctagtactgtccctggccaaactgggagtctgcagatccctgttgactcagatccatatggtgtaaaattcagctttctgagcatttttttggttagtatccgccccaacactctgtagataaataattcgttgaacatgtatttaagtgtgaggtactctccacagtgttacagacactgaggtaaatatgtaagacacatgattttttttgccccagagctttcattacaattggagtggagatgatgctgaggctaacatcgtcaacagggggagccagtcctagggaggtaggggagaagtggtcagttctgcctggtgctgccaacttgacttgacaataggatagatatttgactccaaataaaagatgtttaaagcaaggtaatatttgaaagctgggcaaaagaagttttaaataggtaagcaatgtgttgaagaaatattaatggcaaggaagaaatatctaaaacaaaacccaaatcattgcaaatatcattataattataggcatggatatttgtgtggtcatttactgtatctcaaatcctatcatatgtataatacttcacaactaatcattgtcattatgattgttgttatcattttacaaatgagaaacctttgggagaccaatagatttttgctaaataatccatcccaacaagcaaaatggaagaaacacaactcatgcctgtatcttctattatcacataaatatccacttaaaggtgtgtactataaactctaaagcaaccactaaaaagagaaaacaaaaaatgttatggttaaaaagctaataaagtagacttttttttttttttttttttttgagacggagtctcgctctgtcgcccaggctggggtgcagtggcgcgatctcggctcaatgcaagctccgcctcctgggttcaccccattctcctgcctcagcctcccgagtagctgggactacaggcgcccgccaccacgcccagctaatttttgtatttttagtagagacagggtttcaccatgttagccaggatggtctcaatctcctgaccttgtgatccgcctgcctcggcctcccaaagtgctgggattataggtgtgagccaccacgcgcggcctaagtagacaaattttaatatcaaaaatgataaatcctataaagggggtaaaataaacaaatgggggaaaacagaaagcaaatagcaagatgatagactaaaacttaaatatgccaatgatcacattgcataaaaaacatctaaatgccccgaataaaaggcagagattgtcagattgaataaaaaagcaacatgcaagcatatcctgcctgtaagaaatacactttaaataaagacacaaatagttatactactcgtaggtaggctacttagaacactttgcccaacaagaacagaattatctatcattttgaagtactcacaggagatttgtgttgatagcaaataaacacatgaaaatatgcccaatagcattagttattagggaaattcaaattaaaactatgtgaaaatcacatcatacttagtataatagtatgttctttgtcccctagtattatttttttctgcccttttttgaaccacttgaatattttttataattgtatatgatatagtttgttgggttatttatatctcattattttgttattctagttattgctttagagtttattatgtatatatctttaagttataacagcctaccagtaatataatattaatactacttcacatacaatatgagaaagttataataatacacttctagttgtctcctctatacctttatcctgttgtcactaagtgttggtgagaattctcatagaactggaattctgttgttggtgggaatataaaatggtaaaccacttgggaaaagaattcattcctttattgaaaagaaaatatgtgtccatacaaagacttgtatacagatattcatagctgcttttttataataacttaaaactgaaaacaaccccaagtcttcatcaataggtgaatagatatcaataggtgaatagatataagtcgtggtaaatccagagactgaaatactagttaatagtgaaaaggaatgagctgtaggtatacacaatatcttgggtaagtctcaaaataattatggtaagtgacagaattcagacaggaattcttacagtataatttcatctatataaaattatagaaaatgcaaaatgcagactaatttccagtgtaagaaatcagatcagtgttttcctggggagtaaggaaaggaaaggatgagaggaactgattacaaagaatctcaaaggaacttttggagaaacttttgaaatacaactttaattatgttaatcatggtgatgattatataggtgaatgcatatgccaagacctaaaaatattgtacatttcaaatgtatgcagctaattgtattttagttataccccaataaacagttgaagaaaaaactctgacaaaaaataactcattcactgtgttagcagagtcagtattccactaattacaccccacaaattcaagatgatataaaattgctgcttctactatgatgattatgaccacacagtaatatcagtgatcctgaccaccaccatcctttgtggtctggcattaatggtttacagtgttcaacacatctaaaatctaaaatacagtatcatgtgcatttacatccttacatttatggctgagaaaaatgtctcagacttttgtgaaattgtagatagtatagccagaaccccaagttccttaatgggctagttaggatgtaatactgttgtgaattttttatacgttactcattgagttctatataaaaagtcattactcaaaattaaaagaatgtgctatctcaggcatatctactacttgcctttaacatttttccccattagtcttacgacatttgagaccatttttgatacagtccttccaaatttttatgtactttatatatgttactgtaattttcctcacctaagttttgagctacttaaggacaacctcctaaaataattttgggtataaagtaagcataaaaatatgtttaataattattttcaaaagataatttctataattgatttttttaccaatgaaagcatcttctataaacttttactgttaatttaaaaaatttatttgcactattgcttcactcttatttctcctttgttttcaatgacattttcttccaaataattccaaagacatgcctttcttttctgtgcacgatactcaaacattatgatatgaactcagatgttgacatttttatcagcatctccacaatgttttcctgcctgatgaaatgttaagaatgcctttagtcttcattatatgtttgttattttctttcagttatgtttctacccagtaaactttgaagctgattttgactagaattggactgggagggacaataaaatggatagcacttcttttgacttagttaaagcactaaaataagaagtaggaagtaacctcttgagcttttattatgattagatccatatcatcttttttcaccctgtccttacagaacaatgtataaggttaagaaagaacaagatggaaacctaccactaactctgggggaacatttggcatgacttttcactgcaagatgatgcctaaggcgccctctggcattcataggtttattactttatagaactctactaattggcagataattaagtatatgtgctgggaaaatttcatcaaaaaggagacattaactttatctttttaatattgctgctacaagggccatatttaaaatggtttaagacatgctttaataaatatttaattttaagcaattatttgttccttgctttgttccaaggatgaattaaaacaaataattcagttgtatttttcaattgcctgttcaatcacaaggattgagatgaaaccaaatgatttgaacccaatctatttcataatatgagagtaatgttgtagaaaaaaatgatacagttgggggaaattaagtagctgataaattgatgaactggcactccaggcgatctcagattttggaggctactctacagttagagtcctttaagtacaagtagtagccggtgcacagtcagagagaaacaatccccttagataactttctgtttatggaaaagggatcagcgtggcatgcaactcaaaaataactcttatgtcaatgctctctaccgacctaactttccttaccatctttggccactccatcctgacctgagacctctgactattttgcctagtttttgctgtgcctttttaaatattggcacccaactctcttttcaccactttttagaaatcttaccctttttctttatcagccactccttatgagtatggatcttgtgattttagaactccaagaaaattcttaacagccagaagtttctttactgctccctactttagagtcacatgtcaggttaatattctcatgtgagcttgaaagctttagatttctttgagtagacaaaattaatcccctatctggcgagagaggaattgggaagttccctgaggaatggctgaatttctggaaaagcattcactaatgtctaaatgatcctctctaggatcaatgctgttctcaaatgaatcaaatttagtatatcttgatgatcccagggcttcctcaactttgtcgttaagctgtacaatgccgttcttctctccatctccccgacactgatctcttcagtatctttaataatcagactaggttttgtgaatgcactagttattttttttaaatgtaatatctttcttatacttgcaaagcacatactggattttcagttaggacacatccttcttcatcatgcagaactggtcattacacaatcgagccatgtgaaattcttgacatttgacccttttgacctataaaaatggaaatattatatggttcaacctaaagtaatcgctttcatcagaatgatttctatgtgaaccatcagtcttacctctttatcacctagagcacagtatttgttatactttttaaaatataagctatgcttatgtttgatcaaattgggttgttttatgttttattacacaaacttttggaaatattaaatacattcaaacaggtgtctggtaaatttttcattcagatgttcataaacatatttattcaactttagttcttatggcacttaagtttgcattttaatgataaagggcaatactgcagacagatgagtaccagtgccaaaatatgacaggtgttgccaagtgttttgtggtatttgtgcagtgacttggcattttcaaaaattccatctctttgcatttttcacatctagcaaaagagcccagagaggactgaggaataaccaacattactatttgtgaattcttaagaacatttgctccgtttgagataattggttgaagcttagacttaagtggaaaagttaattggaatgtgagatttcctaacatttctccagcagttccttggtgattagtacaatcttctttgtataagcctgtactgtgctgttgtattgctcatgtttgggatgagagggatgttagttgacagtgtttacttttgtgattgcctctcccgattcaagtttggtgttcagataaagtctgtttgggaagctgatggaaccacaacttgttactggcatttccatcattgcctcaaagtttcttgaaagatggcagctcttcttttctagcaaggaaggtgggggaatagctaagagaaaggatgccaggtgtctacagaaatgaatgctgactgatcctgttttcttgccaaaaataaactctggctattgattttgtttaactctttttctctggcaagaaatatttattatctccctagaggtcttttagatgtgggaatgtgaagcttttcattagaatgtttttctgttcagataggctggtaaggaaatagaaaagtattgcatgaatatttatgcctgtattttgtttactgtaggatggatgtgctccctaaaagtcaatataatataaaaagataggttttcaatgatctcatcagcaaatattaaacagtaaaaattcttagtgttaatgagagtacagagaagcagatagaagggtaagcacatacgtgtttctggataacattttagtaatgtgtgtgtatacagatatgcatataatatgcacacctttaaatctagcaaagctacttttaataatttgactaacatattttcacaagtttataaacatatacatatacaaggggttctgtggttctgtgtagtattgcttccaacagtagataaatggaaactacttaaatgtctatctactgtatataggggaatagttaaataaattaggacacagtaatataatgaaatacaatatacttattaaaaagaatgatgtgtcaggatgtacccaatgtgttaagttaaaggggtaaatgatatgtacaatacgatcccatatttgtcacaattcaaagtagatacatgtatctactttgataacaatatatcaaactttttaaaggcaaatactaatactaaataataactttctattaaaatattgacaataacattcagtgagtcaagtaatgaactggatacagctatcacaataagaattgtgctcattgcagacggaaattgatagaggagagttccatatttctgaaaaacccattgtctctctctctctctcttgctctctctccatatatatgtatacatacaagtatacatatataaacatatatgtatgtatatacatacatatacatatatacatatataaacatatgtatacatacatatatacatatataaacatatgtatacatacatatatacatatatacacatacatacatacatatatatatatacacatatatatatatatactttttaaaaaaattgtgacagagtctcactctgtcgcccaggctagagcacaatggcgcaatctctgctcatgggaacctctgcctcccaggctcaagcgattttcctgcctcaggctcctgagtaactgagattacaggcatgtgccacgatgctcgggaaatttttgtatgtttagtagagatgaggatttgccatgttggccaggctgttctcaaactcctgacctcaagtgatccgcctgcctcagcctcccaaagtgctgggattacaggaataagccaccatgcccggccaacactcaatatttttaaaagtctttaaactatccatatacttatacagactgactatataagcattaaaaacaattataatagtttataaagtgctattatttttccaaaacttttatatccacaattttctttccaattcactcattgttactagtgcaaaatgtttattagtctttatacagaggtttccttttctgaaataagaaagttggatcatacactccagaaaaatgctttgtgtttaagatttattatcaagacacaaatgctaagatctttcagaaaaggacaaagaaatactgaaaggactgagagagagaaccaaagatatacttaaagctaaatatgtagttgtatgtattttttcatggcattttctttatgggtttggcatgtggtgtgctggtcatttgcctttcagctcttctattccttaactgctgttatagttttctggtaatttacagaatgcaacagtgggagaaattaaaaccaccaactctcagtcaaatacgaagttgaaaagaatgcatgcattcattccagagatacttacaagtattgcttatgtatctatacactccaaagtgctatactaagtgatacacatgtacacattaatccatttaattcttacaacagtattatgaggtaggtatcattattattatcaccattaaacagaagacaaaaccaaggcaaagagattaagtagtacaatagtcaacaagtggtggaaccaaaagtgaactctcatttttattttttttcttgttaagttttactgtggtataatatacatatgatacaatttattcattttaagtgtgcatctggatttgttcatgtagcctaatgtttttgagtttcattcatgtggggtatgtctcagcaggtggtttctttttaataatgaatactattccattgtatgggtacactacattttgtctcttctccagttggtagaggtttgaattgactctacttttaggtattatgaataatgttgcttgagcccttaatcttaaccagtattctgaactacatctccatcatatgagtgatttttaggtaactactgtaaaaaattttgctatctctagttctgatcatgtatgtagttatatatacagaatcataaatatatgaacacatgtatacatacatatacacatacatatatatcatcaattcaatatgtatatatgtgtaattatgatgtgggatatttctcagccccttcgccagacttgtagaaggggcgccctctctacttgtcccactgcgctcaacctcttgcaggagtgagcaagtgagcgtgggatatagccagctgctctgagtataggagtaagccccatgtgggacctgtggccagaccaggtgtgtcacttcaaggggaacatggcactgcccaggtgagggtgcccacgaccccaaaaccccagagggggtgttacagtgcttctttacttttgttgtccatggatggtggtgtgttagcagctcagttggccccttgcctcatcatgtggggtgggtgccctctgctgacaagtgcaaggggccagtgtgacagccttttcttcctacctgcactcagtgggtcccaagctcttgtctggtgtccaagaagaatgaggtcatgtggacaattgaaggatggtgaaggtggagaattctattgagtgatgaaaacagctctcagcggagaggggagctagagaggggacaggaagttcaggtcatctttgctggagtctcattgtctctccctcaaggtcaggccgtctctcctctactgactgaatctggggtctttataggcacaggatggtgtgtgcatgctgactggtttgtgagtatgcaaaaaaggttaaagtgaagacctcactcaaaggtggacatgaaaacgtagaaaaccaattaggaaagggcaggtatgtataaaatagatgaagggtggggatcagtcagaggatagcacatcaaacaggaagacaagttctgaatccagtccaaggatttaacttgcaactaggctttcaggctttaaactgtattcagctttgaggaggggtttcacctgctacacaaccctatctgcctaggcatctggctgcctcctgtcactatcaattatatacataccttcaacaatatgggtatatatacaaatccacataaaacgatgtatatatccaatcatatatatacacacacagagacataaatatatatacaaaagaatataaaatttaagtattagaatcattataatccctacattataagtttttttgtctcagtgatccattgtaaaaatttccacattgtaaaagatattgctaaacctaaatgtttaataattgattatgattttattgtatcagtatatatacattatttaatcaatctcctgggttttataattaggaaattagaatgtattatattttatatatctatgttgacatgtcctttgctgttaagggtggaatatatttatacatttgaataatgtaattagttacaagcagttacctgtaattaaaaatctaagtgcctagaacatttctatgtgatatatatgtgtgtatatatatatgtgtgtgtgtgtgtgtgtgtgtgtgtgtatgtaatatttaatccccttaaaagtaattatcattacttcagttttatcgattgggcgcagaggctcagtgcaactgagcaactttcccgaagtcgtattgctagtgagtggctccaatggaatttgaactagacaggtctttttctaagctagttctattattccatcatgtctaatacatattgaccttgaaagtgaaatacaaaaaatgtgtaactaatactgtgaatcacagatctttgaatattatagctagaataagaaaaccacaaacaacagcaacagacactgttccagtccctttacagttgtatgatcttttgttcctcattacaaccaatgactttagagattattgatgtttagctctttgttctatggacgggtaaatttttagaaagaacacatatcgccacttaaataaaagtcagatttgggaagataatttccttattaaaatatcaaataaatatcaaacatacatccaaagtggatcttgtttcttcaaacaaatagtttaatttctgctacaataattatgccactaattcaaacaagtatatttgtaatatctaatgaggaattaaaaagagagtataattactcctacctgtgatgtttctcttatttattatgcaaacgattttgaatacctacttgctgcaggcactagagcttggaacaaacaaaaaactcccaggacactttcacacagggatgaatctttatgtgggttttgaaagacaggtaagtgttcaccagaggagtagggaaaagacatccttaatgaggaaaaacatgaatacagggtttgagctgggaaaatacaaggtgaaccaaagaaatggtgaatagaaatcaccacgagcacatgtgcacacttgtgcacacacacacacacacacttctaatttcttgagagaataatctgatctgcctgttcgctgatatctctcttcttaagtggtctctcttttcgtagcaaaatgaacacggggtattttcctaaacaattttttatgtttattattttaataattatattttacattataattttgatagtattttaaaaacttagtattcacttactgttattattcaactgttttaatgttatttattagtcatcaaaacagctgttaaaacaagtttattctgcaactttatctgcggagaaattattagatataaacatataatacaagactttgaaagatttataatctaattgtgggttctagaaggtggttcagggaaattaatgtagtttataaggtcatattttgccctttgtttctatgatctgttaaaacataagtgctttcttcagtcaacccttaaaagccagtgcatgaactcctcttttccttttccaaaagtcatgctaataatataattcctttcttgttcttattttcattgtttcctatgttattgacttctgaaatggatttacagtgccttaatactacaaagaaaaactatgagagaatttaaagtgttgaggactctttttttttttaaactccaatactccaataactaaattgctcctgttaaatgtaggtgagaaaagtttctctgcatcaacactgggttttgaagtcagagtttgtccatctactataatagaatttgaagataatagtgttagggatcttcatgcaataacaagtgagataccgatattgcaatagaagtgggttacataattcatgatcaatcactaataggaaatgtgaaagttgagtgtcttatagtatttccatttgctgggtcagagtttaaggaattaagctgtaactagagaatttaattactgtttgaaaggctgccgtggctgctttgcctcgagatggctctggcaggaggtttctgctgatgattttctcaactgatgccctgccttccaggccgagctagaatgagatcattcataattactagaagatatttgaaactacattttttattgtaacagaaaaaatataaataataaaataacatttttcacaaattctatcacctatattttgatattttgatatatacgcttatagcttattttaatgaatatatatttttatatacgtatatatttattaatcatgtatattcagtagttacttattttatttatttattttttttaagacagagtctcgttctgtcacccaggctggagtgcagtggtgttatctcagttcaatgcaacctccgcctccccagttcaagcgattctcctgccttagcctcctgagtagctggagttgcaggtgtctgccaccatgccaggctaatttgttttgtattctaagtagagacagggtttcaccattttggccaggctggtctcgaactcctgacctcaagtgatctgtccacttcagcctcccaaagtgctaggattacaggcgtgagccactctgcctggtccattatttattttatcagtatatcttttaataaaagctggtacaatactattttaaatattacaggatctttttacaattaaaatatgtagctagaaattttagatattcttaacaaacgtgatttctaatggtgacagcacttactattgagatttttctggtatagttgcagtgtgaagtatattttagttgcttcattagatctagcccaactataagtgcagttttcaatatttaacagctctcttctactatactacttcagcaatgctgttgtattccgagatggttacttgggcaggaatttgtttttttccattgaagtcaggcaatcaggctttactgactatgaaagccatgagcgtttctctaggtagagcgatccatctcatgatgggttaaactctgataacttggccaaaaaaattttgctttaatgataggaaatatctatttagaccatatctaggagactctatatctgaaaatatttgcaaaggtggaataagcaattataaggaaattagtcattttgatgactgccaaaaggaaattggccaaataagtgattggctctgcagagcacagcacctgtaaattagaaactaaaatcaaaacaaaacacagacacacatacaataatactgaggccagaaaaggagtatatttttctttaattttgaatggaataaaagaccttattcccatggaaacaaaaccagctctctctttaacaatgaaaacatttaaaattagaaatatgaatcactctttaagaagagaattatttttaattaaaggaaaactgcaaaacaaataacttggctctagcagtactttatttatcaagtttgtgcagtaaaaattcttaatttctgttgataaaagaaaagccaaattcacaaactggtaaaccctaaacccggggtcttggttaaaaaattattcagttcagaaatggtttagtgagactatgcattctcccactattacacatgatagatttttttcctcttgtatgtgaggatatttctcttgctgtcaaattgtttactacaagagcctaccatttcccagctaaaatgcaaacctgtatattttcataaaagtcaaggtttgtgaaacacattttaaatagctaaggaataccatagaacacagcaagtataaaaactaataagagttcttaaacttatttaaatttatttcagatataatcaaacaaaatgaacttactatgttttttattcttttcctacttgatccaatcagaattgcattaatctcacattaagccacagctttatcaaagaagacattcatttatttcattcaacaagaagttcagatataagtatggtaactcaattatcccttcaaagaacaaagcttattttatcttcctattttaacatttttagtgaagcctgttctacatccatgtttcagggtagtaaagggagaaaaaagaggagacagcatcagaatactattgctcatatctctttggaagaactttgtctaatgtccatctctagttgcaggagaggttgggaaattgcataaaactaaaaaagggaaggaggggagtggtttgaaagattgttgtatgagtgtacttatagcatctgccaccaacaacctctttagcttctcagcatgtatatatgacttttctacatgtatgtttactttaaatgaagtgaattcattctcttcctttcaatgtaggtaatctaaaaattatattcagttactgcatttagcttgaagtccaggatctttctgtagtctcttcacaagcttcaggtttggttctttgtagatcctgggacacaaattaaacactatgtatctttgtccaacactcccaatgtattgtggagagaaaagaaaataggatgacagcaatttaaaatttctgatttagtaagacaggaaatggaaaatacatagtctttgtatgtagcaaccatagagtcctgctggacaggtatattcaggacttcctggtcctagcaacagaagtagtttctgggttagtcaatcttgtatgacctgctactttctagatgaatttcgtttatcagtttccctctactagtttgagtctacatatgggtaaaccttctttgctcattttatcagtgcctacactcaagggtgagtactgtgaaaggtgaaagtaaattaaaaagggctccaaaagaatgaaaagtcattccattatctgcaatatccataaatgaggaccatcccaggaaatccaggcatgtggtcttcctagctggggagatgctctacttggagtctttttttttttcttttaattgctgtgagtgcagggacccaggaattactttaagcacagctgtagccagccaaatgtgagacacattggctaaagtccatctctagttgcaggggaggttgggaaattgcataaaactaaaaaagggaaggagaggagtggtttgaaaggttgttgtatgagtgtacttatagcgtctgccaccaacaacctctttagcttctcagcatgtatatatgacttttgggcagtactgtttcctggagaatttactaggcttccaggagacgggctctaagacaattttatgagcaagtaaccacgtaagcctggacaattttgtctcttatctcttggctcctctgttctgatcaattcatctcccttaacctaatggctgcagcctcagttcctgaaaaataatatgccagggtgagaatgcaacacctttaatttggtttttgccactaagctaccattcattttgactcgaagacctcttaaaggatggtgctggaaaagccctagggcaacaattttatctatttctgaagttgcacttagaagcctctgcttgtacaggtacctttttgtgttcagaatcagctggcttttctcaaccctgcagagttccaaattatgatattctcagtcaatttatattgcaggacactagcacatgaccctcttttgaacatggctgctctcctttgcatctctacctataaactgtctacattcagtttgaatgtatctctgtgtatggtagtatattcttgaaagggggaaacatttgataatcacttgccaacattctgaattttatttcccaccattcccactaataaaaaagcttcaggtggcatggtggtcaaagtttatagtgagcaagatttgaccagctgttttgcaattgcgtatcaaaatgtatcggctttctagcccgaggtgattaaatcttcactctctgtgccagcatctcctccacagagtcagttctatgtttttagactctgttacttgccactcccttcatgctttaaaaattattatgttagtgagtattcttagttgcaaacaacacagtccactttggttagtttaggctgagagattatttgtagactactaggtcactcaagaatgactgtagaggttaaagtactagcttctgaagctactgtgtgggaactgggtcaaattatgtggtgacatttctttggggaaaacaccgatcaatacttttgcccctcgggactaaatagtactgtgaaaccctgtatcacagtactacatagcatccactgttgggggaaaaaaaaagcagttcccatgatatgggcactgtacactgtaccactttgagtttacaccttgcttgaatgcagggtaaatacctggaacatagctacaaaggaatccaggagtgtgagttatctaacttcagtcttcagaagatgagcaatacaaggagggatctagtcaaaatgaaagcagaatgctcgagaggctgggcatccatacatatgcttctccaccacagaatcataaactgaaatctccagtttcaaacccatcacaacacccttacgtaatcttcaacatttgaaacagcagcctcactcttacctttgctctgtgaagtaaaactgtacgtttctgacagtttaaatgtgaaacataatgacaaacttaatattcctcaaaaaaagctgtttggaagagaaaaaatgtaagagctggccagtctttacggggaaaaagtagaaccaatgttagttgcgacaaatattagtaatgtgacaggttaataagaaataattagggttcagggcctagagaaatgctctgtgctattgttgcaactcttctgtaaatctaaaattattctaaaataaagttcatttaattaaaaaaatgaaaaaaacagtcaaccagaaatgcacagagactcaaactcccaagacaaattgcaagtacacttatacaaggaacatcagtggtcatttatagttgtccttcatctattggtatcccatttattttgaacagaaatttggaaagaaagataatattgtctctccctcctttttctatatcatgtatatgtattatgtagaaagacacatgcatatgtgtgtatgtttacccatatagttactactattttgtatggattgctatttgtatgcatatttaaccacttaatacacctttaccttgcttttatagcaaaaactagaagctcaaaaaaatttgcctcaaaatgagatggatattttttcttgtgaaggaatagattctagaaatgtttaccaatctttattatctagagcttgctatttattgtgcctgctatttgcaggtaaaaaatgcattagaactctgtcttccagggcttacataaactctgatgatttatttatcaaaaaatgacaaaaagggacatctttctgcatttgcaatgtattgagagttaagtttaagatgataactgtatcttttgctactctaaaatgccttctatctttttctaagataagaatgaaataaactagtagttgtgtctttgtttctacttagacttttcttctttttgatagcaaagaacttagaatgttagccacttttaatataaattttgggtaaattaccaaaagtgttatcatccaaatatgcttgctacaataatttcaggtgtgggttcatagttatcttgggaattctgagtcaatgggagacagctgtgctcttactattccaactgctctccatggttgatagtgagctttgttagctgctccagacacaatgtcatggattaattcttcctttctccccacaatttctacctcattttactaataaaatagctcaaacttagatatttttatgaatatatttctaagaatgacaaaattattttttcttcaaatgtaaaagggattttattttggtgaaactttacagactttagtgaatatttgttgaaagatacatgccagaaattgtcaataatagatatattaaacataggctctaacttcaaaaagaacgtggaacttgtggaataatggcgtcttatagctaatatggatgaaacattgcctggcactgtgctaactgctataaggtattatctaccatttcccacaagaattttctaagacaagtgttattaccccatgttatttatagataaagtaactgagatttatagaagttaagttaggtagacatagtagttctcaaccctgtcagacccagtgaatcacttttatgtaaaataattcataatgacctattttatgctgaaacaaagtaacgcatgacttaacctatctatagatgtaatttgaaaaatcagtataatgttccaacttaaaatgaaggagaactaaaagtattctaatatgtattttaacgtgtaagggcttggatacaactaccctagaatacatagtagacactggctttcactgttgatagaattaagatgaatgtgaccatttcaaatgcacactgatacaaatactataaatactacagttcaaatattatagttcaaatactttgtgtagtttcgacacaggtgatgtaatttttcaaaatggaaaggaagccttggtgaagttcttaacagcaacaacaaaaccttctttgattagtgattgacatgctagttcctttccaggacatttcagtgtctagtaaatcatgcaaaagacatggtgtttctacctaaaagaattacatcctgagctaaggtaatcatcaatgagttaagaaatttccttaatgcctgatgggtcattttaaatcatgcacactgtcctgtacatggtggggtatctaaatctctagcctattccactgaatgccagtaacgtccgtgaatgttcgtgaaaaccaaaaatgtcccagaaattagtaaaatgctctgtgttgaaaactcctatgttaagtagaaacagtggtgctacaattcgtatataggcccatcagattcaaatattattcttgtatgtgctgtattattttgccttataagttaatgaaagagacattatactcaggaattctcaaatactttttgcaccatgaacctgttgggaagtctagtgaaaaccatagatgtcttttcaaaatgtactttttcatataaaaataaaattcatagaattaaatcaattatattgaaacacagttttagtttaatgataggtacaaataatattttaaggttcataacacttagaatgttatatgtaagtatctgtggttgtattgatgacaaaaatgctgctgtggtttgttgcctatattcataattgaaaatataaagatgatctcttcctctctctatatattataaaatatgttttatacatatatctatattaattatagataatatatagattatatatagagatagatatctatatctatctatatagattatatagataatgcatatataatatgtatattctccttatatgtgtgtgtgtatatacatatataatatatgtattttaatccaagttcaagaatgctcagaactcatccatgaaccctgagataaagcacctgtgctagaggaaatcatgtacaggatacacagaaagcaaagagttgattgcaactaaatggttcaataagttgcaggaaaagtgatatacatcagtttacttgcagattcctaaagattgattggttaacaggcaaagaagcctagggaagagtgtatacaaaaaccacagtgtcagaaaagaccataatatgtgtaggcaatactaagtagcttgcctcaacaaaagagggtgaagaaaacctggaaattaacgatggactagaatgcacagtttgttctttaaatcagaaggattttgctctaattctacttgatttaataatatcttatgtgcttactgggatttttagtttttcaagtccttcagaaaactattattgtcattttgtagtctgtgaagtccacattctcaacacccattgcaataaaattagctttatttttatggtgaagaattttccaagcatggatatttttatcaagataactattgtcaataggaaatatggcataagtgaaaatatcacaagcaaagatttcttacccatatttgattatatctaaatcagttaaaggaaataggatggaatgggatttgattttcccttattaacattatttagcttttcttcagtatagttgcattatgtgcctgcaacatcccatggatagatgaaatgggttatctcatttattatgtagtatattatgcctttctagaatagatagaaaataaagtactaacatcaaatggaatttagagcagttttcaattgttgttaacttatccacatttattttcagtgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttaggtgatttttttttttatctacttgaaaacgagttaaataaaacccctgaatacctgtggcatgtattacattcccatataagtaaaaataaccaatgcctttccaggacattctgttgaactttagatgattcatttcattgacaagaaaaggctattcttttttcaatactgttgaaagactttggtaaatttgaggtgaaaggagaaatccctttccaagaactacctagatgtcttttagagaaaaatgttattgcattcttaatttttaatgtatgaaatacagcttcacaaacccttgccaaatacatgcgaaacaaataacctattatttaatgctatttgacttatttccttcttgtccattaatgaaattttggcaatgaaggaaaaatgtattttgaattgctttcaaatgacggtataacagtaggctttagttgacaaagtcaagtaaacatgtgaactcatgcagactctcttgatgaagatactgagaaggtgattaattggaatgatttaaaaaattattatggaaccagaaattaaataaggtaagttttaatttaacttttactagaataaaataataacatagaattttctgtggtgatttaatagtagtaaaatatatgggtcacctcagtttctgcaaaggcacgatctgaagatgtcttaatcatatcctataaagtgttttaattaaacttttgagggctggctggatatgaattaaagagttgacacattccttgggttacaaagagttaccacttaggataccaacatatgttaacaaattaaaaagtgcttttgactttaaaaaaatctgcatacttttagtaatgaaataattgacaaatggaggtcacattgaattcacaaaactctagattatagaataattcaatgaaagagatatttaatttatctgaacacagatgattcaagttaaactaagaactaattattaaaactatcttaagaaatcttccttaaagaagatttgtactcttatgtattggagtagaatttttacctctgctataatgagccaccccccaaagcttgttttaactattaaatgacttcgtatatgaaaatagaattactaactgagggtaaatttcaggccattaactctgtggaacattcacaaattatttctttatgaaagaggtttatctttatatggacttcttttctgtaatacgttaacatattcttgggtcgaggcagtaaagttgtaattcagaacagaaatttctccaatgtattcttttaacaaaacatatatgagtacctggcacagtggctcacacctgtaatcccaacattttgggaggtggaggagggaggattgcttaaggccaggagtttgagttcagactggacaacatagtgagacccatctctaccaaaaatttaaaaaatattagccaagcatggtgccatgtgcctgtagtcccagctactctggaggctgaggcaggaggatcactcgaatccaggacactgaggctgcagtggactaaaagattatgccactgcatcccagcctgggtcacagagtgagaccttgtaaaaaaaaaataaatacataagaagaagaacaaaaagaaaaaccatgtaccagactatattcagaacttgctgaggaatttgaatatgctgctattagtaaaatcagccatctagctcttatgctgaaactgtccttcagtctatgagatgaaaatgtgatgaaacgcaatattgtaagtctttacctacccaccctcagtagttttttgccctcattgctgatgtttaacctttgagagtgtgtacaggttttaccttttttagctttgtgtaaaatccctaaatacattctatccaaacaaataacctatttctattcttgatacaaccctccttatcacttaaaattcattccactacacaaaggaagttttgactgaaagcctttggtgtccaagcagagcctgcttcccaaagatccttagggatgatgacagttaaaaatcaaagaaccaataaagctcccctggatttctggaaagaggtgtgtgaccaaaaaagaccctaggtcttgcatttctcttggccccagcagagaatttttatttttatttatttatttatttttgagacggagtctcgctctatcccccaggctggagggcagtgtcgcgatcttggctcactgcaagctccgcctcccaggttcacaccattctgctgcctcagcctcccgagtagctgggactacaggcgcctgcaaccacggccggctaatttttttttttttttatttttttttattttttagtggagacggggtttcaccgtgttagccagaatggtctcgatctcctgacctcgtgatcctcccgcctcggcctcccaaaatgctgggattacaggcgtgagccatcgcgccgggcccagcagagaattttaatatttcttgagaatcaactccctctcaaccagtaggaaaatcgcttatgatcctggcacttagaagggaagaatctttgcaacacaaatgacgattaaagaataacagtgaaaagtcagcagacattccacaagagggaagtcatcttcatggtttaactgtaccttatacggctaaagatacagctatgtttagaaagagggccaatttaaagtcctccgcactgactttgtgtcacttacctaaatcctattttcatttgtgaaatgggtcagattgcctctgtgttttgtatctgaaatgggtcttgaacttaggaccctccactacaatcacagcctagattatgcctctatttatcgcaaagctattgctcagtttataccgaacacgtacgcacgcacattttatggctaaattgactatatgttgtttccattcaaataaacagtccagcacttataagttagcctagggtatagactgtaggtctttataaatcactgacaatgaaaactattaacattttgttataaaccagaactttggctcatcttttcaagtacaaagagaagaaaccaagtagtgacagctttcagataaaataatttcctatttatacaccgtttttcttgattttgattgccaaataacttatttaatttcattgtataaactgatcaaatacacagaaatatatgagaattgcagggtcttctgattagtttttttatttggaatatctgtaagacgcttgataattacaataccacaataggcaaatatttttaattgtatttaggggaatcatagttactttttttgcatttttaaatagagacagggtctcactctgttagacaaggtgaagtgccctggtgtgatcatagcttagtataacctcaaactcctgagttcaagagatcctcctgcctcagcctcctaattagctaagactgcaggcaagcaccaacacacctgcctaattaaaaaaaaaaaatgtagagactagatcttgctatgttgcctaggctggtctcaaactcctagcattaagtggtcctcccaccttggcttcccaaaacactgagattataggcaagagctaccacatatggcctcatcatggttacttaataagcagctctgactcagaaaaatagcttttagctacttaagccgtttttttgtttttttgttttttagcttttgagaggtcgtatgagaaaaacattattgtcagacatgactgaccaattgcctttttgctttatcagagaaaaggacagataagtcagctgtatctggggccatacgattgaaaatcaatgtggagataaaaggagaagagaaggttgctccatatcatattcaatatacatgtttacatgaggtaaataaatggaattttactaatacaaaatataagaaatgttcttgattatggattataaaacagaatatttggtttaaaaatcattgaatttgtagagtggttcctggagttctgactctatactacagcaggtgatatactaagatatcataaattctatgtgttgtattacccctgacgaacttgtcatctaatgagagtttagaacaagcctgtgaggcaggtgtgaataggcaataagatgataatgcataagtagatacaaaaaaattaatgttcttccaaagaggaagaagagtgttaaaaatattgattgaagaaatgagtcatgccacatattttggaagcattaaatatgtagtagtttggtattgcaggagaggatcaaatcgtaattgtgtttgagaactccgagttagagttcagattttattgaagatttaattaggactctatttataactagaaacataaaaatgtggtgctgttttgatggcttttgggagccaatgtaataagcagttaatttttcttcctgtttctgagtacaacaagcagtttcatacatactgcacagtcctccgtgttaacctctctttctacaaacatgtgagtatggagaaaatgaagatgtggttactcacccaaaaagtagggcctagttggcttggagagaggtaaacaccacccaacatcaatcaaaagcacagtttcaccagttcccttttgtgtctcagtagagaagcacagacaaatcatcttgggagtctatcaaatgtttgtcgctgagagcttagttagaggtgtcacgggagactttctctgatgcaaatgatacttgtctcatatcaaaaaataggtgaagctgaggaatgtactcttcttcatgtgtttcaaagtaacaaagtaccttcctcagaaaaagacaactgaaagatagttctacttttgtgcatattattttttctacatatattcatgaaaatttatacatgtaaatatttataccccattttactaagaaagaaatgaggaaccgtgtttaaatcgtgtgtatattacacacgatttaggtataggacctaggcttaatttcataatcacagttttgtggttagtgatattattccctcaagagagatggttcatttttcagaccaataaaaagaaatcccttgaactggcatgatggagaattcgggccttaaagtgtgggcagagaagatctgcagtcagagaaacagcagtacacttcactttacaaagtcttttctactggtccaagaaccagaaagaactgaaatctaagaaaaagtccttcagtttaccctggctttatcaaagtagcagttgctaaacttagaagcaaaaaggaattgagagtagtaattttatttcgttacaaaattctccaacattcattttcaacctcgattcattgccctgactcttaccattttgcagcccaaatcctttagtatcatttacacagctaaattttgccttaacatagtcaaaatcagattattcatccagggcactataatttactcagaatgcctgaatgcaaaatacgctctatcatgtagaaatgttttcaggcaaaaacactcacttccttctgcaaatggtttggtatgtacaaaatatttgaatcattgattctgtgtagacccacccaactttactatctaaagtgccttaggaaggtactttatcactttgaacatgaataagggtacattcttcagcctcatctcatattttttgatgtaagacaagtatcatttgcatcagggagtcaccagtgacacctctaactaacctctcagctgcagtgtaatagaatctaattctgagaatggaacttggcgatgtatggtttaataagccttccaggtgattctcatatactttaaagtttgagaacctgtgccttatttgctgaggaaactaaagccttgatttttcctaggttacaaagcctgttactgtcagagacctatccagagctattatgacatcttgtcctaaatattaaactatgtccttccttcccatatttatatcagcgcttttacccaggcagaaatcaaagcagattttgcataaaagatgaattgagttagaataaaaattcaagatattcctattgcttgcagatgctgatgaaacattagaggcaatgacagtgcaagagcattttactggaagttttagttaaatgtttctggcctattctgaggaatcactgaacaattaaaaaccacttgcttttagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgtaagtactacagaacatttacatggtcaatatctctattaaaatataaagaaagaaaggagcgttcatctcacttctaattcaaatgaaactgattaaaaagaggattatatttcactgtgcatgtttgatgctgactactctctcttacagctgtaaagtattaatgacttggtaattcactaccaccatcctccaatccttgttctgtcctccaagtgtggttccttgacaaatagtatcaacagcacctggcaacttagcaatgcaaattatccaccccatcccagacctactgaatcagaaactctgagggtggaatccagcaacctatggtttaacaagtcttccaggtgattctcatatactttaaagtttgagagccagtgacttattccatatctgaggtaactaaagccctggtttgtccaaggtcacaaagcctgttagtgagagagacaggtccagagctattatggtgtcttgttccaaattttagactatgtctttccttctcatatttatatcagtactgctaattcagtaaaacaaagatttatttagcacccatagaacgcaaacagtataaaaaatgtgataccacagaattaacttattataatttcagtgaggatttagaactgaatttcagtaagggtttagtaatgaacagaagtattcattacttccccatagtttcctttttgagacctggtctaattttataagtgcatatggttcagatatataccaggtgtaatttgtaaattatttatattagatgacttttttcatattaacaacaagatctcattttcatgtaaactgaatagatactggtccagataagaagtcaatttcaatcatcttaatgatgaatgaagactgggccaaaatcagtgttcattttcttttgttttttttttttttttgaatgtaagttctggggtacatgtgcagaatgtgcatgtttgttacgtaggtatacatgcgccatggtggtttgctgcacccatcaacccatcatctacattaggtatttctcctaatgctatccctcccttagccgtctacgccccaacaggccccggtgtgtgatgttccccgccctgtgtccatgtgttctcattgttcagctctcacttttgagtgagaacatgcagtgtttggttttctgttcttgtgttagtttgctgagaatgacggtttccagcttcaacaatgtccctgcaaaggacatgaactcatccttttttatagctgcatagtattccatggtgcatatgtgccacattttctttatccagtttatcattgatgggcatttgggttggttccaagtctttgctattatgaacagtgctgtgataaacatacgtgtgcatgagtctttatagtagaatgatttataatcctttgggtatatatctagtaatgggcttgctgggtcaaatggtatttctagttctagatccttgaggaatcaccacactgtgttccacaatggttgaactaatttacactctcatcaacagtgtaaaagcattcctatttctccacatcctctccagcatctgttgtttcctgactttttaatgatcaccattctaactggcatgtgatggtatgtgattgtggttttgatttgcatttctctaatgaccagtgatgatgagcttttttttcatatgtttcttggctgcctaaaggtcttcttttgagaagtgtaagtacatatcctttgcccactttgtaatggggctgtttgtttttttcttgcaaatttgtttaagttctttgtagattctcgatattagccctttgtcaaatggatagattgcaaaaattttctctcattctgtaggttgcctattcactctgatgatagtttcttttgctgtgcagaagctctttagtttaattagatcccatttgtcaattttggcttttgttgccactgcttttgctgttttagtcatgaagtttttggccatacctatgtcctgaatggaattgtctaggttttcttctagggtttttatgcttttaggttttacatttaagtctttaatccatcttgagttaatttttgtaaaatgtgtaaggaagggatccagtttcagctttctgcatatggctagccagttttcccaacaccatttattaaataggaaaccctttccccattgcttgtttgtgtcaggtttgtcaaagatcagatagttgtagatgtgtggcgttattactgaggcctctgttctgttccattggtctctatatctgtgttggtaccagtaccatgctgtttggtttacttaagtcaggtaatgtgatgtgtccagctttgttctttttgcttaggattgtcttggctatgctggctctttttttattccatatgaaatttaaagtagtgtttttctaattctgtgaagaaagtcagtggtagcttgatgaagcatacttcccaaagtaattgatagattcaatgctatcagtgtttcttttcaaagtttactgttcatagcccttaatctctaatcataattctagaacaacataatgtaagcatgaatgataattactgatagagaaattgtgcatgctttttcagtacatagaatgtccttatgctaaataataaagatatatagattcttagatgtgaaaaaaaaataagaaaccttagagatcactcgattgaacctccttctcaaatctagaaactttgttattggatccctgactaatggtcatcatcccttgttcatccacatccagtaatagggagctcactactttggagggaacttgttttataattggtcaaccataatagagtctgtgattttgacatctgttccatcccatgccaaaggctatgattcagaacacctagtataaagttatagcacaattaaaatgcaagtatgatgaacagtctaagggaaatgaattgttctgcctaaagaaaggtaggttacaaaatcaaaacaacctgctgctggatagaatcccattaaaagaaaagattaagttaaatttattctaaaatatctctgggagctgatgttagattcattcatttccatcttttctgtgttctaagaaacacagtcatgttaatatagaaaaatggtaagtatgtatcacatagatcgttggaaagaggagaattagcccttccttattttattacattgtataatgtaactcttgcctctcaatctaagtaaaagataagtatttttctttttttttttttttccagttaatttagaaagcttattttgccaaggttgaggacacgctcccatgacatggtctcaggagttcctgacgacatgtgcccaaggtggtcggggcacagcttggttttatacattttagggagacatgagacattaatatatgtaagatgtacattggttccatccagaaaggcggggtcaactcacagcaaggagggggcttccagggcacaggtagaggagagacaaatggttgctttttttgagtttctgataagcctttaagataagtatttttcaaaaatattttgaatatttatttggtagcaagtgacctgcaggtatattgggtctcattgtatttataaatctcaggaaaggcaaaactcctgttcacactagacaactgtctaagagcaggggttggaatttttttttctgtaaagggccagatagtaaatattttgtagttgtaccagtctctgttacactgcttagctctgcagtactagtgcaaagcagccatagatattaagtaaataaatggaaatggctgtgtgctgataaaactttattttaaaaaacagaaactcggaatttggtcagggtttggcatgagggcatgagggccatagattcactggtctaaggagtgaaaacaaggcagatagaaataaagcaaaagaatgccttaggttttgtgattcattgacaattacacttcagtgacaataatgtggtagattatgtgtacttgtggttatacatttgatttaaaaatatttttatatatcacatgtttcttttagcactgaatacttatcatgacaagcctaacatttttcccagcttagcaaaactttagacaggcttctttctgcctctatcgccctgacgtccgtttcctcccagcccttgcagattccaaatgacctaaacccacaggcctctgacctcctttcccttagagcatttactttagaaaacttacaattgtaaattctttctctgttcctttgagatgtaactaaaaaaaaaaaaaaaaaaacccttacctgatcttgtccctgttgcagtagccttaatgaaaattcccttgtctaattaactttggtgcaatttttgctttggcagtacaaaattttccattactttgccagaagaaaaaaattctgttgacaatctgatcaatcctaaggaaattactaccaacatagatacaatctctattgtaccaataaagattttatgaataccaatattatttattggtattcattagttattagaaattattgtttttatacaaaaatatacgtgtactcattttatctcaatctgttaatataattgtaatctgtaattatatccaggaaagagaatagaatggaacagcatagaggtgcacttcaattctattccacgacttacaaattgaaattttgaagagagaaatcatatctttcattactgcttcataagaagttcttgatacatgatagaaagtcagtacatatttgcaattgagggaatcagaggcagaagctgtttatcagaattacatttatttttaccttctcctagtgtgtttctagatgccagagtttttcagttgccaaaaagaaagtgaaaatgaaaagtttaattgagctgatataggggtctatgtcaccatttatgctgtaataagggtgagagcacactacattgattgatcgtttttaaaaatttgaggaagtttcagagtactgagttcttttttcagtcaagagttgaaatacagctttcagagatagtttccaccatacttttaaaatgatgcttttgcaattgaattgtaacttgagccctaagctattgctggccaagcactaactcaactgaaaaaaaaactgtttatgaataaatctatcttttaatttaaaccggttgactaatgaataggtatttttctgttgttctgaaaccttgcatcagggaacaacaacaataaaagtaaccggaaagccaaccaaccaaccaacgaaagaacaacaaaacctagaacgcaacatttgaagcctgtctcagaagtacttcctcttaattcttaaaaaaacaaaattggaaaactcagctacaaagaagaaatgctgtcttttctctataataaggatacttaaccattttcgaaaaagacaaaagtccttaattctgtggattttcctagacactatttgatcaaaaacagaaatcaaattgtaccttcttttgatatttaaatactctttagggttagccaaatccccgggtaatttcataatcttcctcttttattagagatttcttggtttcttttgagcacattcccatttctttgaagatggatttggagaataaataaataaggggaagtatgttttaagtcagaatctggtagtacactactgaatttttctcttgtgaatttcttttcagacaaaagagtctgaaactattttgctggtaaacctgagcattaggactgaacgtcccagtgctccaaggtacctccagcttactataaagcattcctctttccacagaatattttctgtgagggtaccatttattagccctacctgttacataaaaatgaccctttgttctggagcatgcgtcagtaggagagggattacaattttcctgtttggacaagtgattgatcaaggacctgaagaatttgttcccacatggcaaatgcaaccatccatctaaaataaaaacaattttctaactaatgatagtaagaatgataggctgttccccttctctaaggaacacaccattccacatattttgcatcatggggtgaggcatagaacttgtttccatcatcaatattttgggagttcttgatgcttttcatctatatatgcaatgtgtatgttcctaatagtgttttgacagactaattgttcacagctgaacacatccggggaattctatatcagtcattatggtttaaatcatcctctggagattatttctgtcaagaaaatacattttcttgagtgtttaatcagtcatttattgtaacatgaaggctaagatgtctcacaaagtctgagattctattaggctatggttttgcctctacaatagcaaaggagaggaaagcattaggtcggtgttttttaccttgatgtgcttacaaaacaacctgtaatgtaccctggcactgaccatctttatctaatttatatttaaatcagaactgtttggatacaggttactttaaagtcacagtctgttttaactgctttatccaggagtctatctgtaaaaaagagtgctgcttaatggagtcattcatttgtttaagaaatatttactcagtgcctatcatgtgccagaaacatttctatggttacagcagtgaacaagaagtcagtctagtttctcatgaaccccacattctagaagatgaaattaatttattcaatagattttctgaggatgtaagtatgaggacttatatagaatgtcttagtctgtgaggctgctataaaaaataccatcaattgagtggcttataaacaacagaaatttatttctcacagtcctggatgctagaaggtccaaaattaaggtgccatcagatctggtgtctgacgagggccatttcctggttcatttatggctgtcatttcactgtgtgcaagcttcacatggccaaagggatggaagctctctggggcctcttttataagacaactaaaatcccattcatgaggggctccccacttatgatctaatcacctctcaacagcctcaccacttaatactacaaccttgagtcataggtttcaacatatgagtttttcatgaacacaactgttcagaccacagcacaaggcaatggggaaatagcagtaaaagatagctcttgtctctagtaagctcctgatttagggggaagagaacaaagagattaaatagtaacaagcatgggggctataagggcataggtatagaggaagcaaatccaagcacagatgagaagtgtcagaggaagccgatgggcagcctgagggccccacccttacttgtccttcaacttctgtcttcctctaaaatctgtgccttttatttattttccagtcacacaccattgctcttgtactcaaaatctccataactgggctctagcaacccatagcatctttgagaagctatgatgtttttggtcaaaacagaagtgacatttaagtgtttgagtcatctttagtgacgagaatgaataaaattctaacttatcactgataagttagaatgctgagctgaatttgggggagcaagtgtgatgaatattgttttagtgtatttctaacatcagaaatgcagatagtctttcctttcattttgcatagtatctctgaaattgcttgcaacaatctaagaatcataatcttccttttggtacttctttccaatcaccttgttcttctgttcattgattatttttaaactttagatgaaagtcatttctagtctttgaaaaccacaagttccgtatgatttcggacacctgtccctgaactggcatgtgagttagaggattgttttattttttttgttcaacaatagcaagtgacattaacccagatgtgctatttgaaatacatattagaccaataatattttgactattaatggttaataactttgtagcagttgctttagccaaaaacttgccagtaactatctcattatttgctttttaaatttttttaaaaattgattgataaaattttatgtatttattatatacaacatgatgttttgaagtatatatacattgtaaaatgactaaatctagctaatgaacatatatattactttacatagttatttgtgtcatgagtacacttccacgctgttagcatttttcaagaatacaatgcattgttattaactatcatcaccatgttgtacaataggcattttgaacttatacctcatatccaagtgaaaatttttatgctttaacaaatatctcccagcacccaccctgctagccaactccagctcctggtaactaccattttactctctaattcagtaagttcctctttttttatatatttcacatatgaatgagatgatcatatggtatttttctttctgtgcctggcttatttcatttaacataatgttctccatgttcatccatgttgttgcaaatgataaaatttcctccatttttatggctgaatactattccattgtatgtatatacattttctttatccatttatctgtcaatggacagttacattgatttcatatctcggctattgtgagtaatgctgcaataaatatgggtgtgcggatatttcttgacatactgatttattttctttggctataagcccagtagtggaaataatagattatataatagttctatttttaactttttgaggaagcttcttactgtttgtcataattgctgtaataatttacattaccatcaacagtgtacgagattctgtttgctccacctccttgccaaggcttgttatcttttaccttttttggtaatagccattccaataggagtgaggtgatagcttatcgtggttttaatttgcatttctctgatgattagtgatgttacatatttttcatatactattgggcatttgtatgtcttcttcagggaaatatctattcagatcctttgcccattttttaatcatgttatttgttttcttgctgtttaattatttgagttccttttatattttggatattaacgctttattaaatgtatagttggcaaattttttctcccacattgtagggtggctcctcactttgttgattgtttcctttactgtgaagaagctttttaggttaattcaatcccattgtctatttttgcttttgttgcctgtgcttttgaggttgtaactaatacatcattgcacagaccaatgtcatgcagtttttcctctatgttttcttctagtagttttatagttttgggtcttacattcaagtcttcaatcaatttagagttgatattttatatggtgtgggataagggtgggtcaaattgtattcttctgcatgtggacatccagttttttcaacatcattattaaagagattatccttttctcattggcactcccgttgaaaatcatttgtcagtaaatgtgtggatttatttctgggccctctattctgttccattaatctatgtgtctatttttatgtcagtaccatgtttcattatttgcagtaagtatcatctttttagagtttattactctaacttttcccatggaactaaaattccatttgttgaattcttctgacactagcaccatttacttgcaaaagtaaagtcaaatgttttaatgttaatccattgtttttaatcatgtctttaggggagaatattaaacatttccagagattgcaacagtactttttgaccttttttttttgaagatgtactctctggtttttgaagaagtggtttgcagcacctctgagtcagtcatttttaattattggttgtacttgtaatcctatttccaccctgagaataatttaagtagtgttagaactgtagctgttaaaagtaaatgattttcaatgaatatggttagaagcaagaaaaagtttgccttggctgtaactacacataaagagagaacccatgcaaactcagaggcggacatcttgccaaattgaacctcctatagaagcccattagctgaaagctctgcaaagagcaatgattgcctcaggctgacttctgtgtccagtgctttcttgctatttttcctaacccctggctgcaatagaatcaaatgctcatggtggagagaagtgatgaatgcagccggacacagccaacatgttatttatattcagaaaggcatagcatgttagagcatgtaagggttagatcttctaaaaatcctttcattttgcagatggaaaaactgaatctagaagtgatgaagtcactttttaaggtcacagaagacggctaggtttagcatgaagcatctttatgccttggtactcttaactctaaattggccacccagattccttttatcccgcctcattttatatatctatatctatatctatatctatatctatatctatatatatgtacatacacacacacacatgcacacacactttgctgaccatttcttcaaggtttcaaagaaatgtagccactaatactgattcatatttttccttttgtaagatttgtctgtttttcttttttccttcaaccatccaagaaatgtttactttgatacatactactaccacctttatcacatcaattgcctaatcatttactatttagagtcatgaaaaggcaagttcaacatagactattgttttggtactaggagctaccttccttaatttagcatgcttttaagcacagtttctagaaaaggataggtatttttaccaaactggggaaaaaattattgtaatgacctgaaaattctgttgctcagtttcagtattttattttgcaaaatcagtatcaaatgagtaagcttttaatcttggctgtcaaccatttgtttaaatcccaagtcactagttatttttaagaagttaattttaatgtaagttctaacaggtggcaactactcctaagtattgtatctttaatctttaggtgtattaaaaactgtttaatttaactataactaaatgtattactcatatttaaatttttgacatatttacatttcctttcaatcaaacaacaaaagttttgctgattaattagctcacaagaaaaacactatggtaatgctaagttgttattgaaactggtaataaaatatctagtggaaagaaaagtagcattaagtgaaatgcttggtttttcttattagccttttttgattttcacatattcaccattctcatacctttattttgcgttaggaacttatgcaccaagatcatttcattaatatctttaaaattcttgatatattttactaagtaatattaaactggtatctattttacagtaattttattataccatgaggcatgtactcctaactagaaattacttgtcagtaatacattttgaaagagaaaagtcattttgtcagcgatttgtttgacttcttcaacaaaattcttgttcaatgatattttaaaacattataggttatacaattttgcatgatgtactttaaagtttatgtagttttcttcaaaaggaaaatatgtacaaataatttagtcaaacaagaataaaaaacatgttaaattatcttattagtgcttaaggttacaaagagacttttaaaatcaacaataggcaaaatttgaattagcaaaatttaagatgtatattttacatatttttttctggttagggtaataaaacacgttaatgctacatttaaaaatatacaatgtacattttttaaataacaaaaatgtataacgccaaccagagataacactatgatcatattcagcagtatttcctgctgggtgtttgtttttgtgttttcatgtagacatatacacatatctatttgtgtttggtgtgcatgtgtgtgtgtgtgtgttgaaatagtgaaatgtttttatcctgcttgttttggcaactttcagggtttctttgaatacgtgtttgctgaccacctggatgttgtcagcatccacctgtaaactttgaaagaccagcccctaaaaattttccactttctgccatttctttattcaaatgaagcactcttttagactgggggaaaatattttttagcttctattggtgagttttctaagtatatttctttttctgaacaatgtaaacaaccagtaaattttgtcttgctaaaagcagagcataaaagattctacataatccccagggtatattgttcccagggttcttccagccctttcttctaagtagcttcacatcccattgctcattccctattgtacaggcagtattagaatcttgggagttttatgctctttaatggatatagagtgagaaggtgtgggaaaggagaaacagctttactgcctggggagtccattagcatgaaatagggagggattgatagccttgcttggcagcagtctaggccccagatctctgataaagggggcagacattggaaggtttctagaaataccctcccattcctctctgtcaggttagtgttttaggagtttatatatcagcagtcactgaatagttctccatctagccagctgcctaaagttagaaaaagttccttccagaaactgggaaatctttgattggtaaccttaatttccaatacggttgtgattttgcatcctttttggttttcttggaagtttccatgggatgcttagagggattgagtcaggtgcagctagctaccatccatcatgccccagaaatcacctcagttaattttaatcaaaatgtaaaatatttctgtcagctttctaagaggaatactggcctaatgctttaaaaaagttaaaatgctgctttcagtttactgattataagtagaatattattcgccttcaaagtagccattgttattacagtgttaactgctaagtacttccgccacattttcacaacataattggatgtcttcataaactgtcatactcaagcatatgtcctgtacactctaactctacatcaatacctttagtttatatttgggttcatattactttaatttgttttaattaagtaatgtttcttggtcaattagtatgcacaagaaaacactgtgctaaatatgggctggatatatatcttaaattttgctgattcaaattttgcctattgttgactttaagagtctctttgtaacctcaagtactaagaagaaagataattcaacttgtttttttattctttgataaactaaaaacttatgtatatttctctttgtttttgtaaataaaactgcataacctttaaagtatataatgtaaaactgtataaagctataatacttattggggaataagtcaaacaaatcaataacacaatgcttttttttctttcaaaagttatcaaagcataaaccaaacacattccagaaggaacagatacgtatacaagtaatacacaatattgaagaaagagggccaaagtaaataaaatcattatgtcaaagatatatctgtagtcccatgttcattgcagcattagtcacaataactaagacatggaatcaacctaagtgttagtcaatgggtgaatgtattgagaaaatgtactatgtactcacaatggaatacttttagccttaaaaaaaagaatgaaatcttgtcatttgcaacaagatggttaaaccctgggaatattatggttaagggaaataaggcaggcacagaaagacaaatactgcataatctcacttatatgtggcatcaaaaaaaaaaaacaaaacaaaactggaattcacggaaataaagagcggaatggtgattaccagggtcttagggaaaggaggcggattgtggagctattggtcaaggaatacaaaattttagttagatgggaggaataaattccagaaattcattttacaacatggtgactatagttaataacaatgtgttgtattcttgaaaagagcaaagcgaatagattttatgttttctcaccacaaaaaaagataagtatgggaggtagtgcaaatgttaattagcttaattcagccattccatattgtatacatatttcaaaccaacatattgtacatgataaacatgtaatttttatttgtcaattaaaaataaagaattttttttataaagagagtgaggaggataaattaagagaagctataccatggtggatggttaagaaggagtctctaaagatacactgcctgaattccagtctttgagagagaaccttacctgctctgtgactttaaagaaaaaaagaattagaaaaggaaagaaatgtttaattatgacaaatacagagaggacattagacttcagaaacattggcaaaacaaaaacaattaagtatttaaagactaagttggaattactaaggttacctagtttacttggtgttttcatgctgttcatgataggaacagcagctttccatcttgattttatattttcagagatcattctaaatcttcagttataacattgtcaaagtcaggctgaaaattgttttgttaggaagtttgggtactacagaaaaattcaaggttttatatcttagagatcagaagcagacagtaattctgtgatatttggattatctccaggtacaaagtatttttttttccttctgactgtggtatgtgaagtggtcgttcttaatgaaagcatggcaggagtgtccattttcacttctacactttctaaattgtttttctgcttccactgccgactcatttgaatccatctttataccacttcagagtcatcttttcaaattaatctgataatgctagctctttctgcagaaatctcaggtaacttcatgtagttcacaagagaaaatcaaaactccttggctagatattgtaccaatcaaggtttggccttgacctactttaccttggtcatcccctggtacctcttcactttccatcttatttcctcttagtgcaaactcctgtcactctattaacattgatcttgctaaggtcatgatgatgtttatttgtcaagtcaaataacttcttttctgtcctattttataagactcttactgcacttaacagtatcaatcatccttttatcaagattatcctgattccagtttcctgggtttacttttacctatctagtatttatttagtctcaattatagaatttactttttttcttcttgtataatttcctttcatatggctatttcccaggtgacattctctaacatttcttcatttattgtacatattttccctaggtaatcttatcctttctcatggtttttgataattcatgatgatgatcccaaatctaggtgtttagtccatgtctccaaaaaccagtaacattcctacatggaagctctatgagcaccttaagctcatagttgactagatacattatccccaccttcaatttttttcaatttttagttcccagctcacttggcagaagaaccattcacgtagtcactcaaactagaaccttgaaacttaaccttttctcttccccatcctgctctccttatgaattctaagtcctgacagttattcctctctgaatatttctcaaatccatttcctcctcatcatctacacacaactactctagttcagacatccatcgtctcttctcttcatagcctcctaattggactctttactttcaccttccttaaactcatcctcctacatgctccttccatcaaattaacctatttaaaatccagatctgattatttcacttcctaagacatgttgaagaactagagttccttgctaatactttttaacttatatttactctaagattttgaactttctccaaaaatgttttttgatgcatagaatagatccaacttacctaacatgttacataagactctctgtaaacccctcagacttatctttggccataccaatcctaattgttctcctggaaatttgtgctctgttaacctaatattgctggagttcactttacacaatattttctttctttccatagtgccttgatttgtacttttccattcctctggaatacattctttatccatcaatgatatcaaactctatgccacgcttggctatctcttagtcattcattgactgttagcccagcctcatctcaagacatctcccctgaccctcctcaccaggctgtgatatacacattctaactgagtgtcttcatagcactcttctatgcctttttcataatttttgcataactgtacaaaatttattacatgaccgattcccccagcagtctataagcagattcattactgcatatccaaagctaatatagcatctgccatgtaagtgtgctcagtaaatatttgttggaccaacttgtagagaagctaagctcttcactctttcatgatcattacctcaactctcattctgtagtccttgtgtttccttctgacttctcctctcttcaccgctatgggattcaattcggcctttggaggattgccctgcacctccaagcctgctcctccatcctatggcccacccaaaccttttggctgcctctatgattgcactttctgctgtacaacaaaattaggattcgaggtatgtgcttctcttttaagagtatgcattttattagatgaagactatgttttaatcaactccacatccttaccattaagaagagtaccaggaatacagtaagtacataaccagtgaagaaagagtactctgaccagatggcttgaataggaaaaaaatggttaaatactataaaactcttagaataaattataatactaattctaatcaattttcatagatgaatgtattataattactatttgactatacattgaagttatttttaaaagagaagcttaaagtgtgaatgtaagttggacattacttttttctaacttttctgtgaataacatatgttagcactaatgataaacgtgtggtgaagattgtattaaactatataactcaagactacacttatttacatgacgtttcctgaattattcaaattttcacatataacctatgaattatttattaacctctcattttgatcatgaaacactgctctggcattcaaaaaccacagtttcttagggtatttttatcatcaagatatttgcttaaccatctcaaagtataaaataggcaaagggtggtttttgatacttctaatcttcccatattgcatttgtatttccctcagatgacttttaagtagtgagcaatgttcaataattgtgtcatttactttcaaatttatttagtttattttaaactgacagataaaattatacatatttatcatgtacaatatgatgccttgaggcacatatactctgtggtatgattaaatctagctgattaacgtatacatcatctcacatagttatcatttttgtgggagaacttttaacatccgttctcctagcgtttttcacaaatacaatatatcatcattaactatagtcaccattctgtaaaatagatctttaggacttatccccccatttaataaaatgttatatcctttgaccaggatcttcccaaccctgcaccccctaactgctccaacctctagtaactacctttcaactctctacttctctgacttcaacctttcagactgtacatatgagtgagatcatgctgtatttgtctttctgtgtctggcttatttcacataatgtcctccaggttcatccatgttgttgcaaatggcaggatttccttctttttatgactgaacagtattctctgatgtatataaccatattttctttatccattcatctactgatagatacttaggttgattctattccttggctgttgtgctgcaatacacatgggagtgcagatatctctttgacgtgctgatttcgtcttatttgtagatatatccattaatgggaatgatgaatcatatgattgtcctattttttagttttttgaagaaccaccatactatttcccttaatggctgtactaatttacattcccaccaacagtatacagggttcccttttctccacatccttgcaaaacacttcttacctcttatcttttgggtaatagccattctaataggagtgaggtaatatctgatgtggtcttaatcggcatttccctgatgattggtgatgttgaactttttttatatatacctttcagccttttctgtgtcttcttttgaaaactgcctatgtgggtcttttgcccatttttactcggattatttgttttcttgctactgagttattcaaggttcttatatggtttgggtattaacaccttatcagatgtacagttgacattttgttacagttgattacagttgacagttgatattttctctcatcctgcaggttatctcttcactctcttgagtttttcctttgctgtgcagaaactttttaatttgatgtgctcttgtttatctggttttgcttcttttgcctgtgcttttgaggtcatatcaaaaaaataattatgtcattttttacataaatcttttagtttcacttataaaaatcatcctgtgaatgccttaagtaagttattcctgtgtcgctctactatttatgcttgaagtaaccactaagctgctgttgcttccttaaccaagcaccaaaaatctcaaggtggcagctaaaaaagtaaagccaagtaatatggctgctttatgagagcaccaatcctttctaaaaccaagaacaagattactcagcctgatgacctccagtatccctctaaaaagacaatgcagggtctgggtaataacccccttgtttttgagtgtcctaacaatttattttcaaaattgactatggcatttctatatctcttcttccccctagttcttttattgtcacctacaccattttaggcattacattttccacaacttttgacctgtgattttagtctgacaaatgtaattacttgtgaattgttgaaaaaaaaaaaaaagaaatgtgatagcatagctctaagaatttttaatttctatttttaactaatattttttgttaaataaataatattgtttgtggattcttaatacatattaattataatcaattcagtgtataataaagtcataacacttatcatttccttaaagaagcagtcattaataatcgaaatccagggttaatttgcacaaatcatggaactcacatagcataaatttttattcgtgattcttaaagatgcacctttaaagatttaaccttttttgttaatcagtattatgacaaagtaggtagcaaggtgcctggttaagatataagaaaagccacagttttcaggaccatcatttattttttgtgagtgccactcagggcagctatttatgtatgtgttcaataatacaaaattcagaaatgtctagatgctttggtggcatagtaagatatgagagcaaaataggatcacattatatagtgaaattttctttcctccatgtatattttatctttcacttttatcataagctgtgctttccattttcaagtcttttgttgtagttcaaatgaaaaaggtttccttgagagaagtaacaaacttggacccttgatgcttctgatgggtataaatgataccattattcaaggtttaaaagaaatgatctttaagcataaagctggcattattcaatctgttctcactattcatctgtttgcctaattaaatcttgtctgtaacaaagtgcttagaaaagagaattgcttacagaagatatttctttctgaaaaatcatacaaactggactcaagtcagaggttaaattgacttattaattcaatgtatattgagaggagggtgtcttgctactttacaactgtgagaggcatacaaatgcaaaacaacattttggtgaaaatatgacatttcaggaaccaaaataagtagaagcagggttgaggaagtagggaaactcctgcgcagttgctttccgatggtgctaaattccactggaaattgtacttttggtgcatacatgcaacattcaaagttgagtttacacatctttgtggcaaattacgttcttttttttaaagacacatttattccgcatcatgatcaaactattacatttagcaatcaacatcaagggtgcaaaaaatatctgcattaaaaacgttcactggaatgctttacacaaaacagaaactaaaataacgtgttatacaattggtcacaaatataatccttgagattttggcccatacacatgagtattgtctaaaacacatcttctttgacagcagcaagccctgtcaccactgtgcccagctgaattcacaactgtgttgtaacccatagcttccttgtcacttctctggctctcttctcctgctaaactttgtttcctggcagtaattaagatcttctgccactgccatagctactgctgctactggaaccaccatgaccaccttggtttcctggttggcaaagtattggcctccatgaccacaggaactagagcttctgcctccaaagtttctacccttcattcatccaaaatttgaagattgaatcctatcattgccaaaattgttgtagcttccactacttccgaaactgcttccattattaccaaatccattatattcatccccactgccaccatatccactaccaccacagctgccaccaaagccacacagtcactaacgtttcctccatgaccaaagttgttattcccccgaaaccgcctccatggccaccaccaaagcttttaggaccactttgacctcttcaactgggtgaggcactagccatctcttgctctgacagggcttttcttacttcacagttgtggccattcacagtaaggtgtttctgaatgacagccttatttatggagccatggtcatcaaaggttacacaagcaagaccccttttcttgccactgcctcagctatgatttcaatcacttcaatttccctgtactgttcaaaataatctcttgggtgatgtccttcaatgtcttctttaatgccacccaccaagatctttttcaaatttaagtgggtacctggtctttgagaatcttctcttgagacagctctctttgtttccacaactcttgcatctgcctttgcggccttgcgttcatggctacatccacctcctccacagtggcatatgtgacaaacccaaagcccctggagtgctgggtatttgggtttctcattaccacatagcctgtgagtgttccccgtcacccctcagactcacattaacttttttcaaagcttaaccctctgatgcagagcttctgcagctgttcaggctctttcaaaaactgacttcgacatgacaacagtggcaagggagactttaacaatgctttctcggcagcgtccatgggcaaaaagggcaaattacactctaattaaggcactttacatttgtgaatgggaaattttcagaaggccaaaattgtttttctttcaattagagattgtgcagttttctctccttttcatagatgtagctgtggaattaattgctgatgttagaagctctgttgttgtatgaattaattaatttctgtcttaaaaacactttatgttttttgtctttcaggcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtgtaagtataattttttaaactttaaaattcctagcagcttatgggagttacatttcaagagactttgaacttaagatattcctggaatcttattgcagaaaggacattttagggaatagcgtaatgggttccagctcaaagttcatttgaaacatttttagtaaattaactttgacaatcaataagaattttcattagattgaatcttcatatcttaaaggatctttttcagtgagggaaaaacatacattttataagagaatgctgggactttatagggaattctcaacatatgcaaatttggtattcaacatttcagattcactgtcttgtagatatagttccctagtaagtgtgagcttggctgccatctctggaacatattaggctccatttgcacttcctattggttccttctggtactgatggatagtggcacatcctctaagtaaaacatggcatgtgtttaaggagcctacaaaaaacaatctgtgcctaattaaggctgtccatctgacatatgcaaaggcatcaagaatgcattgaaaagtagaaattcagggaatcaaaggagccccaagaattcgtctgttgcatccatcagtgtaactctttctctgcaagtatactgtaactgaaattggcaagactggaaataggatataaactaagagtatttctagtaaagtggtaagagtcagaattaaaaatgagtggagatggagaagagaggatagataccaaaggttttcagggcataaaatcagcagcctcaatagcatttggtatgtttggggacatggacagggagggaaggagaagatgcctggaaatattcccaggtttctggtcagggcaaatgggtaggcagtagcgctgttcagtaatcctgtgagacaggttttttgttctctttttttttttttcatggaggaaactaagatcagttgtgggaagatgatttttcatggcacaatgttgtttccactgcacttccaatttagtttactgaatatatttttgttacagagtatattgtttagaaatcaaattttgagttatgtgtcatagaaaagaaacagttgagacacagcaaataaaagagtgaaaacccaatagggaaaaagatgtgctcctgtgtttactctttttctgtccttttcctctgaaagagaaatgcatgcgaggtgtatgaagtgaattagaataatcaaaggaaagtataattgttatttaatgccaaatcaaataaaatgccagtaaaggagactactctttgggttaggagttatgcagtttcactttttgttgaaatttagcaagtcagtttagtcgtctaagcctcagttcctcaacatgctcaatgaagaagataattcttactttaacatgtttctcaaatttaaaataatgataaaatgagataaaagatggcaagccagttgataaaagctaaaagtgtcagtgtataaaatatgagaattttgtctctcctgccttacctacagtataacctacagtatcagctacttttgttagacagattgactcttgcagaagctggaaccaaagaacgttccctagccagttcaacaaaatcctgttgttaccaaataccagatcatagaacagctttgttataaaaacctcatcttagtaacagcacttgctgtcttgggattttacctataatataaagcatgctgcactatgaaattgttttgcttctaatattccgtctgtgtatattgtgaagaaaaagccaacatcatggaacattgagcctttctccctctgagaaagatgtgtttaagtgattaatatccaccataaaaactacctagaggaaaattagataacatgctcctttacttcatgttgacccaaagaagagacagcagattgatttcagtacattttagtatttcagtggcagtgtagttataacaaacttccttttgtaaatccaataacttattatagaatagggccaaaagaaagagaaatgtttcttcaaactacatcagaaaagttggtgatttggtatataaatttgactatatttttctagctatcaaaaataatgccatttgatgagtcaaatatacctaagtatatctcctgcctctacattggaacctcaggtttttattcacctaactgttaaagctgattctgtcatctgggacacattgacaattatatgctcccttcttgatccttctcaaaggtgcatagcccacacattttgagactccaaaccagtagaaaaagctttcttacctatgagaattgtaaaacaaatctttaagaaaagaaaaccattttacatttagaccttttcaagtataaatcttatttgaaatcatgatgtggatgaaatatgttcaaaaataaagtgaaaaggacagaacccttgggtgtacagaagagatgcaagcaaagtttacctaggaaaatggctagaccaattggatgacagtgatttttttttaaaatgtgattttatcgcaccattgcactccagcctgggcaacagaatgagaccctgtctctaaaaaaaaagtgataactgtaaaaggtaaggtaaactattttgggaaaagggtagtatatcatataattaactgtcatagagagttcaagtaaaatggagaaagaaattagcccattgaatttggcaagtagaatgtcattggtcagtgaagcaattgaggttgaagcctgatttcacgaagtttgttcagtgaatggcatataacaagcttgtccaacccacagcccgtgggccacatgcagcccagagtggctttgaatatagcccaatacaaattcgtaaactttcttaaaacattgtgagacttatgcatgattttttttattcctcatcagctatcattagtgttagcgtatttcatgtgtggcccaagacaattcttctttttctattgtggctcatggaagccaaaagattgaatatccctggcatagaagcacagttatataaattaaagctcaattattccataaatatgatacagtcattaaaaatcgagtttttatggaagaggttcaataattgagcagtgcccatgataataataaatgaaaaaagtatgctaaaaaactctatatgcaatttaattccaacattgaaggcacacacacacatacatacacacacttacacacacacatacaggtttagagataagactggaaggaaatgtggtcaaataccaaagacatagccacctagttgggttatagctgacattttgttggttttgttttgtatgaatctttatacaacagtctttttgttattattttactttaagttccagggtacatgtgcacaacgtgcagttttgttacataggtatacttgtgccatgttggtttgctgcacccgccaactcatcatttacattaggtgtttctcctaatgctatccctcccccagcccctcacccctcgacaggccccggtgtgtgatgttcccctccctgcatccatatgttctcattgttcacctcccactcgtgagtgagaacatgtggtgtttgcttttctgttcttgtgttactttgctgagaatgatgtctaaaattttttataaaataccttaagtctgtattaactttataacaacattctgaaagaaagcgtgaaattggatgaggaaacagactattctttcaaggaacttaaatcagaagataaaaagagagattgggcaagggtaagaaggtttttccatataaaaagagactttatttttattatctgcttgggtagggatttttaaactatttaataaggtaaatataaacatgtttatagagtgttaggaaaggagttagttgcaagagtgaggttgtgaatttctcagatgggagaataagtgactataagtactatctcagaggaaacgaaggaagtgcagtcatgagggcagaaggagaggctagcctttagaatgagaaaggacaaactctgttctgaaattcaaggaaatagtgtgagagtccttgcagagaacactaagcttttgatatagaagtgaaaagttggggtagttgtaccttattttttaatccttctttaaagttgtcaggaaagacaagtgttgctcatttacaaaacaatgggctgtgaaatggttgcagaggggaagggggttggtaaaagtttggataagctactgaggggaatacaaaaaagaatgtttcagggacatgtaaaagaaattcctagtaaactgaaagtgtcatttgctgttgggcactataaatgtgttgtcacaattcttgtgacagtgagactttcttagagtgtgtcagcatcctgatgcttatctactaggagataaagctgatggttggattgactctaggctgaaattttgcagaaaagaggccatgggaaggtaaggaaattcatataaagataatggggtgaaggtaaagtgatttgccattagctctagtttttggtaagtggaaccatgagaagcatgatggatagcaagagagaaggaggggagaagtggggaaagggacagagagagtggaagagagaaaacaggcagagacagaggattgtgggaggaacatattaatagcacctttcagttaacattttgcaagggaagtctcaggtccaaaaggtaactcagggagtagattgttgaaaattgattgtagaacagtggtatgctacaactggctggtacctgctcatgagaactgatcagtaaattttcaggaatattgcaagcttgttaaacacagccatccttgaaattggacatattaaaagtatttacaacatgaaagttagcaaatgctaaaaatcaaggctttttgctttcagagagccactttaccagcgcatcactgagtataaatgttatttggagtccagacaaagaactttactagataaagtgtctctatgtgtgttgaacgcactcatgggtagatcaggagttgaaaagtaacaaaattccatgaggtgggaggcagtcaatattttaattttgaaggtgtctttaggaaatttatttagtgaattatcttgaaatacaaatatcaaataaatcaattgtaaaattaatatttttgagctgtttatttacttgagtatatacatgctcaatatatataaccaagtataagtgatatttttattgactgaccaacctctataatattttctttctacacatttttggctgcattttctttgatcacgtcatatgacaaaaaaattgaaatattatttttataatttttttttttacttagctgagttgacatattttttaatggacgctttagaagagtttatttcactttcacaatgccacatgcgttttagtgattttcataaaatttgggaaaacaccaattatttttttcatatgtgatgtaaaagcaaaaattacagctgacaaagttaaacaggcaaggcaaactttattcaagactattgcaatagggaagagaggccagagctcaattagagctcaactccactgaaatgaaaggcagggctgaaataaggagaaagtattgaaggatgatagtggggaggttgatcaatgggatgtaaccagtgcactgagtaattttgagtctgtaattttttcttctgcgattaggccatctttgtttgctaattacaggcatggaagttagggtcctatcttcccaaagagggtgggaggtaggagtgctctctccttgatgattacatttcaaagggaaggctcccaagtctttcagaaaggcattcttggattatgaaactggcaagaggctttaaaaaatatttccatgtgaaggggcagaaaaagaatttactgttacaacttttctaaataaaatgctttaagaaaagggaggtcgagacctagagtcaggaagaagcctatctaaagtttaaccaggctgaggggaaggctaagcgtgtcttgatcagtgaacaataacatttcaatgcttttcaagttttcctgtgaagcgactctttaaatatactttgaattgatgaaatttattaattattttgtcattgaaagcatcattttagtggcctttcataatagtatgatatttctgttggtatcagaattaatctcaaatcaataagagctataaatatatgtccaatatgttcatgtttaacactaattgaattatttaaaaattaccaaaattgcctatgcattacttctgtttgaaaagtctttcttaatgaattgctgtttttggtatgatctggaaaaaaactgttacaatttgcttgtcgtgttctgaattatttttatcttattcctgaaaattttacaaaaatctaagatagcatgaatacatagctagcacctcccaggggtgctaaagaaggtgagggctgaagagcttaagcatcattagcttctggttaaattcatccctgctgttgaagccagactttgagaaagaaagaaagaaaataatgagagatgctgaggatgatgcagaggttatcataccccttccttacaagagcttttccttccagggttccccaaatcctggggggaacttcctgaaggtgcacactccgaggagcaactacctcttccccctgcccatgggccaaatgcagtccactaactcaccaactggttttgtaaggcccataagctaagaatattttttaatattttctaatgttgaaaaaaaattttaaagactgttattttgtgaaacattaaaactatctaaaattcaaatttccacatccataaatcaagtttcactggaaaataatcatgcctattagtttacatattgtctatggcagctactgtgctatagtgtcagactgaatagttgagacagggttggcaaagtgaaaaatatttactaactagccctttgtagatagtttgccaatccctggtctagttattctggtcaactaattaaaccaagttttttttttttttttttttgcttggatttaccttttatttattttaaaaatttatttaaatttctaattggatacgtaatagttgtacatatttatggggtacaagataaattttgatacatgcatacaatatgtaatgataaaatcggaataactggaatatcgatcatctcaagcatttatcatttcttcatgttgggaacattccaattccactcttttagttattttgaaatacacaaccaattattgttaactatagttgccctattgtgctaccaaacactggatcttattccttgtaactgtatttttgaacctattatagtatttattattatttttattattgatttgccccctgctagacatatgtggcccttatttaataaaaaaactgaataatgtggcagttttagatattgtgccatgtcccttggggaaacattttttaatcacccagtctttcgttattccacaaatcacaccctacaggcagtaggcttgctctgctctgcaaagggaatctcactctagttaaatagaaatgttgtaaataaaattaaagttcaagctgtcctgctgtttaaagaatctctatgaaaattcaatcagcagcatacttttaatttcacatcatctgatgttgttctggctttcagtgacaagaagcccagcagttttcttcacagttttctattttccttgaatgtaaattttccagctaggcactgaagactaggtagggaaaccaaatgtgtgaactttatcagtcagaaatcttttcaactccatgaaacagaaactcatgaaatacatttaactaaataagatttccccctttgctccccaactcatggaacctaagtccacagaggtagggaattcagagctggtatagctgctcagtattgtaatattttaaaagagtgggcagatggggtaggatggatgtaggcaatccttttttttttccattcgttctttccattttcatctaatgggcatgaaataagcactctatcttctggaggctattagagttttaggtgggaaaagggaagaaacacagagggcaaaagttgaaaagtctgaatgctatacctaacaaagaattatacagcaaacactaatgtaacaaacactatctgccaagcactctttttaaatctttcaaaacaataagtcattggtagtatggtagctgggtctatttgatttaataagctgtctacatctcattggccaaaaccatggcatgtggtcatccttggaggaaaagaggtcgagagggtgagcatttcatatgggcacatttgacatatgatattcttttagtaaggaacaatggaagaacggatattgggcagacaaccaccaccatttgccccagtgaatataagagggccgatgatttgggccacagtatggttgatcagtcacttcaactgtcttgatggtttgtgccaatcacagagataagataaggcatccagagatgttacacgaatcacactcactttgataatcgtctaaatgattaactttactgtggcctaaactaattattgtagtgattcttctccttttctatctggattgagggccaccaacccaaatgcatggaagttggagagttaagaaaggactgtatagcttgcctcatcccctgggaaggtataatggagagtggcagagaaagatctaagacgttcaactcatctgtattttctgtagctttgttgggataaagggtcttaacctgcctaagaagattgcatgcttctggaaggcagggctcatttcttaggctcctttattgcctccacagaggttaacacagagatgatactcaaactttcttatactgatgtataaatctgatgatggcagtttattcagaaaattggagtttcagcttaggaacaatttgtcacctcctgttaatattcagctcactccatcgagatcagtgacttcgaggcataagagttatataccccataaatccacctcctctgtgaaactactgagaaaagctttcatttttgtcaatatcctccaaagtgcaatttggtgtttacagaatattaatgttggcaggggcattttatgtcatttaatcttacctctcccattttattttttgatgagaaaactggaattcagaatagtggagtgtctacctataaggtttgtatgtgtgacttttatgttttgactttgtttttgtttaatccacccaactttaaccacacacttaataagagaaaagctctttattctcaccatcttcaaatacttctgttaagaggacagttcaacactgatactgcatcaagtggaagcaacagaagttttttggctgcatgtttctactaattttagcactaaatcatacacagcctttaaaagcaattgatcctttcagatatgaagtctgcatttgcttccaaaaagaaaatattttttccaattggttttgacaaaaacaacacctgctcccacttccgtaggtggtagaagtgtaaaaaactgtaatatattgtctggagaaggggcatgaagtacaggaataaaaagaagaatgggttgcattttctcttgctgacgcattatattgttgtgaattattacacatagagaaatgtactggcaatttatttgtctgatctctttctacaaaatgcaagtctctagatactttgttagaacagttacacatttctcattaatcatagagaggaagtatgacttattgaaaagaccatgaatttggtgtcaaagagacctgagtttgaatcactgctatgccacatagtaactttatgatcttggacaagtcattgatatatttgatccttcctttctataaaatagagacaaaactcagaattattatgaggtctttagagtggtcatttatttccattctcctattttgtgtttgctttgtacagagggaaaaattcataaaactactggaccagttacataactctttgaggattgatctgtcaaagtatagggtatgtacaaatttacttgcctaaaagaaaactgttgtttggtctagagaatttcttgccatattgtaaaaattacccatcatgtaatagaaaaataaaaatattgatctcaggtgctgttacccttagaaataatccagcaggtctccttttttgttcagattctttgccccacgtagactacaacaatactctgtgtgtgtgtgtgtgtgtgtgtgtgtgtgtgtttgtgtatgcacttgcagctttaattttgtaatttttaaaatagccatcagattcaatgaccctcagctaattcatgaagtagactatggcccagtcctcattttgaaagctcaccctttgttactgaaatactctgctgatatttccccaatttctgagcttcctacttaatttactgcttcattctctttcctcctggatcgtgataccaagagtaccatttgttcctgcaaagctgcccagaattcattgtcaacaattctatatatcacctcctggggaaacacatacacataccacaaatatattcatgtacatatgtgcataagtatacacacatataattttagttacaaaatatcttagttataaaaatttagttacaaattttagttataaaatgtctatagtaataactaatagatgctctcttgtatcttacattctttaataatttatcctaaacatcttttcttattttaacatatctatctcccatgcattcatttttaattagtcttttattgacagatactttaattgcatacttatggaagttataataccaaatttaatttggtattatttcatgttggttatttcatgttggatctgggaccaacataatgagaagagaacaaccattaagccattgagagagatatttgggggcaacaagggcctgaagccacctcattcaccacctcatcataggcacactaaccctgttcaagttcatgaatatctcgtaattagcgatggttttcctaatggctctttagaaaagcatgttaacatgtgaaattgaccaaagtaaaaattgtttcttagttcaaacattttatcattataacttttcattccttcaaaattataaacatctgtatttttaaatgatgcttctcatcaaacctcgctaaaagaaacctttttttaaaatccatagtatttcaggaaagactatatgatgcaaacttatttttttaacttttaaagtttttttgtgactaaaagtaaatgcagcacatgtataatttccgaagtattttttaaaaagtagttatcttgagaaaatcatgaaaattttttcctatgtatgctatacttaatccttttagtagcaagactattttagaagcaagcattaataacatcataacattgtaataatgatattgttttgcatttattgcattgttagtgtaaatagaagagtgcagctttccaagagtaaaaatataatatttccaaattgtttacgttctataatgttttatgacaaaaatattttaagaataccttgagtatttttaaaattgtatacagtttactttccattttctttcatgagaagctagttttagtttattttcccactagaagtttactgctgacaaccttatccattttgtttcctaattaaccaggaaaactttcctgcaagcaatactgaaagactgcaagacctgaaatcaactgttgacctgttaacaagtatcaccttttttaggatgaaggtatctcattttatttctgtcactgttttgttgtgacatagaatacattcatcccctggtaaagtcttgctttaccctcctcttgatcaagtactgtgttaactccatcgattaagctgtactatctttgcctgaactcgatgaatcttccaatataaggtatagtgaagaagagattatcctagacacttaaaatactctgatacatttggctctaatttagttctcagttaaatttgtcttagagaaagctctctagtaagtggatgtggcacttaaaaaatttccaaagaatgttaaatggaaatggagttcacttctaattttagttttaacttagatgttttgccgacttttttgctacaagaaagtagctgactcttttaagtttaccccaattgtggcaacttccattttcagcactgggaatgtctgtgtaggaatatatttgatcacctatctattggtataattggctaggccttacaaaccaggtatttctttttagatatatcatttctgctttaattgcgagttttcggcagtcatagttctggcttgcagtgcaacttatgtaaagcattttcagaaactacttgccgggctgtgggctaaaatatacactctttgaaagacagtattacgatgcttattcagaaaattcctaaatagcaacaatttttttctttgcatttgcccataatttttttcactagaacctctaaaaatggcattttgtaataaaagagagacacaaagggaaaccatactatatcaaagttcatttagattctttaaagttgaattaaaattcatttggtttaaaatcaggctaactaggtgattaggataaatagaatttacatcaattctaatctactgtcagtagctactggaacaatgtgcagctaatgatggcgagacccaatcaagttgacttagattgacaagtgatgtctgccattgacactgaggagtgaggaatgggagtgagggtagggtgtgccagcacagtgctacccatctaccatgcctccttgtttaaaaacactatctccttaaacttgtaactattcttccccaaccctcactaccagttgattactttgcttcctatttcaatgaaaaaaaaaataggaggaaagaaagaggagcatcctcaagctccaatcacatactcccaccacctaccccagtaggtacttccttgtatgtgtccatatattctttcttttttagtattgatgagccatctgttttcttagaaaatgtggtctcttctactggtgcaattgattttgtcttctcttgtgcactaaaatattgttccagcaatcctctccactctcctgaattgccaactttcccctatgtatgtgctattgattttacagtcttcaaaatactgcttggcatcactttcttctatagctactaccccagttcatttcccttaatagcaaaactccttgaaatagtcatctatacatttctttccaattaatttcctcctattatcttttgaacaaattttcttctcctgttattcttttttctcattgcagagagtaaaaatcactcttttgttgtacagtcctattagttttgacaaatgtgtagtcatataaccaccagagcaataagatacagaacagttccatgagcctacaaaattcccttgtgctataccattgttgtcaacccttctcccacatgctggtaaccaccgatttgttctttgcctgtaggtttgcctttcctagaacatcatgtaaatgaaatcatacacgatgtagcataacacaatagagaatcattggtgttgaatgtatcaacaattcacttctgttaattgctaaggagtaattctttgttatgtatgtgctatcgatttatccattccctcattgagagatgtttgagttatttacaattttggtttcttacaaataaaactgttttaaataagcatgggattatagttgtaaacatatgtttttatgttccttgggttaaatcctcagcagcagtgtgtgagagtcccaattgttctgcatcctctagcaaaactcttgggattttccatgttatgtatgtatgtatgtatatatttcttattctagtagaagtgacgttgcattatcttaatgtattaattttatttgtctaaaaattaataatattgagaattttggaggggttgattttctatctgaatatctttttttgtgaagaatgttgaaatttttacccatatttattagctggttttcttactgttaagggcattttaattttaattattttaaattgatagataaaattgtatgtatttattgtgtacaacatgatgctttaaaatgtgtatacattgcagaatggctaaatctagctaattaacgtatgcattacctcacaaagttatcatatttgtgaggagaatatctaaaatctactttcttgcattcttcaagaatacagtagtctcgagttttgagagtttttatatgttttgaatacaattttttgtcagatatgtgatttgctattatttttgccttgtttgtgccttgtcttttaattaatcttaaaatatctcatatagcaagtttttaattttggtctactttatcattttttttttctaattatggataatgctcttggttaaaccaacatcacaaagaggtttttttggtgtgtttcttctaaaagattggttttaccttttatatttgggcatattttttatttagaattttggggattgttttgctggttgtttttgtttgatataaggtgtaaagtgtgaatcaaggataacattttacatatttatgtttaatagttccagcagcatttattagaaagattttcctttctccattgaattgctttcatattattgtaaaaaattaaattgaccatatatgtatgggtctatttctgaactctctatactgttcaattgtttgtacatccaccactaccatcctgtcttgattactgtgaccttatagcaaatcattaaaaaagataatgtgcatcccacctcgtttcttcatttttcacaattgtataggtgattttcattccttctgggattttaattgagattgcctttcatctatagataaatccggagagaactgacattttaacaatattaaaacttcaactctgtccttagtttttgaccacactgtaatcagacttttactctctcacttcaccaaaaataatttgtcaacatctcatgttttatttctctcctataccattggctcttttgggagcagggtggggggtactctctactgctttattccttctcatttgtctgttgtcacagatttagaattatgtaagatttaaccggatttatttcttggacctcttctcttcactatccatactcaaccagcgttgtttctttatattcttctgtaagctaataatttccaaatttatatctctaaccagaacttttccacaactgtagattcatttatccaaatatcttcttgaaattcatatatatgcctaataggcttcttaaactgttcagaattgactcctgagctcccatccacagtttttcccatttaaattgaagtcacctcccttatggcagttgctcaggctaaaatattggggtcaactggagtcagctctcacaccagtcatccagtctgtcagaaaatcctgttagctctttttttctaaattttaccagaatatgatttcttctaataatttctaattctaccaccttgatcaagcatcatcttctctagactaaattgtaacgctgttctcataattggtctttctatttttttcatagcccactttaaggcagcgtaagggagccttataaaagttagttgttttgctaaaattaggccattttgctcttatgcttaaactatccagttccttcccacctcgctaaaagctaagatttttatagtggtctatatgtagtttccccttgttctcaccctacagcttcatttactcttgccgtttattgtattaattctattccattgaaacgcttcccatccttcctctgttttacttttcaacatgcatcatcatgtaatatattttacgtatttattttattatctacttgaacttaagcccatgaggaaagggatttttgtttctatcattcattgctgtatcaccattatctggcatataggaagtgatgaatatttgttgaatgatggaatggaatgaaatcaatgcatgaagtactaactggtcacgttaagtgtttttatttgagtgtttacagccattatcattttcaataagtttttatatcagaaagttaaaatgtttacacatttaaaaccacatggtaagatgacacttactgaacatagaaaaatcgactgaaagtatttattgaatatatatttgagtagtttatactagattacaatgtgtcactgttgcatttgagaaaataaatgtctgtctttgtcaggttctggagctgcaaagccccccaaaagcgagcatggtggtgaaggactgtgtaagggcttgcctggattctacatacaagtatatttttgacaactgccatgaactctactcccagctaacagacccggtaagaaaatatgtatgtcttttataatcgccacttttgtttctagtatctgtttccataagtttagcataatagtaaatagaaaagtatgttcatttaatttcacattaactgcaaatttgagaatttccataccttttcttcatatttgaatatcactttcacatacatgaactaattcgctccttaaaataactttatctagtaaaggcacatattatttaaggttttagctggagaatcagtttcagaaaaatgaagacattttctcaaggtcacaaggtaggtaattggcagatttgggactagacattaggattccaactcctgtttctatgtccttcccctaactcatactgcctcccatatcattttattttatttatttgttttttgagatggagtctcactctgttgcccaggctggagtgcagtggcgcaatctcggctcactgcaacctctgcctccggggttcaagcgattctcctgcctcaggctccccagtagctgggattacaggcatgagccagcattcccagctaattttttttatatttaatagagacggggtttctccatgttggccaggctggtcttgaactcctgacctcaggtgatccgcccgcctcggcctcccaaagtgctgggattataggcatgagccaccacgcctggcctatatgttaatttattaagaaatatttcaaaaatacaatttaaatcaaaaccacaatgagatacaatctcacagcagtagtaatggctattattattattttaaatttttatttccataggtttttggggaacaagtggcatttggttacatgagtaagttctttagtagtgatttctgagatttcggtgcacccatcacccaagcagtgtacactgaacccaatttgtagtcttttttccctcacacccctccgagcctttccccagagtcctcaaagtccattgtatcattcttacgcctttgcaccctcatagcttagctcccacttatgagtgaaaacatacaatgtttagctttctattcctgaattacttcacttagaataatagtcttcagttctatctaggttgctgtgaatgccattaattcattcctttttatggctgaatagtagtattccattatgtggagatatatatatatatatatatatatcacagtttgtttattcactcgttgattgatgggcatttaggctggttccatatttttagaattgtaaattgtgctgctataaacctgcatgtgcaagtatcttttttgtgcatggacttcttttcctctgggtagatacccagtagtgagatttctggtttaaatggtagttctactcttagttctctaagagatctccacactgttttccaaagtggttgtgctagtttacattcccattagcagtgtagaagtgttctcttttcactgcatccatgacaacgtctattattttttatgtttttactatggccattcttccagtagtaatgtggtattgcattgtggtttggatttgtatttccctgatcattagttaggttgagcattttttcatgtatttgttggccatttgtatatcttcttttgagaactgtctattcatgtccttatcccactttctgataagattttttttcttactaatttgtttgagtttcttgtagattctggatattagtcctctgacagatgtatagattgtgaagattttctcccactctgtgggttgtctatttactctactgactgttccttttgctgtgcagaagctctttagtttaattaaatcccacctatttatctttgtttttgttgcatttgcttttaggttcttggtcatgaagactttggctaagccaatgtctagaagggtttttctgatgttatctgctagaatttttatagttcgaggtcttagatttaagttccttgacctatcatgagtagatttttgtataagatgagagatgaagatccagtttcattttcctacatgtggcttgccaattatcccagcaccatttgttgaatagggtattctttccctactttatatttttgtttgctttgttaaagatcagttggctgtaagtatgcgggtttatttatgtgttctctattctcttccatgggtctatatgcctatttttataccagtaccatgctgttttggtgactatggccttacagtataatttgaagttaggtaatgtgaggtctccagatgtgttccttttgcttagtcttgctttggctgtgtgggctctgttttggttccatatgaattttaggactgttttttctagttctgtgaagaattatcatggtattttgatgggaattgcatcaaatttgcagattgcttttggcagtatggtcattttcacaatattgattctacacatccataaacattcagaatggctattattaaaacatcaaaaaacaatacatgctggtaaggctgcagaaaaaagggaatgcttatacactgttggtgggaatataaatgtgttcagtcactgtggaaggcagtatggaggtttctcaaaaaacttaaaacagaactaccatttgacctagcaatcccattactgagaatctatacaaaagaaaatcagtttttctactaaaaagataaatgcactcatatattcatcacagcactattcacaaaagcaaagacatggaatcaacctaggtgcccatccatggtggactggataaagaaaatgtggtatatgcacaccatggtatactatgtagccatcaaaaagaatgaaataatgtcctttgcagcaacatggatgtgtccggaggtcattatcctaaacaaaataacgcaggaaaggaaaactaaatactgcatattctcacttataagtgagagcttataaagatgggaacaatagaaactaggcctactggcaatgggagagggcttaaaaactcactattgggtcctatgttcagtacctgggtaaggggatcagtcgtacgcaaacctcagcatcacacagtctgttcaggtaacaaacctacatatatacctcatgaatctaaaataaatgttgaaattatttttaaaaatttcaggaatacaaaaaaatatagaaaccaaatcaaacatgtatatgcttactacctataaccatgttaacattttccaatatttctctgctcttgtttaaagacattaaatgttacacataaaatagtattttgcttgggaggccgaggcaggtagatcacgaggtcaggagatcgagaccatcctggctaacacaatgaaaccccgtctctgctaaaaatacaaaaaattaaccaggagtggtggtgggcacctgtagtcccaactactcaggaggctgaggcaggagaatggtgtgaacccgggaggcggagcttgcagtgagccgaggttgcaccactgcactccagcctgggcgacagagcgagactctgtctcaaaaaaaaaaaaaaaagtagtatttcgctttgtatttcccaatcccatcctactccttttttgtccattggagatggacactattctaatattggtgtgtttgaacgtattttcacatatgatcaatgaacgcttgagttttatgttctgtgaattgcctgtcaatcttttgtgtgtgtttctcttggttttcttgtctgttacttattaatttatagaaaaatctaaaaatattgtggatactaatccttttttggttatatggatttcatagattatttccctcttgatgacacatctttttgttatattgaagttttctaatgcatactatgacatatatagctattacttctataaaattggattttacaaatgtagtctagcttgggcaacctgggcaacatagcaagaccctatctctacaattttttttttaattagctgtgtatggtggtatgtgtctatagtcacacctacttaggaggttaaggtggttagagtgagtccaggaattggaagttagagtgatctatgattgctccactgcattccagccttggtgacacagcaagaccctatctctatttaaaaaaaaaaaatgtgtctatcacctgtcctttcaggaagagtgcacttggtccactagatattaaaaattgtgtaattatccatgaaacattctgtttacttgggagaggcaaattctagaaagcaatgttagatgaaggcaagtaagactcttccaaactggatttttagctaggtttcatatagtatatttctggggtcactgttttttgtttttgtttttgttttttttgttttgctttataagaaaacaaattaagctgagtttggcattgcataagcaaaacaatatataaccacatacttgttcataactttagcttatcaactctgttagatatgcttagttttaaaacttggtcctccaggatttctaggagctaaattggtgctcacttgtactttcccatgagtagttttctaatgacttttctttgtctaatctctactttccatcttcctcccatagggctctttcaattcttttacatttttcaacatcattatctttattttacctaaaggctaagattgaaactttttattgtaccatgtaattacccatgcataactttttttttttttttgacagagttttgctctgtcacccagactggagcgcagtggcgcaatctcggctcactgcaaactccgcctcttgggttcaagtgattctcctgcctcagcctcctgagtagctgggattacagaggcccaccaccacgcctggcttattttgtatttttagtagagacagggtttcaccacgttagccaggctgggctcgaactcctgacctcaggggatccacctgcctcagcctcccaaagtgctgcgattacaggcgtgagccaccgcgcctggccccatgcataactttataatcaatcttaccagactttaccaggttcagtttcctactcctcacactcctgaaccaaactgctctgctctcatgagccctaaattttataatttccatgaatcagccatcctttttcacatccttgcatttatgcatcctgttctatatgcctgaagaaattctccctccttccctgctttcatcaaaatccagctcaaatatgatctttgtcaaagaaaaaattattcattacacccattaaagaatggtaaggcagactattcaaagagtactattacaatagttacacaggaaggctaccccaataggattttatagtagaaaagagaaattgggctcaactatgaataccacaaggaaaagtgggaatttatagccaaggagctgagttaaggggaggggcttactggatagaaattactaagagttaacatttggggtaagggggggtcctggctaacagatctgatgggattcttgctgaaggcagaccagggtgatcaaatatcaccagaagcattgtagaggaaggaaacctgatcagataccaaagtgtgatcatatatcaaaaatgaaaaattctggctaaactgagaagattcttgctaaattggacaatgcagaaactaacatggaagttcgaaagttggggcctggttaaaaagagagctcagaagagtttgatcaaagtttggtcaaagagagaatctttatcatttcctcatctactaattaatactcagtggattaattaagctgccaaagtgaagtggcataccttacttgatgtctttctaatacataaataataacaacaacaatgataaacgaacagtttatttctgtaagagagcttcgtaggtagttcccataaagcaaacgtgcccctaacaaaaagtaaatgaattatgtcacatcaaaataatctaatatagcttaatattttatgacttggctttcagaaaagataattatataattttcttactggttttatttttaggtagatagatcttagattttatgcgaaattttgtcaatgtagggaatgcttggggctaagctttaaatcttggaaaaatactttttcatcaacattgttattatttgaaattctaaaggaagcatccattggagctgaattatttagggggttaatgctctctcgagcccttttgaagccatctaggaatacttcatatgattaaggcttatctcccctcagttggctgcaactccatgctcctaagagctcaagttaagacctttttgtcttatagcatacgtctcacctgtcttcaaattctaattatttagttcaaaattaaataccttcatttcaaaatatatccagaatcagaccacttttcaccagatccatgcttctaccctggctcaaaaccataatcattgttcacttggattactacataacttcctaagagagctcaatgtgtctaccccatcatcttatgtctgttctcaacagagcagccagaattattttttaaaaaaggaagtcagattatatcactcttctgcatagaatgttttaaggcccttcatttaagttaaattcaaagtcctacaaaactccacatgatctggcctatgttacgcttctcacccctcttactctaatgctgtccccttgcacatgtcaccatgtgactggagagccaatgaagagttgatgtgcagggaagtaatgtgagcaatgctttacccctgctttttatgacagagacagaacttaggacagtgccgagtaggtgttcacaaaagcatttgtttaatgaactgaatacataaataaactgatttttctccagtaatacagtaagaaattataggtatatttcacctattataaacaagattgaatgaagtgccctattctgtggtagactctcagtgcttgcctaaagcctcttgcacttactctgggtcatgtggcaggatcccagatgaagagatatgggaaaagtaaatgaaggccacttctagtcccaacccataaaaacatcttgtcacctgcagtgcaataacctggaaggatacatattgcagatggcatagctaccaggtggtgaagggctgcctagtcagcctcggactttgggtgtttaagaaataaccttttattgcattaactcacggatatttggatatttatttgttaccatagcacaatctggcttattttgactaatagaacttcagttacttttccaacctgccaccccactatatatttaaaatatatccatgtttacgtgactatcctatttataactctggaccagctccccatttactcagaggatgaagtccagactctcccattatccacagtgcctctaaggtctaagccttgattatcactcctgacttcaacatcatctccacattgcattccatgattcagtacattaaactccatggtgactttgcctgccttatatttacctgcctggagcgggcatcccttctccaaacttccctccaaacagctaaccgcagctcagctaactttttcttcagaaagcctttatacctcttctagctggatttggtgtttcggttctctattctcataataccctgacatgtcaccaccactgcacttatcacggtgaatttatcaggtgcatcatgtgatatcagttagacctgtcttcccggctaaaccgtgagtttcatctttgtattcccagtgcctggtggtatacctgactctgagtagggttgataaacgaagtaattatctaataaaaataacatttaaagaaaaaggcagtgccttagttacttatttgtagtatccttcagtgactctacattaaaacctatggtaaggaacataatctctgatattaaaacccctgagttcaaattacagctctacttttcagcattgtggactttgttaagctatttagcctcttcatgtctggtttcttcatcatattcatgctacttctgttttctttgaatcttctccagataatatgatgccttgcctgaaacaagaaattaagaattccagcactattagacacagtacagtctgattatttaaatgtggaatcatactttctccctccagagggattttgaagaaccatataaaaataaaatgcttagaataagaaaggaaaatcgatttgatagaaaagtagagacagctgcagttagaacaagatagaagtgtggtctccggaggctggctctgcactcggtaggtggtattttccttggctgaattgccaggctccgcatctgcacttcagtttagcttaggaactccaatgtgtcagtgtagacagaggtcactggactcacagagaggtacacaaaagatcaatctataaactggatagatatctatccagcagatacctaatcagccctattatatgccaggcactggtgtaggctcttaggacatatcagagaacaaacgatagtttctttaaaataaaaaataaaatttcaaacagattgaaagtgttttagtttatactctcccaggtgaacatctatgtgaaaataaaacctgtaatccgaaggttattttaggaacctggaacaagagcaggatgaattagctggataatattaatagtgattattgctagcatgaacacatccattttaataaaatctacataaagagaccccctaattgtggaatgaggaggatagataagactttctttttaaatgtgttttaaaagaattatgctgagctaatgtcagcattaactcagttccgtggaaaccactcagcgaaagaacttttctgttgaacaatgaaaacctttattaactgattttacagtctccctccacacctaccctgagatcaaaacttgtttacacagagatcatccacaagaagatgtcaaaaaccaataaaacctttctgcctaagattctgctattttaaatttatatattttggtaaattttaagttgtttattgaatgactacctaagaaaattgtattaagatatgccttaactaaaacacatgtacacttttagttctgaagcacacttagggactttttaaaatcttattttgaatctgattagaaggtttgtaactaaaaacaggaacaaacgaaagttcttgacattcatgtgatgatttcttttgaaaatcatttctccaaatgactgtgttttgctataaggcagcatgagtgatacagatagatgaatgcagaggaaaatgtgctacctacaagtgggagttgtatgtaaaatcagtagaaacatatttctctctttattgacttttggatacatacacacacacatgcacatatatgcttagtctctttgtttccctcccaagtcaaattctctcacttcttatctcaaaggaaatctctgttatgaatttcttattagctttgatgaacatagtttcatctttgtgtacatttattacatatatctattatttgtgatacagtctttatctctatcaacctgtgatataatacattttagaaataggtaatacagtattattgttgtatatactaattctagaaccagattgtctaaatgtaatgattcttctataatttttaaagctcaatattaatttttgagagctatctatgctgattcatgtatgtacagtttgttgatttttacaactgcctacagcatgtacagcaatttacacatcaattccgatttttcacaattacagataaggctgcaatgaatatctttgtagtaggtgtgtaaaaaattcggtatggtctcttaaaggagaagggaatatcctcctttcctctactttttcccttccgctagacagaatgtggacctgattttgagccatcttgtaccatgtggacagaagcaccctttacttttcacatgcattaaaataccttttgtctgatacccatggtaacattgagtttagtgaaaacagaaactctatttatcttaatattgaatttgtagcatataacactgtgcagagatcaattaatgcttactaaatgaaaattctatcaaaaaacatctctttgtattagacggaatgtgatatgtataccacaattttggccacgttatcctctgaaaattctttgagagagaaaatatcaccgtagaatagtctaaaggggcaacttacctgaatttaaatgtggaaaatttcagaacgtccatgcttgttttgtggatgtatctttctcagttattttaacccaaaaagttgatttagcaatttgtctttttccctttcttttggttttgctctagccaatttctaaataattcagcaatgaaagaaaagttaaaatgtgccctgaaatgtacatgtagaaaaatatccaattctgtaactcttaatttgaaacatgatttaaatagtaatcattacaaaactggctataatatgtccctgacttttcttagatatttttccagcaatgtactttcttatgtaatcattggcattagttagggaatgatgtttattctgaaagataggtgttttttaccaccttatgtgctccttgtcttagttctaaatctgagtaaatataagcataacttagagttaatatgtttataatttgatatatacaaatatatcaaattataatttataaaatatttatattttataaatatataaaatatcatttgatattatataaaatgtatagaataaatgttatgaaaagaaaatttctttttaaatgccagcttcatgactagtatataaaattttacttgtaacaagaaattgttcaaaatgagtagtatattgccatgtcttatgtattttaaagaagaaaaatatatgaaaattcagagcctgaaaaatgactagccagttatgcttctatcactatatgctttaattttcataacaaggtaaataaagtaaaaaatgaaaccataataaattctgaaaatatcaataacatacatagtatgttgtattagtaaaactagtgaaattttgattctaaaactgaattatgacaatacatgaaaaaaattataacctcacgttgttaataaacattgatgagaaaagtctaagtaaaatattaaatattaaagaacatgacttggtcaagtaatttcatctcatgaatgcaaaaatggttcaacaataccaaaaaaagatcaattataaatttaatggtgatatgggacattggaaccttcatgcactttcagttggcaagtaagccgggagccagtaatctaactctgggtacatattttcacaaagttcaccaagggcatgtttactaggatattcaatatagcattgtttgtgagactgaggagatggaggcaacccaggtatctttcacagaaaaatagatccataaaatgtagtgggtacatatcatggaatattgtggggcacttaggaaaatgggttagatgtctacatagtaacatggataaaaagtaaaaacagtgataagtggaaaacaagggaagaaacataatgttgtatattagcacaataatattttccttttttttttttgagacggagtctcactgtgtcgcccaggctggagtgagtgcagtggcacgaactgggctcactgcaagctccgcctcctggcttcacgccagtctcctgtctcagcctcccaagtaactgggactacaggcgcccgacaccactcccggctaatttttgtatttttagtactgacggggtttcaccgtgttagccaggatggtcttgatctcctgacctcgtgatccgcctgcctcggcctcccaaagtgctgggattacaggcgtgagaccccacgcctggcctatttttctaaaatttagataaatacacaaaacaataataaacattttacaagactgaaaaaaataggcaaacaccaaactcagtatgtggtcttatgtaagtcaaaaggacatgaaattgtagaatggtaattagaaagaaatagaaagataaggatgacggatggaatgaatcggcaggcagacaggaaacttgcatgatctaaattcttaaacaaggttctaacctctcctccaactcaaagaaaaaaagagtaagtctaaaggtctgcagtaaaatatgctatatttgtggtatctctggagtcaattacctaaactttgtataacttttcaattgatatgaatttagcatctaacaagtataaaactcagatttaatgttgactctttctgccccacgtggccatacacgaaattgaaatggcgacctctgaaattgtgtcgtgttatagccataaaactgctgtagtggagtcaagaggtataatcaatattgtgtcatgtgatttttattttaatgtgttccttcttcagaaactttcattctttaaagatggttttccttcacaaatggtgataggaaaaaatgaattcatctacaatgtgcttctttatattataatactatcaagtaagttgtttggaacatataatatttcactgaagactatagtttgagttatttcacttaaaatttttctatttttcacattgtgactttgtataatagttacccaggaaattgatgagtcttgaatctgttagttttaaaatatagttgttgattgggatgggacattttagtaagtcaaattactccaagctcctgaaaagtccagtaaacataataaattggaaacataatttttttttacaattgtttgactctagtatttcccaaatttcctgctgctaaagggttcttggctacttcagaaaatacaggatatccagtgaagtgcgcaggaatctgtattttttaacaagttagtagaatgatacgtgacattaagcaactattccattaaatagaactttgtcactatggattctgatattctatttactttttagtttttctttttagtaagtatctagagaaaaacttgcactgaaaattaaactgtgaaaagaactacagtatgtaaaaaatctgtttaagaactgtttttgcctaatagtctgtattatttcccaaggcttgcgctcctcttccccagcttcccagaagttacacagttctttatataattccttttaaagagaagaaaatggtagatgttacttgtattactgaatccttggtaaaacaatacagcaattaagatcaacacggaggcagtatggtggagtatattataaaaccctccagtgtaggaattttatctctcttgctcaccaatgcattttttatatccaacctaacgcttcacatatactaggcattccataaatagtggatataatagttgccatttttatttataatacatgtgaatcaaaaccataagattttaattttaattttagttttacaactcaactaattataacaaattaacaaatcactcagtagccactgttttctcatctctaaaataatgcaatatcttttgtctctacttcagaggtagtagaactctgattctaaaatcaggaggtgtttacacttagggaagcatctagtgaattagaaagtagtgtagaaacataagtaattaaaagagagaaatatacagagatagaattaaagttaaaatatcatttactcagtgatttcattgaaatcttggggtgaaagttaaatatgaaattttaaagcaagaggtcaggaactctaatccatctaaaattctctctatatggttaagtttaatgcatttttaattgctattttcagccttccaggaaatactgatgtagttattctcatagttttgattttgtttatatattgtgattatacaaatatataacacatatatacatttatataattatatttatataattaatatatattttatataaatataattatataaatgtatatatatatatagagagagagagagtgagtcaggttatcctctctgaagaatattattggtcataattgtttaattcatcaccagcaacaaaatcatgtgaataaaatggtgttgcattaatgaaatggtatctaatgtgctgattagacatagtctcttttattaaaagtctcatattttgtagcatgtttcttctaaagttcctgattcgtcagaacagtgtcaaacagaaggcataaaacaaaaatacagcaattaattatgctaaattctagaatatatatgtatttttgctatcactcataagtggtgtctatatataatctctgatagatggctagcaaagacagactagattgtaataatccagtaatccaatttccccttgctctctccagaacaagttaatggataatggaatctcaccaggaaatgaattggtccctttctttatttccatgatgcgttttattttccttaaatatgctatatggctctctatagaggtgttcaattttgttaccattccttaaaatatcttattgaaaatgcagtttatgtatcctgttttattgatttttacaattttatctattgaaaaattctatctttgagacgttcttctttggcaatggtgaaaatggccaagaggaagcattcaaaattatgcaggaagattagttttgagctttctgtctcatacaggaaaaaggatttaaatgtaattcatttattcacatatatacaataaataaaatttgttgacttcttgttgtgtaccaaacactaagaataagagaaatttcagtgaacaagacaaacacagtcagtatcctcatgggactctagccagagaggtagacattaaaaaaattattagaccaataactgaaatagtgtcagatgccaggcaggcagggaaaatataatgcagtattaaaagaaaaacccatcctaatctgggatgtagggaagagtagaatttaaaataatatggtttctgttagaaatacatccagacagactctgctggaggtggtaattctggagatgtgtccctacaaagaccagggaaatgtcacaatcaatcaatcaatcaataaaacaaaacaaaacattatcttactttcatttaaaatcccagtgtagtagtacctagaattctatagacagttgtatttttcatcgcagcgaagaggtacggtagaatcactttcgttgggcttctgctaaaactatcttagctctttcatctgtactgtgcctaaaccaatggtcaatcatctggcctcatttacttaacctatcagaaacatttgttattggccactccatccttcctaaaatactttattttctaaatgtctaattgctattcttaccagctttcctctgacctcactgactgctcccttttgaattatttgccaaatgccatcctctaccaggcctgtaaatgttagaactcctggggttctgtccttggcttttactctagctacaccgcttcacacacaaaacagtcccataaaaacttggaggacgccaaccaattgaaaaacagagttgtctccaggccaggatgaaggaggcagacccttttgctttgattctggaaacagctcttacaattcctagggaagaattggttgtcctgcctgcttcatgtcagcaaataaccttgttttgttttggcaaggagtggatgtcttaggaagagatgcagctttgaaatcaaacccacctggattcaaatagaggctcccatcaattaggaagctattgagtcttggacaagttacttcgttcttctaagcctcaatgttttcatttagaaaaaaaaaaggataacaataattgctcatagaattgctgtgaggattaaatgaaagaatgtttgtgaatcatcttactcataggtattcaggagatggtccttttctttattccatcaatacttgccttgtttttgtgctaaattcactgaccagacaggagtttgtgctataacaccatgcactgaaacacaaacagtttttgattcggtgctgcttctactgattctgttagccttataaaaatggaggagattataacacacaaaatacatagtttgctggacctaccaggattactctgaaatgcatatactgtcactctccatctgcttgcaaagcatcttccaggtatttggaagcattggaatgtgctctctaattaaacttggcactgacagcctataaaaattactggaaatgtacttcattgtgcttttcttctttttggccacacagcttctggaataggtttccttcagtgatagtaagaggaacaaggttgtacaaaccaaagtagtacttccaactcaaggaatatctcaactttactgttactcaaagaaaacaacttaaagatcagtgcccccaaattctgcataaaatgtaacttggaattaaataatatgggaatagttacttgctatggtttgaatgtttgtcccctctaaaattcatgttgagatataatccccgatgtggcagtattgacagatgaggcccttaagaggtgattgggccacaagggctctgcccacatgaataaattatttcatttatgaattattgtgttagtgggcgatcataggagtagagttgatggctttattggaacaggaagaaaggcctgaactatcatgttcagcctccttgccacgtgatgccctgtgccccctccagactctacagagagtccccaccaagaaggccttcaccagatgttgcccctcaaccttggacttctcagcctctgcaattataagaaataaatgtattttctttataaatttcccagttccagttattttgttacgatcagcagaaacaaacttaaaactttacttatgtaattatcaagtatcaaagacaagcaagaattagaattatttctatgatcatgcagtctacacatgtcatgtttcatttcattatctctgaattaatcttgatttttaatctcactttgctttttttttgatacagagtctcactttatcacccagggtggagtgccatggcgcgatctcggctcactgcaacctctgcctcccgggtgcaagctattctcctgcctcagcctctctagaagctggggctacaggcacgcaccaccaaacctggctaattttttgtatttttagtagagacggggtttcaccatgttggccaggctggtctcgagctcctgacctcaagtgatgctcccacttcggcctcccaaagtgctgggattacaggtgtgagccacagcacccagccctcactttgcttttaattccagttttatttattaaattttttgttaatatatttctcaggcacataatttaaaagatttttttttaaagtataaagtaaaaattatccttctcatactttccccaagtactcagcctcccctcctggaaataaacaatattatcacctttctgcatatcctttcagagatactgcattcatacctatgtatatatatgctttccaaatatgaacgtgtcatagatgtatatatagatatgtttgtatatatgaagacacgtacacatacagatatatgaatcaccttttttacacaaatagtagcatattatacatactctactgctctgtgcttcatttaacaatatgtctttgaaatggtttcatctccaatgcactaaaatattctcattttttatgtctgcgtggtattccactgaatggacatttcacaatgtatttagcctgcccctattggtggaaattcaagttgtttctaaggttatgttttcacaaatgatgctagaaagacatgatatatatctttttgtaactcataaaagtatgtatcaaataaaattcaaaatgtgtatttgattgatggaacaaatgtcatatagattgggaattttagtagataccaacaaattaacctccaaaggggttttattaattttcagtccctccggcaatctctaaaagtgttttttttttccataccttgtccatatactgttctaccaaagatgtcttagtccttctgggctgctataacaaaaataccttagactgggtaattaataaacaacagagatttatcgctcacagttctcaaagctgggaagttcaagatcaagatgcccatagatatagcgtctggtgggatatgctctctgcttccaaggtagtgacttcttgctgaaacctcacctaatggaaggggcaaaagcagctttcagcctctttcattagggcccaggtctcattcataagagcagagttttattatttgataattccccaaaaattcccaactattaatcctatcacattgagtattaggaatactttagcaataaaacatatgattttttgtgggatacccaacattcagaccgtagtcattgtcttaatagtttttacaaatttgatagatataaaaaattattgctgaggaatttcaatttacatttatctaaatattgataagtttaaacatatttgtatattaaaaaggcacttcaatgtttaatcaaagttttcttcattttttattgatttatgtattctgatctataggaccttgttctattttaaggaaattgcactttgtcttgataaaggattcaaacataatttctttagattttgtttaaatttctttagttttttttgaagtttacagtgttaattgtatcagtttacagcttataggttttatgttatgttgtaaactacagtccccactttgagattatttttaaaaatctcatccgatctttccgtctagaatttttagagtatttttaggttaaatgtgtatgactcacctggaatttatttttatataaattgtgatgaaaacattgtcttaaagcagtgttttattataaatttcaaaataaaagataattatgaagtatagagcagaatcaaatcaacaaatgtttttgctttgcattctctccatcctaaaaaacaacctggaatatttttaaaatattcttattttcttccattatccaacaggactttctgtacattgttttcatgaaatattaaatttgaaaatatttgttaagctcagctttaggaaaaaataattttttattctaatattatttgaaattcttaaatttttagcattatacatttaaacatactttttgtacactgataaatattcttaaaagataaagcagaaattgaagaggtttcagcatatgcgtatattaaaaaataactttaagcctctaaagttagcataaaattagacatattaggaggtataaacgttttaggagaaagtaatctggggagataattactgagaaatccaggggaaaaatacaaacacattccttcaacctttcagtaaactgttctttggtttccatataaatttcccttgctcttggagtaggacttacaaaacacatttttcacatatatatgagaaaaaacacacacatatatgtgtgtgtgtatttatgtaaaccattattttatatgtgtttgtatgtatgtatatacattaatctttattattatcaaaagcccaaaagccagtgagacttgcctgtactaatcatagtgcacaaagatatctattaactctttttatttaaaaaatatctaggagtttctgcatttactcagtatgcaatcgagctttcctagcaccatttattaaggactatcttttccccggtgtatattctttccaacttcgtcaaaaatgagttggctgtaagtgtgtggatttctttctgggttctctgttctatacctttggccaatgtgtctgtttttatgccattaccatgctgttttggtcactacagctttgtggtatgttttggggtcaggtagtatgatgcctccagcttcattctttttgattaaaattgctttggatatttgggtcttttgttgttccatacaaattttaggattggtttttctattcctatgaagaacatcattggtattttcatagggataacattaatctttagctccctttgggtagtacagacatttaatattaattcttccaatgagtggacacaagacacaaaatgtcattccaattatttgcatcttcttcaattgatttcatcagttatcttatagttttcagtatagagatctttgacctccatgtttaaatgtatcactattttatattttataactattatacattggattacattcttgatttgagatagtctgtaattggtgtgtagaaatgcaactaatttttatatgctaattttgtatgctgcggctttactaaattcatttatttactggttccaatattatttttgtggagtctttgggattttctgtatttttaatcatgctgtcctcaaacagggataatttgactttctcctatccaatttggatgccctttatctctttctcttgcccaattcctatagctaagacttccagtattgtgttgaataaaagcagtgaaagtggacatccttattttgttccataacttagagacaaatgctcccaacttttcctaattgagtatgatgttagctgtggtttgtcatatatggcctttattgtgttgaagtatattacttttatatctaatttgttgaagatttttttatcatgaaaaaatgctaaattttatagaattttttttctgtgtctactgaaatattcatatttgattttttgttttttgtccttgattctgttagtatgatgtattacgtttattgatttgcatgtgttgaaccctccttgtattcctggcatgattccatttggtaataatgaaagatctttttaatgtgttgtttaatttgttttgctagtgttgagagtttttgcatctatgttcaacagggatattgtcctatagttttctttttttgttgtatcattgtccggttttgatatcattgtaatgctgactttataaaatgagttgaaagtattcccacctcttcaattttttatgatgaatttgagaaaagttaatatgtgttcttccttaaatatttgataattcaatattattggcaaatatttattagccgtgaagccatcaggtcctggactcttctttgatgggagagtctattattgcctcagtcttcttccttattattagtctgttcaggttctctatttcttcatgattcagtcttggtaggctgtatgtgttcaggaatttatacatttcttatagatttttccacttgttggcatataattgttcacaatattatcttttgtatttgtattgaatcatttgtatttctgtggcatctgttatgatgtctccttttatcatctctaattatgcttatttgagtcttctctcttttgtacttacactaactaaaggtttataattgttgtttattttttgaaaaccaagtcttggttttgtttttcatatttttaaaatctctattttatttatttttgttctgttctctgttatttcttttcttctaccaatattaagtttagttggtttttgtttttctagtttcctaaggtatacctacctttcttgatgtaagtgtttattgctataacttccctcttaaaactgcttgtgctgtatctcataggtttgggtatgctgtgtttctgttttcacttgtctcaatgaattatctaatttcttcattgacccattattgttcaggagcatgttgtttaatgtatatgaatttgtacagtttccaatattccttttgttattgatttttaggtttttccattgtaatcagaaatgatacttgatattattttgatttttaaaaatttagtaagacctgttctgtgacctaacatatgatttgtactggagaatgtttcaagtgctgttgagaaaaaattttattcagcagctgttggatgacattttctggaaatgtctgtgacatctattcagtcttgagtgcagtttaactttgatatttctttgttgattttctgcctgaacaatctgtccattgctgaaaatggagtactgaagtaatctactattattttattgcatcaattcctttaagtctattaatatagtatttatatttttaggtgctctgatattgggtacatatagatttaaaattcttgtgtctgcttgctgtattgacccctttatcattatataattgccttttgttcaccatgcttgacataaagtctgttttatctgatataagcaaagctactttcagattaaagaactcaccttagcatttttcttgtaagatagggctagtgttaaggaatacactcagcctttatttgcctgggaaagttctctctcctgtatgtttcctggatagcttttcttagtacagtattcttggttggcaggtttttgggttttttatttttcccatcagcactttgaatacagtattccactctcactgagaaattctctgaaaggtgtattggggctgtgttgaatgtgatatagttctctgctgttgctgttttaagtattctttatttgactttggttgataatgtgattattatttgccttgggaaattcatttttggcttaaatttggttggcaatctctgtgtttcttgtacctgaatgctgtcatctttctccagatttgggaaatattcacccattatttgcttaaatatgctttctgggtcttttcccttcatctccattaggaatttttattaatatttggtgaaacttaattcacttgatggtggctcataattctcataggacttctttactcttttctattcttttttcttttatctcctattttgtatattctctcttcaagcttgttaattatttcccttctttgatcaagtctattgttgaggctttctaatgtgtttttcaggtcagttattgtattctctattcattgtattcagtattcttcaattttaagatttttacttggtgtgtttttacttgtgtaaatactatttctttgtcaattttctcattttattattagattattttccaaatttcatcagttttctatctatattttcttgtgattcccctgaacttctttaaggagataattctgaattttctgacagacatttcatagatactcaatctgtgccccttgctgaagctttgttgttttcctttggtgatgtcatatttccctgagtttaacaatgcttgcattgatgtcttcacatttgagaagagaatcaccttgcccaacttttgcagtattctttggtggtattagacctttactacttagtaccaaaagttaatcctttgcttccgattctggggaggacttacagcgagcactagaactaaaacactgcactggaactaaactgctaccctacctctctttcctggtttgagtaagacttactctgtgagttgaagctgaaatgctgcatcagaactgaattgctgctctgctattatttcccagtctggggaagacttatagagagtacaagaacttaaatgctataccagaattatattgctgtcctgctatttttttctagtctgatgaagacttaagtggcaccaaaacctaattccaacattttagttatttctaggacagaagaaagattcacatgaacatctgggtttgtaaaaaaatatggccagggatttgggccttcctgcatattgtacctactgtagctctatggctccagccagtctccttactgtggcatccatgctgattagagggaagaatagctgccaagatctgtgtaccactcactgtgataaaagacgtactctttatccaatttaccccaggtgattgagccttcctggcactcccagtctttccagtgggatggaactggagttggcttcccatgaagattatcagaccagtggagagattgaatatccacctccaactccttcctctcacctcagaacccacaggtctagggaaattctttgcaaatggtgttatgccagcttggaggagggagcagcacagactaaaatgactatttctcctactggtcatgccttctctcgatactgtaggcccaagagatttcttcattactcccctgaattcagggtggtgttcctgtctttgaatactttctaattatatttttgtgggagtagtgatacaagggaatcttatattccaccatcatgctgacataacttttctcagtttttttccattgcagggttcacaaaaacggagttatagaaccataacatcactttcagatatatacatccttaggacccactcaagagctactgaatcagaaactcttgaggatggggtccaacattctgcatttaaacaagtcctccaggtacactctaatgatcgaaaatcactcatctactgcatgactcagacaaataaagggaaagttaaaatgtggaaaatgctctgagagaaaaaaaggtgttctacgagtacataggaggctcacataatccattggggatagacagatcatgaaaggcttctaggatgagaagaaggcatataaagaataggtaagttaagtgggaaggatgtgttagggaaaagaaggatggggcatggtgatggacaaaaggccagagagaatattgcaaataaagaaaagccccacaagtgcaagatctcagagataggagaaggttgatgcctttcagagctgaaaactgaagcaaccataaccaatcacagtgctgagctaatcacaaggtttgttttgtttgcttgtttttgagacagagtttcactcttgttgctgaggctggagtgcaatggcacgatctcggctcactgcaacctctgcctcctgggttcaagtgattctcttgcctcagcctcccaagtagctgggattatagacacatgccagcccacccagccaatttttgtatttttattagacacggggttttgccatgttggccaggctggtcttgaactcctgacctcaggtgatctgcccacctcagcctcccaaagtgctgggactacaggtgtgagccacctcacccagtcctaatcatgaggtttttatcgaggtgaatatgtcacaagtcatttgatactagtatcagtgaaagtcataaggactgaaaattatttccttttactggtgacaaatcaggttaaagaagaaaagagatgttttgtaaaccaagttaatggatttggatttgtcctggaggaaatgtggagccactaagaattttaagccgcagcatggcatgatcagatatgtgtttataaaagtgtatctgactacagaattgagaactaattggaggggtgagactgggagcaagtagaacagctatagcaacagactatttgggtaagctgtctgtgttaaatttcctgattttctcttgctaaagaattcatttacaaaaatatgccctagctttttgatgtatgttgaataaaaataatacatacagaaaaattaaagtctaatgtcttaaataaggatttccattttaaaggtcctgagcaattatagatatttgttaaaaagtaaggggaactaacaagcaattttcagtatattaaaaagcccaacaagtgtcatacatttgcgtaaatgcaaattaaaaattcatggttttctttttaatttggggcgaattacatcaattcagtacaggcactctagtgatttagtgctgattggaaactccagcttgacctttacatattgctggagaacagaaacatcagaaaatgagctttttgcttaacagatgctatatgaaagaaaaaacaatgaaattcaatggtagaaaaataaatccatgtgtcttgatagttgaagattacaaaacatgacatttaatctattttataatatagctggacccaagtgaattaggtagtcatctaagtatttattagaccaaaaaatgacccccccccaagaaaaatttaattgcatgaaaatagcttaatttttgagatagtcatattttatttataagtatttacactcagagctgctatgagagggaaaagttagccaccaacaaagctcagagacatcagaatttgagcagggtcccaaatcaatgctcgtttttcttagatgtagggagctactggggtttaatgtcattttgtacacatttaaattcaatttagtatcatcttttgagtggcaccttcttttggaaactgactgagctgatgacagtttatacttttagtgaagtagagtaagacttcactgtagtgacttttttgttggaacaaactcacacaaatctaaataagacatccaaaacctttatggaaaatagtgcccactagaagtgtaatatagtactgactgtacttatgatattcccattaaatgacttaatgaaccttattcaatgtaatttgtgtctagatggtgccggtaacacacttagctagtgattgattctcactgatgaatagctgtgtgaattagaaaactgtgaatgagtctaattatagtatgctagagctactgctagatgtacataaaaacgatcaaactcgggcataaccactgtgcagatgaatgcttttccatatgtggatgcttacactagcgctatgtctatggcaatagctctgattagattgcaaagtagcccctaagatggcacagctcaactgccattccaattttgacagcctttttttttctttttgccatttagagagagaaagaactccccgtcagatctgcaaagctgcaaacccagccacaggcttggtctgttttcttggccctctcagtattttcctgcgtcctttctgttcctgacttggctcaatgcaggctccccactgagatcattttctctgtataactcttccccttctggccagctggtcctttttggaggctaagtattttgtatccattggaagtctccctctcattttcatagcaccttggggaaaggtgtttctctgattattgcacaaggtccctgaatttaaagtagttttcctcttttttaaaaaccactttgttgaggtatgattgatatatttaaaaactgtacatattcagtctatacaacttgataaatttggggataaatatacacccatgaaaccatcaccaccatcaaggccataaacatatctatcacctcccaaagttttctttttatttgcccaaattaatttaactaatattcataagatatcttttgtattacgtaggaatttgggatggcatataagaccatgttgatttatgattttatgtgttaactatgagccttgggagactcaggatttatgatgaaagagttggagtctttctagtgggcccttatatgacaaatgtcctaggctcctcactggcactgctccccgctcaaaaagaaaaaaagaaaaaaaaaaaaacttgacccaagagacagtcccactttgtgaacatcgtatattctttagaacttttttagttatactatgtcttcctgaaggttcagtacttggactgcttatcttagttgtaaaatcatcgtgagtttttataagggaaggaaaatatatcgttttcaattctccatcttgaagacccttagaattatgttaactgttgtgacctttgcagcacattcggaaaaagtgttccaggagagtttgtgattatttaattgttccacagaagaagagctagttgggatattgcttggatatattattttatgtcctatttttattaatgactccctttaaattacagcatctctctgttagatgaaaaggccttatttttatttcaaaagcatcgtttattatggttattctgttatttagaatttattgcagacatttcatctacatataatttgggtggtgcattttctagttgctatataacagatatatttccataacgtggcaaaatgtaaagaagctggcagcttggggtatttatgttcagccctcttcagattttccttatggttttacagatatgaattgtaatcatgctttgtactttgcctgagattcattttccagtccaattttaaatccccaggaaaaaaagcatttctacctgaaaacattttactgtattttagttatgtgcatatgaacacacatacacacacatacatccatcgatatgtagtacatttaacccactgtagttttttgttattttttttgatatcttaggtttacaaggtttgtgtgctaaaatggtaaatattatctattaaatcatatttttagaaaataattaactctttgacccaggatattaacagtaattgagaaaatcagggttggctggaagaaacaaatctgacctattgctggaaataaaaaagagctctcagtgattttttttattaagcatcatcttggcaatgaatggtgttttgttaatgcagcgtttttcttcatttttctgaaaaatggctaacctatcttaaagcagatttggacaactcttgactatatgcatggaatacactcagtcctctggtggctacaaggccctaacatccctgttacagcacagcaggatactattccttaagagccagttagaccaggaattgttgagctctcacacaactgtcttctcacaggaaaactggatggctgtcattgaacctcaggggatacagtgaccttatgatgcatgtaatttaattatgcataagatcaggcagattaatgacatgacacttatttattaatttaaatctattagtattaaaattgtattcacattaatatagtttctcagaagctatcagaacagaaagtaccaataaaacagaagaaatatgccaacccctacacactttatattccaaaccaaccaaatagttcttcccatgtatggctcagattttcctctaaccttgacttttctcattaaaaaggtagtagctctccctgcaactatatttacattttccaatcctacctattcataaaggcacaatgtgaataccatcttttctgtaacaaattcttgatagatttaacagtaaataatttctccccacccttaattcctatttgggagtttattccactttatgttactgttattttttgcaagtcttagctttcccattatgccacaggctctttgaagggaggatctgagtttaattcatctgtgagaatcactttcttgcccctgtccatacacagtactttccacaaggtatctgctccatgaatactgatagaacgaatgaatcaaaaatatttaaaagtttttagacagagaatgtaaatgatccaacaaattatagcataataaaagctgcttttaacctctccttcattctggagtccattatagcatctagtctcagttaaatcttggattgtagactgaggcaagtcagttctgtcccacaaaattgtctgtgatggtagatatattttatatttgcactatccaatatggaagcctctagccacatgtagctgttgagcacttgaattgtacctagaccaactggattactgaagtttgtactttatttacgtttattttaaacttaaatagtcacatttggctagtggctactgtattggaaaacataactctggaactcagaacaaatggcgacgttcatattgtattaaaaaacttcagctggactgcaactagggttcactaggctgagactttcagggtaatgcaagtacatggttgacccttaaattttgcactcaaggacaccccatgtgcttcaccttagtctcagccatgcatttcagagattactagccagagtttcttactattgacactttaccctatgtttttgggcccatgttaaaccacagatggcactgagatgctattactgactattgaagagtcatgttatctaaagaatgaattgttcacagatctaatggaatttgttttctgctacagtgagaattatgatgttttcttttattcttttcctttcccataggagccttttaaattatcaaatcttctttccatattcaaatcgaatgttatctcctctatgaagtgactcttggtgctttgtatattcacttctcctgacaaaagtgtggtagaaatgccaagtgttagctctatagaagtgccacaacatgtgagttatggcaaagaaaaattcaacaagtgctattaggtacaaccaatgagcccccgagaaaccaatgtggtctgctatttcttaccacccttaaaaacacaaggagaattaacttcactgtgcctcagttcccccaccccacagcatggtgatgctaacacctaatttatgttaattttcttaagtgctgtttaatgagtatctgctatatgactgatatttgcactaaaggcagagatttcattcatcaagagagattttgctttttgtttcacagaatagacccaacaattaaataagcaattgcaataaatgtctatcatgactacgaaactcttgttttagtaaatggaacagagtaggcactcattaattccagtaatatcctttcaaatattaaagctgaggagtctatttcataaagtccaaagagtaaatgtgttagtaggacataaccatgttaaacaattgtagattaattttaccaaagcttgttggtaaaggaagaaccattagaataatctcctccatgaagtaatgatttgttcaagtataacttataaagtccttcagagttaaaaatgaaaggaaaaaatacattttctctagttagcacaattggtaaaattaaacatccctgtattttgatagctacaagtagattatagaaatagaccatctgggatcgatgattaacctcccccccccaaaaaaaaaagttgaatgctagaggacatcagttgaatgcattttaatttcatgttattattggtagttttgagctgcagttatttgggataaggttaattcgtagactttctcccacaacaaaagcattgcctttgccgaagcccttttgtttatttacttgctgattgcaatccagcataacagccacatttacaattaaattggtaattgaccatttagatcactgttccccatgcaacactaaacttgtaagtaatgattcaggcattaataagcaagccacacaattttaaaaatgcaccacaaattttatatctacctaatgaattgataaatccagaagaaaattccagttagatactatctgctataaaattaaagatagaatatgaacaaaacatagcctaactttagttatttacagatgagttatctagtttgaaaggttcttagattgtcttttctatattttggtcatcacagtgtcactgacattacttcaccaatgcatggataaacaatgaagaaaaaatgacactcagattagtcaacttgcatgctataaagggcttgtaatagtgttgagcctgagataagaagaaaaaccaaaagggtatgtgggcctgtctgtgcctgtcttctaataacgcatctcgcttgtttctactatttttaagaaaaatgagagttggctgtattagaatctctggttagttagggatcctcggtttcctcttgactacatactctccttgtgtttttaagggtggcgagaaataataggccacactggtttcttaggagctcattggttgtacttaacagtgtttgttgagtttttctgtgctataactcacttattgtaggactgctatcgagccaacgcttggcatttctgcaatatttactattttcttaatgtgtttattaactacttccacctctttctatgcacagatagggggaaaaagacaatatggtggcttgctacatcttttcagcaagcgtcaaattgtacagatatccagtctcttcattgaccccatttagtctggctgttaaatactgagaaatagtcattttaagaacagcaaggccctaggaactgtctattgttgctaaccctgagatacattttggaatcctgaatcaccctcaagtgatttagttcactaaatacctcataatgaaatatagacatttagacatatagatttacttacttgtcattaagcctagggaaaaccaagacttgcaatctttaagtcccctttcaattctaaaacttcctgacaatgagcaatctgacagttatatcatgatacgatcatgtctgccactgcttcagtgctaattcacattgaattgccctttcctgcctctcgactttcagattagttttgataaaacatgaatatggtattttctagctgatcattctgatttctaatctgacatgttgtcatatttttatttatagattttggtttacaagtcagcactccagagagatttctggttttttgaccttcactaagggtctctttcattcaaataatatctgaatatggtataagtatctgaatttcactcatattataaagctattttttaaaatctcaattataaaaattaaaatatccttcattaaaatataatttttttactaattataaacttaaaaagtttttaattgacatgaaatcacatgttagtgtacaacattttattttgaagtatatgtacattgtggaatgacaaaatatagctaattaacatatgcatgacctcacatagttatgatttttgttgtgagattactttatatccactctcttagcacttttcaagaatgcaacacattgtcattaactataattacatattgtacaattgatcttttgaacttatttctcctatctaactgaaattttgtatcctttaatcaaggtctccacaacccatcacccaaactcctacccctgcccgaccattccagcccctggtaaccatcattttactctcggcttctaagagatcaacttttttagattccatatatgagtgaaatcatgtgatatttgtttttaatacctgatatttcatttaacgtaactggaatgattatcaaacattatcaaaatgatggaaatgtatagaatataagctcttaggtccaattaaacacatacactactcttccgccattcttgccatcaacattgcaccccattaagtttccaagttgaataaagcggaaggctttattcaaaatgtcatctcaagacttttttgaatggcctgaggcttagcagcagttcttagttcagtagtctattgtggttaagaaactttattatagaaagttttaatgtgatataattaaaagttttgccattctgtttggcttctccaatcttatttccatgtgtaattttttgatattcaggatttgtttatggctttaccacagctttaaaataaaataccccttaataatggatatatatatatacacacacacacacacacacataccagtggaatactattgagccttaaaaaagagggaaatcctgtcatttgtggcaacacgtatgaacctggaggacattatgttaagtgaaataagccaggcacagaaagacaaacactgcatgatctcacatatttgtggaatgaaaaataattctactcataagaacaatgagtaaagtgatggtagccagaggctgagggaggggagattggggagatcatgtccttgttgatcaaagcacacaagttttagttagaaggataaagttcaaaagatctattgtacaacatgtgactattattaataacaatatattgtatatttaaaaatagctaagagagtagattttaagtgttctcagcacaaaaaagcattatagtatgtgaggtaatgcatatattaaaaagcttgatttagtcattctgcagtggatgcatatatcaaaacatcatattgtgtaccataaatgcatacaatttttacttgtcaattaaaaagtataaaattaaaaaatatagtaatatgtcatatcagtgagctttatcttatacttgttttctattagtaatagaaaacatatcagttaccttttccttaagagcctagattattgaaaaaatattttattgtgaaaaatgtcctacataaaaatagtgaatatttatgatttataaaaagataataagataagcaccttaatactcgtgacccaagtttagaaagagaatacactgataacatcagtctccaaaaataaccacactcttgaagcttctgtcaatgattccttttcttttcattatagttctactacatgtaaatatttatatactttattatctaatcttgtttttaaattggtatatatggaatcatactaaatatgtttttccatgttatgttccttggcctccacattatgtgtttggtattcattcaggcttctgtttgtaactgtttgttttactttggattccctgaaaatagattctgaggtgaagaattgcatgcagaaatttcacctaagaatgctctaaagcagtgctggccaatagaactttgtgcagtggtagaagcattctatacctgcattgcctaatagagtagctgtagccactagccataggtgacaatcgagttagtcaatttaaaaatttaaaaataaatttcaacatccacatatagcttatgaactatggtactggatagcagagctctagagagacatacctgtaagaaagtaggaagcagaattggacagaggtagaagctgactcagccagtcctctgggcacgtctagaactgggataggctgtcaaaggtgtccccagttgaagcaaagcaactgaactttagtatgacagcatgagacagtcattggtgctgcctcctagaagaaggagcaaccttgggtgagtcagctcttcactggaaattaagggcaatttccagtgaagagcatatctgtgagcctttagcagccaatattaccagaagcaagtattacaggatactgggagtgttgcttcattagccagaaaactttgtggccagtggcacctttgcctgagttttgctcgagcccactggacttgtttcacccactcacactggcaggccatgcttggcttgtgctactggcctggatcccattccttcaagggtgaaccaggcatgaagcagtgaggggtgtatgagtgagcaagcatggagtccggctgctctgcacagccaggcacactggctgtggtggggtaggcagctccagatgctggcatgggtgccagctccctgcaaggctgcagctggtccaggcttgccacaagcagcttccactgctggcaccagggaacatggtggtgcctggaagtctggaacaccaggaaccatagagtcccaaagaaggtgtcacagccctggcttgggagcttctagtctgggttccccgaagggctgcagctcttctcttttcctctcttctctccttcttattgcccgcaacatggtgagcaaggggcatgtttctgccctgtttgtgttacagctcttttagtcctgctattcagtgggtcccaagttcttgtctcacatccaggaagaatgaggtacaccgacaactaaagggtgagtaaggtgaagaggtgctttattgagcaacagtacagctctctggagactcgaagtgggtagctcctatccataggcaggccatcctgtcaagggtgcagttttcagcagacaagaaacccagagtgggtagctcctatcatcaggcaggtcatcccaacatctgcttagctctcagctgaaagaagaccctcagtgggcagctcctctctgcagacaggtcctctgaatgtctccccaagtctgtctgagtctggggtttttatgggcttcaaaaggaggaagtgtgttctaattagttcatgggtggctatgagagggcccagaaaaagcaccataagttctcattccagtctgtggaactggcagcccagcccccagcttcaggccttcccaggccctttccacccaggagcctatctgcctcccactgtcatcagcctgtcagcccaggtgcccaggctgtttgtactgagggacacctgcaggcctacaccaaggcagcctcagtaacccccaccccggcctccctctcatgcccctcagcacccaaagtctggaggggccaaggcagcagggagctggcatttctgcaccacctccagcaagcaaacacacctctgggttgtgacagtgcccaggcttagtctcaactttgcttcaaaattggagcaggcaccaggagcaggaagaggccaggcagcaggagcaggcatttctgagcctgctgaagaagggaggcatttctgagcctgcagaggaagggaggccttctagggcccctgagctcaggaatgctcaggtctgcagctgcacccagaggggcaggatttccattcctccaacttggaaggggtgggggcttctgcctgttcctggctcctgctagctctgtggagcatgcagtcctggctgcgcctcgccggctggctgcagctgtcatcttcacaacagcctctccagatgggctgccactgccatcattaggggattggcgctaagctctggagagattctgagcagatcactgcagtatccatgatagagctgatcatttatttgtactgctctataagaatttaattctataaataaaccacagtttactaatatattctatagatgataagagatttaggttatttccagtttgaggaggtatggctatggtaaaccatgtttctctaaacagtcctgtatatgtcttctggtgaataaatgcaagaatttctgtaagatatatacctgtaagtagaattacagaaagttaggatatgtgtgtaattgactgcactaggtaaagcttggatgttttccacatagttacagagtttacatattgcagcctctcattcagtgcctcaactgtatcaaatgaaaggtttattcaaaatttctaatctaccttgcagaaaataaacttggattttttaatatcatttttctctgaatgcagtgttgaaataaatttaaccctgtagtggttggcactaaattctaaaataaccaccagtgagtaatgctattgtttaatgcttttcccttgaatcttgactgaatctgtgacttgcttctagccaacggagtacggcaaaaaccataaacaaaaacaacaaatataaattcacatttagattattttgtatgttaaaggtaaaggatttttacagatgtaattaaggtccttagtaagtttgaattgaatcaatgaaaagaaggactacattgtgtgagtctgatttaatcaggtgagctcttttaaagggggcttcagccttttctgaggtcagatacattgtttttctggtcttaaagaatcaagccttcctgaattctagagatgcatggaaattaattctgccaacaatgatgtgagtttgcgtgaggaccctgaactcagatgaaacaccaccgccagccaatggctagattgcagccccctgaaacatagagcagaagacccagcggagctgtgcctggactcttgacccattaaaactgtgtgacaataaatgtatatttttttaaagctgccaaaattgtagcaatttgttacacagcaaaagaaaacaaacacccatttgcagcaaaatttcccctttttttaatcacaatattttattttctccatctgactattaccttttcttgagtattttttattagagtcagagactgtattctttctgtctttaagacaatccttaattcctggagaagagacattgaatatcattcaaattgctttcatgtagtatctagtagtaactgtgtcctttcaaataaatttttaactttcccaaggataaatgtacttgtaggaattcaaggattgaatagaagttatttatgtttatttcaaagataaaatatataaaaataaatttcctggaacatctaagaatacctaagtttaagaaaagaaaggtatgggttatagtattttaagattcctctaaagacaaaaaggggttttaagaagataacaatgacagaaacataaggaaaatttggatgacacctgaaacatagccagaaaaagcatatacgagtttaaattttataaagaacaatggaattatgttattacagataaaactagctgctaaattaaatacatttaaactcaaatatgagtaacaagttttattgttacatgaaagtctaaaaatcagtctgactgatactcaagtagtcttcctgtcatagtttgggttgtccaagagcagggcctaagagaaagactcgaaggtagtttatttgagatgtgatcccaggaaagagaagctgaatatgtagagaaaatgacataaagaacaaagaaaagcagtaacatgtgctatagtgagctggtaaatctatgctctgcttctctgagaacccattgaaaaccacatgaaacatatttgagaattgtcccagtggaagatggtgagttcaataggtttcatgatgtcccccagaaagacttgctgttcacccagaacctcagagtgttacctgatttggaacaagtgcctttgcaaatgtaactaaggtaatcatcttgagatgagatcctcctagattagaataggccctagatccaatgacagacattcttaagggagccagaaaaggagcagacacacagagaggagaagcccttgtgaaggcagaggcagagatcagtgttatgcagctacaaattgaagaatatcacagcctagcagccgtcaggtgctaggagagaatcatgaaatggattttccttcagagcctccagaaagaaccaaccaccgccccacagggctgcttgggcttcctcacagcataatggctgtattttaagagcacatgttcaagcatcaagagcagagacaagcattgagaattgcatttcttaagactacagcctggaaatagatcaattctgccatattctattggtcaaagtcacccatgttcaaggggagaaaaacagacatactttttgaaggaagaattgacaaataatttgaaactatccttaaccctccacacttgttaggtgtgtacccaagaaaaaggaggaacagattaggtgaacagctattcagcctctgtcatgattggagctttttaagctgtttatccttttaagcagtaactgtatattttgatcaacatcctatgaagtacttaaaacttgtcttaatccattcagactgttataagaaaagtccttatactgggtaatttataagcaacagaaatttatttctcacagttctgaggccaggaagttcaagatgaaggtgctagcagatttggtgtctgctaagggtccattccttatagatagcacagtctttctgtgtcctcacatggcaaaaggagtgaaccagctccctcaggcctcttttgtaagggcattaatcctcttatggagggttccacccccatgatgacctaacaacttcccaaaggcctcacctcttaatagtattgcattggtgattaggtatcaatgtatgaatttggccgtggggattagaccatatcacttatggattacattttcatatctgtgaacttagttacaagtatataatcataggaatgcatattaacaaatgcacagggcatgtagtcaatttttagatacagtatgggattttttttttggtacagcattccctgaaaaaagtgatgtttttatatgtagatacccatgtgtacgtggaagtttataacatttggagacatcagatactagaacatttttattatgttacactaaaatcttctctgttgaacattttactcacaagtaaaagtattagtattattttcttgaccacaagaaacaaatccaagttatcttctagtcttctgtacaacaacccatcatgtatttgaaatcagctatcatgttactccagagtttgttatctttgttctaagcactaccagtgcttttaaagaggtgatatatgaagcagaaaataaatgctagccagatatgatctattgcatttttcttttttaatacaagtgtaatttacctaaagagaaaggagcagctattagtttattaaaatggtagtgttttatattcaagaaactttcatatgcatgtctcttggatcctcaggacctcgtcaattactacagcatataccataaacttaattaaatgtaagtattcccccattttggtaataaatatataatattaaatatattctacacatacacttgctataactatcagaaatatagaaatatatatgtatatattatcatttcaatattaggaatctaaagttttgaagagattaattctttgcccaaatttatacaataaattaaggtaagctgagaccacagtaaaagtttctgatcctatgttcagttactatttttctattataacgtgctgttaaataatttatatatttaaaattccacattcagaattgtaatattttataattatgtatagtttaattaactatgtacagtctattcaaattcaaggaacaattttgagatgttaaaaaccacttagagtgctcaaacactttgaaatgcagttttggcaatttaaatgtcaggatacctctgactcatttaaactgaaaggaccctgtaaagactattgaatattttatggtaatgaaactgaaatactctaatatatggaaattcctagttttgtttctaaccaaattaatgtatttttagcttttgataattactcttaagaccactagttgctcagtttttttgttttcagttattaatagcaacagtcttattatgttatttgagaaaactagtaatcccttagtaactattaattttaaaagtaatgttttatatagggtctagtatgaaagtctatcaacagctagaaaggatactacataaatacctagtaaactattccacttcctcttaaaattagggaattgtgtgtagttggaaattcatcaggtctgaaggtgaaagatacatctttcattatcatgacagaatacaaaaatctagcaaactcatgactgatactggcacccaaaagtaagtgtattactcttgtttctaaaaagcaagtcctgtttttaatctgactttattataagttatcttttatagcctttattataccttttttaatacctttattataagttaccttttacagtgaacttttcctacgaacatgagacttcataagagcagtgctatgtatgtaaggccaaatttgcaggccatattttcagttatcctgatttagtaggtctacaatagaggctctaaaatcaactgtatttctatcaagcaacctacatggttctgatggagaagatccgtggaccagacttagaaaagcaatggtcaataggagctgtgaatattggccccaattccattccacatacgtttcttttacattctctgtataagttgcaattcacactttgctcaggtatttttggtatgggttttaaaattattattttttagttgaaagataaattgaatgtatttatcatgcacaacatgatgttttgaaggatatatacattgtgaaatgactcaatctagctaattgatatatacattgcctcacatagttattatttctatggtgagaacaatttatatctattctcttagcatttttctagaatacaatatactgttaactatggtaaacatggtgtacaatagatctcttgaatttattccttctaactaaaattttgtgtcctttgaccaacagctctctaagcccccacccccaaccctaccctaaccacccctgcccctgttaacaccattctactatctacttctatgagatcaacttttttaggttccatacatgagcgtgatttttgtctttctgtgcctggcttaatccccttaacataatgttctccaagttcatccatgaagcaacatttccgttctttaacactacataggattccactgtgtttatacatatgtatggtttttatccactcattcattgatagctacttaagttgattccatatcttggctattgtgaataatgctacaatgaatatgggagtgtcactatctctttgacatactgatttaatatcttttggatatatatacagtggtcagctgaatcacatggtagttctatttttagttttatgagaaagagactgttttccataatagctgtactgatttacattcccatcaaaagtgtgcgagagttctctttatgtcctaaccaacacgtgttatcttttgtttttttgataatagccattctgacaagtgaaaggtgatatttcattgtggttttaatttgcatttccctgataataaatgatgctgagcatttttctgtatatgtgttgactatttgtatatcttcttttgacaaatatctgtttaggttctttgcccatgtttaattgggttatttgtttccttgctattgagttgtttgaatgtcttacaaattttgggtagtaactccttatcaaatgtatagatggcaaatatttttctggttctataagctgtcccttcactattttgagttctttgttgtacaaaagaacaaagtttttgtttagtgtaaacccatttgtttatttttgcctttgtttcctgtgcttttgggatcacatccaaaaaaatcttaatccagtctagtgtcatggagcttttctcctgttttcttttagtgatttaatagcttgtggtcttacattgaagtctttaaagattttgagttggtttttgtgtctggtgtcaaataagggtataattttattcttctgcatgtggatgtctagttttcttaacatcattgattgaagagattgtcctttaactattgtgtgcccatggcatatttttgaaaatcaggtggctaggatttatttttcagctctctattctgttgcattgatctgtgtgtctgcttttatattagcaccatactgttttggttactatggctttgtagtatattttgaagtcaggtagtgtgatgcctccagcttttttttctttttttacacaaaattgctttggttatacaggatctgtggtggtttcatacaaattttaggatcgttttctcaatttctgtgaagaatgccattggcattttgatagtgattgcattgactctgtagatcactttgggtcatatagatattttaacaatactacacttccaatccataaacattggacatctttttattcatttgtgtctttttaaatttcttttattcctatttatagattttaatttagatgtctttcaccttctgggttaaattaactcttacatattttttgtagctattatatatatgcacccagattcataaagaaaatattactagatatctaaaaaatctaaaaatatcttttaaaaagatacaaacttcaacacagtaataatggaagatttcaacatcctactctcagcattaaacagatcttctggacagaaaatcaacagagacattggacttaaactgaacttgcgaccaaatgaatctaacagatacttacagagcattttatccaacaactacatattcttctcatcagcatgtggaacattctccagaataaaatacatgttagtccacaaaacaagtttcaaaatattttaaaaatcaaaattatgtaatgtatcttctcagactacagtgagtaaaactagaaatcaatagcaagaaggactttggaatctatacatatacttggaaaacaaacaacacactcctgaatgaccattggatcaataggaaaattaagatttatattaaaacatgtcttgagagagagaaaaatggaaatataaaatattaatttctgcaggacatagcaaaagcaatgctaagaggaaagtttatagcaccaaacaactacataaacaaaaagtgaggctgggctcagtggctcactcctatagtccccacactttgggagacttgggaggcagaggcaggcagattgcttaagcccaggagtttgagacaagcctgggcaacatggcaaaactccatctccgcaaaacgtacaaaaattatcctagtgtagtggcatatgcctgtagtcccagctactcaggaggctgaggtgggacccagaaagttaaggttgcagtgagccaacattgagccgttgccctccagcttgggtgacagagtgagaccctatcccaaaaacaaacaaaaaacaacaatgaaaaaaaaaactcagaaagatttcaaatagtctcattgtacacttcaagcaactagaaaagcaagaataaatctaacccaaaattagcagaaggaaggaaatgataaaggtgagagcagaactaaacaaaatagagactaaagaaaccaatgcaaaagttggttgttcaaagagatttaaacatttgataaactgataactagactacccaagaaaaaaagcaagaagctcaaaacagacgacctcagaaatgaaaaaggagacattatgactgatattttgaaatacaaaagatcaccagagattattattaacaactatacactaaccaactgaaaaacctagaagaaatgaatagattcttggaagcatacaacttaccaagattcaatgaggaagaaacaggaaatctaaacaggccaataatgaggagcaacattgaatcagtaatggaaattctatgaacaaataaaagctcaggacaggatggattcaatgcagaattctaccaaacatataaagaagaatgaataccactttttcttaaactattccaaaaattgaatagagaattctccctactcattctatgaggctagcattttcctaatactcaaaccagacaaagatacacacaaaaaagctatagaccaatatctctgataaatatagatgcaaaaatccttatgaaatactaacaaactgaatgcaacaacacattaaacagataatgcatcatgatcaagtgagatttatcccaaggatggtagcatagttcaacatattcaggtcaataaatgtgatctattatgtcagcagaaggaaagacaaaacccataggattatcacaatagatgcaggaaaatatcgttcttttataacaacggtgagcaaactaggcatagaaatatcatacctcaaaataataaataccatatatgataaacccacgctaacatcatactgaagggggagatttgaaagcattttctctaagaaatgaaacaaatggtgaaaaatgcccgctctcaccactcctatgcaacatggtgctggaagtctttgccagagaaatcaggcaagaaaaataagtaaaagtcaccaaaattagaagagagtcaaactgtccctttttgtaaatgacatgatcttaggtccagataatccaaaagactaccagaaaattcttagaacttataaacaaagtcagtaaagttgaaggatacaaaatcaacatacaaaaatcagtagcatttctatccaccaataatggcatagccaaaaaagaaattaagaaggcagtctcattttcaatagctgcaaaaaaatacctaggaataaatttaatcaaggaagagaaagacctctacaaggaaaactgcaaaacactgatgaaaggaattgaagaagacacaaacaaatggaaagacattacttgttcatgaatcagaagaattaatattattgaaatgaccatactacccaaagcaatctatggattcaatgtaattcctatcaaaataccaatgccattttttacagaaatataatacacaattctaaaattcatatggaacaagtaaagagctgaaatagccaaagcaaccctgagcataaagaacaaacccggaggcatcatgctatctgacttcaaaatatattacaaagctattgtaaccatgacagcatggtatttgtatgaaagtaaacacatagaccaatgaaactgaatagaggacccagagataaatccacatatttacagccaactcatcttcaacatagattccaggaacatacactggggaaagcacactctcttcattaaatgatgctggggaaaatgtataactatatccaaaagaatgaaactggacccctgtctctaccgtatacaaaaggcaactcaatatgaacatgttaaacctgaaattataaaactactagaagaaaacagagggaaaattcttcaggatattggtcttccgaaaatctttctagggaaagattttatggctaagagctcaaaagcataggcaacaaaaacaaaaatagactattgagaccatagtaaagttaaaagcttctgcacaacagagaaacactcaacagagtgaagaggcatcctcttgaactaaagaaaatatttgcaaattattcatcctacagggcactaatatctggaatatacagggaactcaaacatctcaatagtaaaaaataataattctattaaaaagtgggcaaaggatatgaatagatatttcccaaaagaagatatacagatgtccaacaggtacataaaaaatgctcagtatcactaatcatcagggaaatgcaaatcaaaaccacaatgaaacatcactttactccagttagaatggctataatttttaaaagacaaaaaatatcagatgctggcaaggacgtgaggaaaagggaactattacacactgttggtgagagtataaattagtacaactactatggaaaacagaactaccatagaatatagcaatcccgctactgggaaacatgtactcatgtatttattgcagcattattcacaaagaatagtggaaagatatggaatcaacctaagtgcccatggtgaacgatgcccactttcaccgcttctattcaacatagtactggaagtccttcggtactatggaaagatatgaaatcaacctaagtgttcatcaagggaacaacagataaagaaagtatggtatatattcataatagaatactacttgaccataaaaataatgaaatcatgtcattttcagtcacatgggtggaactggaggtcattacattaagtacaataagccaggcacagaaagacaaataccacatattctcatttatatgtgggagctaataaacttgatgtggaaatagagaatagaatgatagataccagacactgggaaaggtgggttgtggcgagggttggaggggggcaggatgaagcagggttgattatggatataaaaatatagttagatacaagaaataagttttaatgtttgatagcagactagggttactatacttagcaataatattatgcacatttcaaagtaattggaggacaggacttgaaatgatatcaacaaataaaaatgataatcattcaaggtaataaataccccaaatatgctggcttaatcattatatgctctatgcgtgcaaggaacactcacatgtaccccataaatttgtaaattattatatatcaataaaaggagaaaaaagaatgctctaaaactgggtgaaaatcaaatggaaattaacttacagctagaccttgattgtgcctataattctcaaactgcaaatgagtgctcaggagttgtgacatttgagaactcaggaagtgcaaaggcatttaacaaaggtatcaatcattttgttccctgaaagcttttcttctcattcaagatatataacacaaaataaaagttagctccatattattaatgtgaggtgatggttgccgtctgtatatataaactcaaccaggtcttggcattgaggctaaagagaaaaaaccgaggctactaacttgtgttatttgcagttaagaggatgtggaaattaagataaccctcagtttacttatctctaaaatgatgataatggtatttgactttagtatttggaaataaatgaagaacatccaagtgagaatacacagtttatttattcagacattgctatagcaataaagtcagctaccatcactagcacttggcagagattgaaagtcaggcagggaagtggaaaagccttataataaaaaacatggaaggcctcaggtgtgatgtgtttggagcatgttagcatgggaaagctaggagtcagctaaatggaagtgacacatcctgtgtgatttgtttagggagtatatttggctttctcttgttggttttcagttaaaaattagggcaaaatataaggaagctggcagccattgaccaaatccttaccattccaggtcagttgctgcaaaggttgtgatttggcctcctgcacttgttgatgcagagattgtgggccagagttctatcagatatggtctagacattattcatttgtatgttcagtcttcatggctaacagttttttaaatgagaattgaattgtaatgagttgaaaatatgcctctgttgctgcttttggaagtagtggaggtagcattaggtggtaagttgaaggcagcagtatctggaagagagaagaggggcatgtggctccactgatgtcaggaatgtcccaataggttatcttgagctaggggaagaggacttagagaaattctctttctcaatcctgtctaaatgtagagtagaataattgccctctattttcctagctgataaactgtccacattgctcttcacaaggatccttgatctcctgggtatctgaaactttaggttctacttctaaactgatggtgaaccccaatattggggcccagacaaggagtgttcttggcatcatgcaggaaagaattcaaaaatgagccaacggagtaaagtgaaagcaaagcaagtttattagagcaacagagtacaggaaaatgcctgctccgtgacaaagcagggctaccccataggcagagtagcacttgtggatctagcaccagttagctagatttatagctactccttaattatatggtaaataattttctagaaaagggatgtggatttcctggaactgagggtttctttcctttaaaccatgtaagataacttccaggcattgccatggcatttgtaaactgtcatggtgctactgggagtgtccttcagcatgttaatacattataattagtgtataattagcagtgagggcaactagaggttgctttcttccccattttgattttagctggtttctttactacatcctgttttgatcagtgggatcataaccccactgatgtggagaacaagtcctgctgatctcctacctcaaaactaatgagagagggcccatttttctaacctatgaacttctatagctaagatttccttatctcagaattatgaataggtaaacaatcaatttgtattcagaagaagttgcaaacacatcatatgagagctatctagtgaatgatttaatattattttatcttgccacatatttctcacattttaaagcttacctcttttaaaatattcaggcttacatctatcttgctttcctttttgtttctttatatctaccctgtcctgattattcaaattcttggcatcagcaaaccttgttgctaagatctttaatcattgcttagctgccatgactacagctaccttgctttgcacattgcaaagcacttatacacacacacaagcacacaaattctttaagttctgttcagaaataccacagtccctttggcctctcctagacctcctcatttctagagcccttcacctaatctccattcttgattcccattcccatgagctgaatgacgaaacacaaatatcctactgacctcaatttcctgtcctgcctttttcactccttgtttcctctagatctgtttcttcaccttcccttcctttttttccttccttcctccagaccaaaatatatatttgttctagcacttcagtaattctcttcaaatatttaaatctcattctcctttcctgtttttattgtatgctccggaagcacatccaacattctggcttttaggcttcaacattcaacactggagaaaactcataatagtccagcgtagtgtcactacaagttcagagatccaccccacactgcttggcaatgccactatgggtccaactcgaggctgtctctcattcctcacaggtgcaatttcaaacttttactaccccaccagtacactgtgcaccacctcttctctgaagaaggaaattcctagctaatttttctcaccaccaacaaggcttatctgcaagatatttttattatcttactcagagcaagtcacattcttatttatgcttgaagctaattattccacatagactccggatctcattctcttccgtttcagcaggggcctctctcctttacctatgtctcttataaaattttattcttattgttttttagactttttctccaaggttttgtctgtggtcacatatttatctctctctttttgagtaatctaatttattccataatttcggctgccacatatatactggaattttttttgatctacatcaacatgttcagaatgcttttgaaacttcagataggtctacctaattaccttctagattcctccttttctctttctcacccattagtcaataagttccaacaattttacttattaactctttaagttaataagtaaactgccaagtcatttagaacacaaatgtaaccaagtaatcctatgtttaaaatcttttaaatggtccttatcatgtttggtttcaatgcaaactccctgacatgacacacaaaacttttcatgatttgacccctgcatttatctctctagtcttttatttcccaaagtatgttcagaagaacacttatcctgtgaaaagtctggcacgatgagatgggggaacaggaagggaatggagggctttagcaagttcaaatccatttaagaaactaatgctttagtattacctcttagagaagtggttctcaaattggtttctggagcagaagcaccagcattatttgaaaggtcactctcaatacacattttcaagctttaccctagacctactgaatcaggaaccatgggtcccaggacctagcaacctgtctgtgtttgtgagctttcccagtggggctgatatacactaaagttggagaaccacaatcttagagaatcaccatgcacattagcatattaaaggcttcaggaaatctgaaaataacgtatttaactttgtttaagcaaaaattttgaagttagttgagcccttgtgtgtgtaagtacatgatactaacatagagtagaacaaacgttggagaagcacacttcatcaaaagctgttatagcccattttactcataattattcaaatatagtaggcatctgtcatgtggttttgtgtgtacacagcctgtctttgcatttttcttttttttttttctgtgatggaatctcgatctgttgtccaggctggagtgcagtggcacaatcttggctcactgcaaccgccacctctcaggttcgagcaattctcctgcctcagcctcccaagtagccgggactacaggcatgtgccaccatgcccagctagtttctgcatttttagtagagatggagtttcactatgttggctaggctgctctccaactcctgacttcaggtaatccacctacctcagcctcccaaagtgctgggattacaggcatgagccactgcgcccggcccgtctttgcatttttctaccagaggtctcctcccaacccaagtcttgtcagctccttagaagcagcgtttcacaattacatgtttattgaatgaatacattgaatgccacagaaatattttataacagttttaaaagtattgtataagttccactaagttgaagatatcatttgttatttcaatactgtcttttgcatgtaatggctctttctatatactgatctcttcttgatggaatatacttatattttcttatgtgatatcatgaaagtgtaatatacatcccatcagcttgtctgtaaaaacttttctctatatgcttttctgtaatgaaatgactttgtaaacatgaccattggaactttcttcagataatcctataacctggcaactttccactttcaaaaaattacctccccattatacccttacagattttctgtaaagtctgtttcttcaataatctattaacaaaataattttagtcactattataataattactataattatgattgatttactgggtcatattttaataaatgtatttttatttgctattaaatgatttataattaccatattttcttgatataacaaatgttatttcataacattattcatagtaatgtttcagtcaatatgaatatacttattataagcttttcttaatttctactacaataaccttaatttttccaatcataaggttaaatgccctattagatttctagggtatattaaaaagtttcacatagagaaacttaattcttaagaaattgagtaaatattataatacaccagatgagacctcatcctttcagcatgcagtctattacaatacgctattaaagtagggaaagcctggtttatgatagtattgtgtgctatataaaaacttaatgattcaacatccagtttgatttattctaatgcaacaaacgttatatgatgtgaaaaatagcatcatcagtaatcttctggtgtcataaaaaagagtgatggaagtacaatttgcgacaggtaagggacttgggaatgaatgcatatttcaactacttctgtctctcctcctttccatgtcactctttgcaaaaatgataagtggctgtgatgttacacatatcatgtgtaataattttctttcatttaatcacattacttaaaatatgtaagacatatattttggctatgtacatatgacgataattaatgatagtgttctaatacaaatatctccccactgtggctattagaagtagttttatttatcaccttcacaactcaccaggttatctggatttctaaatcctttagaaatctattgagcttaatataatgcacaaataattacattatagtagtgataacaaaattctgtttacaaaataaaaataaattttaataaaatttctaacttaaaaggcagcaaagcttgacatttgtaagcctgcattactgtccattacttcctaaagattcactaatataacccaggaattgaaagaagaagcttgccaagaactttcaagttgttctcggggatcatatatacatacttcttaaaatcctttggagattgcttatcatttattctggatatttgaagtattttgtgtcagccactaatttttttttaccattttaatctagttctgcaagttttaacatctgttgcatttcaaacataaatgtaaatcaaaggctcttggatgtatcctagggaaatatatgctcttaaaagtacattatagtctaagaatagaggtgtctagtactaagtgagttcactataggactgtctttcaagttacacgagaataattaaatgacaactcaacaaaatatggttacatatcatgatttgcactggaacatatgcatatacaaccattcagccgagagggtggctgatctggtcacagcagaagacatggcaattggatatggcaatagtttgggccaaatacaatctaatacccattttacattagagtctttgagtttctggagccataagttgatgttttcaaatatcctgcacctataagcttgtaaagggtttagcaaaacttttcatatacttaagcgaaaatgtatctctgcctatatttttagccaattttaacaagtaaatgtaaaagaagtgctctaagaggaacacccaccaaaataaatgaccagaatagcttatctctatgttgtaaagaattgcatatgttgagtatgaaatttatatgtgaaacattcaagattgatattgtactctgttaacctcaaagtaaatctagatcatcctatgtcacattctgctttctagactgagagttgaagactttgagcagtgtggtaaattgagaaagtttcaaagacattttaaaaaaaggaaaaaaagagaaaaagacaaacttacaaaattttagttacctagataaatttgtgcgtaagaagggagaatttaagtcaattaatgttgcatatatagtgtgggatttaacagtactgagtttgagtaacagtactgacaggcagctgtcagttctgcatacttactgctgatgtaactttgagcaaaatatttaggcaagataaattttatgcatacacacacgcacacacaaacacacacctttgtacacacaaaattcaatcttcatccttggaagaagccacattaaaggcataatttctaataataataattcttaaggtcatgaacttgtaatcatcagaggcaggaaaaacctctaatccagaacaacaacaacagcaacaaagcaatggaagttaaaccaatatttaaaaagtgattagaaatacaagccaggccactgtgagtttattctatgggatgtcattcaatgaagaaaagaaacctgagtttaacagctttgactcccataatctaagtttcatttccacaatcatttttctttgatcttctatttgacagtgacatctaactaaagtcatcccatttaaccttttcttttgcatgttgcgtgaacttgtgagcagagtaagaaacaggatattcctcgtgaagatcagggaccaaccaccaagaatttggatttttggccccaacttattacactgatggttactattattgatgaggataaaactgcctacacacctgtcctgaatcagtaagtacaatgttttggaaatgaatggattttattccactaaagttcaaataatacatattttaagcgcaacatatactgacgacaataataaacttttccataattaagctatagaaaatagtatttttcaacttttatcagtaaatatcaattaaatgatattatgaatttttagtttgagctccatggagtatgattctttggatatggagaaaaatattttccaagatttgatgtttatgtaatgtaaaacttttcctccacatcctttcatagctataccattgtctcaaaagaaaaaaatgtacactcccccaaaactaaaaataattttgaagagctagtgttaaacatattgcattgtggctttttaataataaagatttggcaaaaaacctgctttcaaaatagatgtgcatattgatttaacaaatttaataacatatttaataaaacaagttgattttcacaaagtataatctaaagttcatgcctctaagacatggcagatgaattaaaattcatgactattctagaagagaccgtaaaaatcctcattttatcaaaatacaactagctgtgtgaccttaggcaaattatctaatttccctgggtctcaatttcctcccaactaaaataaaggtgttattattagatgatttccaagatccaatccaactttaatattgcatatttagattttattttacacccacatattaaagaccataaaagcaaaaataacatcagacttccagctaggcacttgcagtctggttaatgaagaggattgtcttgacaatattagttagacctgaaatgttatgggtagcaaagatagcagaaatagacaaacaatgaagtagaacagtgaagtagactcagacttactatggataaatgactgtattcttatcctctatactggtcaagaccgttagggtcattgtttatgttcagtccaattaaaattccagttaaagaagaaatacatttaagtatttcagtcttcatccttttctacttactattaaccacccattttcaacagtcccccaattcctcctaattgtggagagagtggtcctatttttggtatacaatcatgataatatcaagtttgccctttcactttcttctcccttttcccccacacctaattcttatatctgccttttcttcctgatggcctttgtgtttcctaatctctgtacagactttgctcttctattctcttctgttaggactagaagatcttctcttaatctataacatgtcgtcatcgcatcatgggtcctgggaagtacatctcaggtctctgacagctttgtagaatagagttgtgttttcttatttactctttggacctttcttgaggacagagtagttttctgaaagattgggagaccgacaacttgtttcaagactgtgtccttggactgggataggccattttacaaatggatactggatgaaaacaaacatctactgagaaacacaaattcagttctatgaagaaactttggctttaataatcaaagaaatttcttatgtttaccaagtatcttaaatcaggatttgatcagtaaaaatacattataaaatcatggaagaaattaaagtatccatgatttatttgtaatcatgtgccacaaaatatatacaaagattttagttgactttatgtaactgtagtaaagaaactggaataaatacgtttatttatggcaaaaatagatttaaaattatgaactaaattaagcctaccaagtataaaaattagcaatgacatgtgcaaaagagaaaattgtttttgtttttttcaattttgtttttaatgtcagagtttaagtccacttttttcctttggaaacctgtccctgaaaaaaccaaatgccttcctctatttggaatccattttttattattgtgtttggtcagattttaaggatgctgtaaaactttttttcacatactgaagatcgttcaatttagtttctcatttaatttaataaatgccttaagtgaactcatctggagaccaagatggcatcctggtggccaatgttgcatttgtataatgtggtgagatttcatttatatctgttactttgtttgaatactgcatcgtcacatttatgcttaattaatcatctccttggttacctaaactaatgcagaatttcacaaagtaaaaaatccagaccactagggtaaggatcacatgggctactagctggatttgcagatctgagccccatcccaaatctgtggagtcagaaaacctgcaattgacacagaagtctgcaatattaataaacgatccctgttattgtgtcttatggtcactaacaatgaaggcacagatcaatatgtgaaggacatgctaaaagtagcttgggttttgttttagaggcaaaggcaagtgaatttaatgattttaaaacataggacattttaaaatctctttcaatgtaatccctgattattgattcagatcatttagtgaagttcttattgttatcatgagtttgagaaatcattgtaggcttttgcttactcaaatttgataacaagtttacagtgacggtagactataagcatgagggaaaagacttgtattttgttgactaatgtatattcaggcatacatatttgttgaatgaattaataaattaaagtaaatttatacatgtagtcagtgtttgttctgtctattcccatgttgatttattaatgaactacagtgtttatttgagtaatattttctcaatttttaaaattatttataatgaattttagatgttttagaaatttcaatatttcattaaaactaaatagtattaagcagagtactttcagatttaggtccaggtttctgtctctttttctttctctgtctttctaacaggtttattgaggtataattgaatataataaaatttcacatatttaaatagtctaatttgaatagttctggcatatgtatttagccacaaaattattgctattttcaaaataatgaagatatccattaccccaataattcatccacttttgtaattcatccactcctccaccatccccaggcaatgcccctcatctgctttctaatactatgaattagtttggaaatgttatcattatgtgtaaatgtaatcataaattctctccattcttttgtctggctgcttttattcattacaactattttgagtttcacccatgttatttattcattacaactattttgagtttcacccatgttattgtatgtttctttttatttttgagtagtattccattgtacgtatataccacaatatgtttattcattcatctgttaaaatttgtactttttcaagattaggttgctatgaatatttgtttacaagtctttgtatagacatactcttttatttctattgagttacgtggtaagtatgtacttaatattaaaactgccaaactgctttccaaagtggctgtaccatgccaacacttggtttgataaatcttttagttttacctatcctaacaggcatatattatctaactatgattttaatttgcactttcctgaatcctaatgatactgaccatatttttatctgaatatttgaaattcatatatcttctttggtgaaatttctgttcaaatcattttcccatttccaaattaggatgtttatcttattattgttaagttgtaaaggtctatactagataaaagtctgtcatcagaaataaatgttgcagtatatgcttctagcttgtaactttcttttccattatcttactagtgccttctgaagagcatagttattgcgcatttttaaaaaaattttgatggaatagtccaatttattgatcagtttcttttatagtttaagcttttaaaaaaattctattttagaaatctttgcaatctgcacagtcagcttgcaacacaattttcttctagacatcttacatttaagtctataattcatttcaagccaatttttgcttgttaactggtgtgataatcaagtttaactttctttggatcgttttcatatggttatctatttttttatctctacttgttgaaaattattctttcctcattgaattgctttggcatcttggagaaaactcaattgactgtatatgtaagaggttaattctgaagttctttgtaatctgttccactgatctatatagccgtaattacaccagtactgcatgtcttggtcactatcattttctaacatattttgaaatattatagtaaaatttactcaactttgtttatatttttgaaaatagtttggctcttctagctcctttgcaattccatttaaatttgtatcagtttgtcaatttctacaagaaaaaggtctgctggacttttgattgatattgcattaaatatataaatctattggggaggaaagaaaacagcaatattgaattttataatccattaacatggcatgtacatgcattaaggtcttatttaatttcttattttggtgaaaaggtgttacatattctttgttaattggtttctaagtatttttattactatcttaaatggtacttttaattctaatttctcattctttgttaatagtacatagatatacaaatatatatcttcagcctttctaaatttacttttttgtaggttcctcatgattatttaaataaattatattcttgtctaaaataaatatggttttacttatttctttccaatttagatgtattttattatttttcttgccttattgctctggttaaaatcttcagtacaatgttgactaaaattagtgaagagcagacattcttgccttattcctaatctcatagggaaagcatagagatttttaccattgaatatcatgttaactaactgtttttcatggataatgctttatcaagttgaggaagttctgttctgttcttattattccgaaagtttttatcatgaaagggtgttggattttgtcaaatatcttttctgctcataatagggtaatcacataattttgcttttcaacaatcagtatggtgaattgaactaaggaatttttaactttaaaccaaccttgcattcctggaacaatctccacatggtcttgatgtataatctttcctacataatattatattttattgataaaattttgttaagtatttttgcctttgtgtttatgaggatattgctctatggttttattttcttatagtgcctttttctgtcttttatatcaatgtaatgatggttttatagaaagagttagacagtatttcctccagtataatttgccaaaagagtttttataaaatttgacattttcttttctgaatttttgatagaatttactggaaaaatcatccgggcttagagttttattgtaggaggtttttaaactaaaaatgttatttcttcattagatatagggctatttagtttacctatttgttcaaataggtaacctaaatttaggtttttgtagtttgtatcttcaagaaaattttccatttaatctaagtggtgaaattttccatcatgtagttgtttatgccagtctgttattatttttttatgtctattaaatctgaactgatttttcctctctcatccttaatattgatattttgtgtcttctctcttttgttctgtccaactgtctgaacgtttataaattttactggtcttaagaaacagcttttgattttattcaatgttttgttttttgttttaaattaatttttttctcattcctttactattgtctttcttctgttagtgaagataaatcttaaatggttatagcagtaatccagtgagaagatatgaaagccttgtataagatgatggagagttaaggttagatttgtgaaataaatcaaaagatctttatgactaaatgcactgagtggagtgttaaggaagaaagtagagaccatggaaatgtcatatttataggggcatcattattggagataagaaatacaggaggaagtatccatttaaagaagttcacagtgacttatattttgatatacagatatttggttacctgtgggtcttccaagcattatatgcaacagacaattgtatacatagataagaaagtcctttaggttgatatcgattaaatacataatgtagagaagttttgctatatgtgcctaaaagtaagaaatcttaattatttctaaatattcataaaattttactcattttacttaaactgtcatgacttcatattactttgtttttgttatgcagaccaaaacataagcagaaatatctttcatccattctgttatctcatttgttcgcatgcattgtactataacatgtaatttcttttagttttctccaaaaatatacatacagtgaagtctcaactcattttctctctgcattaagtgtagatagcagaaagtatctcaatgtattgagtagaaaatggaccagttttaaaagttgtcttttccatttgcaaggataaaatctgcctatttttcccctctcggggttatgtgatgagccagaacattagtttcaaattgcatgtttttaaagataggatgttttatttgctgaagtgaggaagtttaggtttaagcgactttgatcagggatttgtcctttgttctttctgttttggaaataatgttcagagtattaaagttcttgatttgtttgcttacactatggcttccctaaattacttttatatttaagaaattgttatgaaagtgtttatcctactataaagtacagagactatgcagtagagtcctgtatatccattattcaaattcaacaattatcaaaattttgtgatgttttcttcatctatattcttgagttttcaccttctttttcttttggctgagttatcttaaacaaacttgagacattctatcatttcatcccttcttagtttagtatttatctctaaaaattatggctttcttttgtacatcacaactaataacattaacggtaaggccctggtattgtgtaatccctattccataatcaaatgctcctgattttctttaaagaagattttttttacattggtttgtttcagtcaggatccaaataaggtgttagcattgcatatggttattatgtgttacaggtctctttcatactagttaagtcccccctcccttttattttatttataccgttgacttctgcaagaagctatgttcattatcctttagaatatgccactttctgggttattccatttgcttccttgtggtgctatttaacttgttccttcatagtcattactctccatagctgaacatttcagattcatttttttaagaacacttcataagtgactgtgtgtatttcatactatgtcacatcaggtaggacattatctggttattcccttgtagtgatgttaaccttgattagtgctgacagtcttatttcttcattgaaaatttcttcatcaacctttcctataatggtttcatttatttatgatcacttcagaattcgctattttattagggatgacaaaacggtgggtttttatatttttttattatactttaagttctagggtacatgtgcacaacgtgcaggttttttacatatgtatacatgtgccatgttggtgtgctgcacccattaactcatcatttacattcggtatgtctcctaatgttaagaaaatgtggcacatatacagcatggaatactatgcagccataaaaagtgatgagttcatgtcctttgtagggacatggatgaagctggaaaccatcattctcagcaaaatggtggttttataaggttaccatttcttcaacatttattcattagaattttttgtaaagaagaactttctttcattaattaggtttacttacttggttacccatatgtgtaataaatataggaaagataaggtaaatatttaattatttcttttaacctaaagtattttatctcattcttttcttttctgctctattgaacttttatcatctttcattaacagtttcatttcaatttaataaatatgtattgaacccttaataaatatatgccagtcaccgtgcaaggctagagtcacaaatatttaatttgtaaaagagatatatacgaaattaatcaggagtctgaaagtggttaactactgtgcctgccacagtcacaagtcattctgtgattaaactcctcctacacacccttgttgacgcagccttatgagaaaaattttgcacaataagagaaactaggttcactctctggaactgtaccaagaaatactaagagtgaatcggctgacagggagaatagacactgaaagtttatgaatttgaagatacctgtagcaggtgatcaacaattaagtcagaatgaagtataaacaggaacgaagatcgcgtcgagagagaagaaggtagttgacagtgagtggagggaaaggatacttggaaggaaaagcagatacaagaatagcagagtcacgtactggaggactttgtgcctgatgatccccatctgtggtcgttcaacgcactcttcagcgctgccttaaatccggaaggagcatcttgtctgtcttgtctgagggtccctgaagcctgactccaggggctgtttgactccagtagacagagttcagcttttcttgggttccagtacaatgtggtaatggagtttagtcttgtttctccattacccaaagtatccttacaaaaattactttttaattatttgtagttacttgagcctctgatttttggaaccaaagtagcataactaacccaatataatattatatgaaatgacacatgtatttcaatatagttgcagtttgtttgctgttgaaatgtaaaaaaaaaaaaaaaaatgctttaatttgaattcttaggatctaggtgaacggttcatttcctacaagcaatcagttttgcagacctgcagttcatagtgggcagaataggtagcgaaaaaacccacagatctgttgtaaaaatctacctaacactaaagatataaagtaaaatttcaaaagtaatttaaaaactgttactcatatatatcatagccattttgaattttaaaacagatcaagtgtgttactctgcagttttctaaaatattacattatatggaaagaattcaaatacttttctaagtgcataagggtactgccaaagaatgcttaccaataattatactaatttaaacacctctgaagatttcaattttctacctccctgaccacatatcacagaggtgaaaaagagttgatcttgaatttttcaaggtttgtcatgcttgctgaaagattttaacacaactagatatttatatgttataaatatcataatcattatatagggaaccatggggaattagctggagacaggcactattctaagcatttttacagtttaatgtttaatcctaaatttattctaatgatatcagtaccattatcatccccaaactgcagatgatgaaacttaagcatagagaggactaacttacgcaaaatgacttatctagtaataggcagaatcaaaatgtaagcagccctttgaaataacaaaagggttaatgttaacaaaaggatcccataaataagatggtgagcattaatccttccaaatatttctgatattttaatgattaatctggatctgattgcaacatcttttaggctttctatgttttagaaattaggaggcaaaacttaattcatgagaccatatcaggatttgtagagataatgcacagaaagcacctggcctaatgcctgcattgagtaggtgctccacaatggtaatctccatctctgctctactgccttaagctccctgccctgcaatatgaacatgaggacttgcttgtaccaggtcttgcagttcgagaaacagttatctaaactcagtaaattctgttgactatttaccccatgcacatcacacacgttatttaggctgtccctggccatctccaactcctttgtcatactgccaggaggtattttcattgtcttatgcaatgctgatttcaagagttaacttagagctgggctcatgctggtatgcctagctacttgggaggatgaggcgggtgggtctcttgatcctaggagttcaaggctgaagtgagctatgatcagaccactgcacttcagcctgggtgacagagcaagatcctgtctctgacataaataaataaaaacttttaaaaagtggaagccaggagcagtggttcacgcatgtaatcccagcactttgggaacccgaggcaggaggatttcttgaggccaggagtttgagatcagtacatagtgagaccccgtctctacaaaaaaatacaaaaattagccaggcattttgccacatgccagtagtcccagctattagggaggctgaggcggaaggatctgcttgaacccaggaggcagaggctgcagtgagccaaggcaacactctgagcaatagactgagcaacagagtgagaacctgtctcaaaaaaaaaaaaaaaaaaaaaaaaggcttacatagatccattcacagttttgtttttcatgttaaaattaagtatatacttaaatatctgagttcattaaaataatgccttgaaacagaaagcaaaaagataaaaagggtgattggcttcaaatggcacttatgatcaacttgctttatggtacaagagaacctaagtacaaaaggaaaaatttctaccacagcattaattcgtaaggatggcttgtaatttactagtagagtcctgattaataaaatttatgcttagttgttcactacattcatgataatagcagttaattgcactaaatacatgtcaagcatcttaagtgcagagcatactaacaaaggcttaataagttttataatgtaaaaagggcacaacaaactgtctcttaagttctagctatgacaaagaaatttcagatgcatacacgacaggcagttacagagaaccattgcttacttatttgtaataattaacctacttttcttcaaagacaaactttgcatatcaaaataatacttctcatttaatggattctaattttatccattgtgactgatgaatcagtattatcaaatttggcagtggcagattatgttttcctcatttcactaagaaatttgcaagataataaattggattattaaattgttgtgtctcataagattcaagatttaaaacatttgtgctttgttaattaattgctgcaaattaaaaacaggagacagtcacataatggtggaatggatcagttatttcattaaacctcctctttatgatggtagattaagttaagctatgactgcattgaaaatgaagaagaggtagagctctaccttagagaatttaatttgtgcacaagaaaacctcatgaattcagattagtgtgagaagggttaatttaaatatatatggtacataggaatatttaatgtaccatatttatgtgtacttcttttaacttctaagtatgtatgacaatttctacaaagttacaaaatggttgtggaaaggtaaacctctttcagttttgcttctatcacagttaggaatttatttgtagttaatgtatgaattgttagtgtatagctcagtacttctgaagttcataaaaccattcagtgctgtgagtacataaacattttcctttgcaatcaagtttattgctattaactttattaacaaattttctcctacagactaaatacctagtaagtacaaatataaattttcattcactttatgtgattatttttatgttagaaatcaatggaatctaaataatattttcctgtctgtctcatttatacttagaatttcatcattatcagcaggaaacatttattgagtactcactatgtgccagtgactatgcaaaatatttacatgtaaaatctcatttaatcctcacagcagccctagaaacagtcccaagttacacaattaatatcatccccatttgacaagtgagaaaatggagttttgaagagattactcactgctccactgggtaaatttgctaagcagcagaggagaaatgaaattgctgtcttttggaatgcattgctatttaacttctatattatactgctatgtattatgcagaagaaatggacaaaaatgtgttaaattttggaaaataagcctctagcaaatatgcagatggtatagactccttaggtagcccccaccaaaaggcagaagtattcaattgtggaatgtcagaaaaacaaactctgccttttaaataatgatttgatactgggactacagcatagaaaaagcgaataaaaaatttagtgtcaaagtgagattacatatttacaagtctacaaaggcaagttagacatggtgaaaaaacactattatggaaatattattttgtggccccttaaaaattagaaacgtaaaatgtagccattagttacccagaaattgataaaatctatgttgtctgaaaaatggagtgtttctcctttcatttccagtaccggctttcctctttcacttactgtattttactcataattgttcattttttctcccctatttccacaaggcagaaaataataaagaattgtttgggaaactgttagctttgcaaatgttactaagttatattctggctgctaaaatggtttgaatagtatggagagaaaaaattatatacatatgtaggtattgagaagactgtgtaaatgtaattaatactgttagtttacagtaaagagatgctatgttgagagaagtgtggggggggaaagaatatcttatccttctatcctctgagtcctcagctgtagtcactataacaagatccattaacaagagaagagcatacaaatttatttaacataagctttatatgacacgggagacttcaaaggaaataaagacctgaataaatgattaaatttgagtatattttgtgctaggttcgacgaaaagtggagaattgcggggacgtgtatagaagcccccagaaaagtataaatacagtaaacttggaaaagcagcaaggcctgctcattcacattccttttgacatccctgtcttcaacgataaggatgcttctttctttccttttgatataggagcagcacctctcacataaggatcttatttcctgcttcagagaaagatcagaaaatcctttctaggttttacgtcttgctgcaggggaaaatcataaagtcctaactgcatgtgccatttctcagattccttccacttgaaatatgcaatttgccaaggtgccatattttggggtagcatgtcctaaatcctgtcaggagaaatgttttataatgctagacaaaattgtttaaagagaaaaaatgttattccccttattttcatcagtttggaactacaaagcaaacatcaataacattgtgccagttcagttaaaccttgtgtcacgagtacaattatggaatttccacagtataaaagcaccaatcctgtcactaattcttaatattaagtgagctcagacccatttatagtcactatgcacttctctttgcccttatcattcacaactatttaatcattgctaattctgccttgaatacaacagaacacttaaagggaggtgatacttgagctgtgctttccagggagagagagaggttattatctcatagaaattaagaagaagagagaacaggaaggtggaaaatgatcagaagatatatagaatgtcaggcgtgtcaagaaataataaataataggggtagctagattattcatagtaagggttggggaatgaaggtgaaagaaatgaaagttggggccagatggtcagagcaggatagtcatattaatgaattgaaactattatatgctaataaatgtgtgacaagcaatttatggttttaaagcagtagttagaaatatgatggcctgtgtttttaaaaggtaaatttggtgataatatagaagatgtatcagaagagggaaaatagaggcaaaggcataaactaattgattagtgcaattattaaggcaaatgaaggtaacgacttgaattaggaacagggaagagagaggcaaattccataggtagaccaaagaaaaaattcccaggagggtggaaaggaggggacactgtggatcgtggcagaggtggatgactctggtagctatctaaattcattagctaaatagtattgccattaatttaactatgaaatacgtaagaaagagtaagaaaagttcttccaaaggtacaaaaagtaccatagagtggaggtaaagtaaaataaaatacaggcttcggaagaacttgtgtaactgttaaagaaagaaactttgcattctttttattttctatcatgggatatctattatctctataggtaatagcacaaccaaaattgaaaccagtgtatcataatgttttataatggaaaaaaacttctaaaactgatcagaatgagacctcagaccccaaatattgttttcggtatagaagcagatcttagcaagaagtagatcttgagatttaaatttaaagagggactactacataaaatatgaagccaataatttaaactgtaaatattttgaggaaaaacccaatagcctaataccaacaaaaaagaaagaaaaagttaactgtgaaaacattttcaatgcatgggaatttttttgttgtaaaagaaaagaatgggcggggtgcggtggctcacacctgtaatcccagcattttgggaggccaaggtgggcagatcatgaggtcaggagatcgagaccatcctggtgaacacggtgaaactccgtctctactaaaaatacaaaaaattagccgggcatggtggcgggcgcctgtagtcccagctactcgggaggctgaggcaggagagtggcatgaacccgagaggcggagttgcagtaagccgagatggcgccactgcactccagcctgggtgacagagtgagactctgcctcaaaaaaaaaaaaaaaaaaaaaaaaaaaaaacatgggcaagaaccataggctctgtttctgattctgtctttgattcatttcatgttctagtacactttcctaatctctaacgttactaagtctaaaatgaacgttattaaatttccctttacatctcctctaaatatcaaacaaactcattgaatattgttttttctttattggaaagatctcagtgcttaactcctgaccaccaatttttgaattagaaataataacaactgaataggggttttgtgagaaacaaattaatattatccatcttttaaaagaactcacgtatatagtaaaactccgattgattctacttcaaaattgaatttcaaaaatgatatgattacaaaaataatcttattcagcttcacaggctgtatgaagtagaaaataagagttctaatgtttatttatcatttctgtgaagtaaatcagtaaaaattaaaagcgtgactccccaacctaagctttacaaattttcagtagtttggtgtgttttcttccagctaatctttcacacatataaacatagaaattcatttaataatgtttgcttctatagtgttttttatgaaatatgcgatcatattttatatgctaatctataatttgctttattcacctaatactgcctgagagacatctattcatgtcaattgaaagagatctgccttggtcatttcaatagctgcatatttttccgtggtatcatttaacatcaggatgatgcagccaatgaggggactcctggggcacagacaagagaaggggatagggacaacacagatattggtatagaaaagaactgaagtcctgtagagagtcattagataactatgagaaaatcaacttcaacaaaagcctgaattttcatcaatttttaattgtttccagtctgataagtaaaaaatttttactcttattaaggtgaacagctcctttcttgtgtttattaggctttgattttttttaaatttccctttcatctcagccacttttcctttcatttcttctatagatttttaacatgttaataatatgttccttttatattaataatattctttttgtcttttatataagctgtatatatttttccagtttgttgttttattttaaatgggggtttttgttttgctttttctttccaacttttatgtgaggttcagtgggtacataggcaggtttgttacatgggtaaattgtaagtcatgggggtttgatatacaaattattccatcacccagatgataagcatagtagccaataggtagtttttagatccgtactctcctcccaccctccaccctcaaggaggtcccaatgtcttttgttcctttctttgtgtccatatgcactcgatatttagctcccacttataagtgagaacatctgatatttaatttgtgttcctgagttaattcacttacactgatgacctccaactccatccacgttgctgcaaaggacatgattttattcttttttatacctgtgtggtatcctatggtacaaatgtcccaccttttctttatccagtccactgtgtatgggcttctaggttgaattctatgtctttgttattatgtatagtgctgtgatgaccatacaagtgcatgtgtctttttggtagagagatttgttttggttatattcccaataaagagattgctgagttaaatggtagttgtattttacgttctttgagaaatctccaaactgttttccacagtggctgaattaatttacattcccactagcagcgtataattgttcccttttctctgcaacctcaccggcatctgttatgtttttacttttcaatgattgccattctgaccaatgtgagataatatctcatggtggttttgatctgcatttccgtaatgattagtaacatcaagaattttttcacacgctttttggccatgtgtatgtcatcttttgagaagtctctgttcatgttctttgttcatttttaatgaggttgcctgttgtttttgcacgttgacttaagtttcttacagattctggatattacctttgccagatgtatagtttgcaagtattttctcccattctgaagtttgtccctttactctgttgatagtttcttttgctgtgcagaagctctttagtttaattaaatcccacttgtcaatttttcttttcattgcaattgcttttggggtcatcataaaatctttgccaaggcctatgtccagaatggcattttctaggtgttcttctgggttcttatagtttccagttttacattgtctttaattcatcttgagttgatttttgtatatggtgaaaaagatccagtttcaatcttctgcacgtgactagccagttatcccagcatcatttattaaatggggagtcgtttccccattgcttttgtcagctttgtgaaagaccagatggttgtaggtgtgtggccttatttctgggctctctgttctgttccattgttctatgtgtctttcttggtgccagtatcatgctgttatggttactgcagccttgtagtataatttgaagttaggtagtgtgatatctttggcttggttcttttttcttaagattattttgtatgtttgggttctttcttggttccatatgaatttagaatttttcttctaattctataaaaatgtcatttgccaaactgctttccaaaacaactataacattttgcattctcaaaagcaatgtgtcagagttccagctcctctgcatgcttgcatgtttgctagcccttagtattggtgggcttctgccttttgttttttttaagctattctaatagacatgtagtatcacatcataattttattggcaaatatctaatgactaataatgttgagcctatttgcatgtgtttatttcccatctaatttttttctctgctgaagtgtcattcaaatcatttgcccatttttattgagtaatgttttttctctattattgagattttagtgtaatgtatatatcctgatataagtcctttatcagtcacatgttttgcaaatttttttctccctgtttgtggcttatgtttttgttttctcaacagtgtcttttgaagatcagattttaattcatgaagttcaatttatcaatattttattttatgggtttacacctttgtgttacatctagacaatttttgcctaatataaggtcataaggattttctactatgttttctttcagaagttttatagttttaggtttggcattttggtctgtggtcctttttgagttaaatgtttaatttgttgcaaggtatgagtcaagatttttttcttttttgcatgtggttattcaagtattttagcatctcttgttgaaaagactgtcctttcttcactgacatactgttacacattgttgaaaattagccactcttgtaagagtagccactcttgtcttgtagttgaagacattctgtataaattattatattttcatagaaagctgcaaatacaagtaatgtttgttctttacttttaaaaaaacattttttcctcttctagtgcttttactttgctatgtcaattttagaatcagtttgttaatttccacaagaaattctgctagaattttgattgagattgcattgaatctatgaatcaatttgagaaaagataaaattctaacattactgagtgtatcagtctgtaaatacaatatattgatttaggccttatttaatttcttttttcaatacttcatagttttcttcatataaatcttgtacatattatcttagatttataagtatttaataacttttgatgctgcattagtccattttgacactgctataaggtgcacacctgtagtcccagctactcgggaggctgaggcaagagaatcgcttgaacccaggaggtggaggttgcagtgagccaagatcgcacaaccgcactccagcctgggtgacagagtgagacttcatctgaaaaaaaaaacaaaaaaagtgcccgagactgagtaatttataaaggaaagaggtttaattgactcacagttccacatggtgagggaggcctcaggaaacataatcatggttgaaggctgaggggaagcaagcagcttcttcacaaggcaggaggagagaggcaagagcacaggagggaactgccaaacgcttttaaaaccatcagatctcatgagtactcactcactataagagaacagtatggaggaaactgcccccatggggattacagatccctccctcaacatgtagggattacagtttgagatgggatttgggtgggaacacggagcaaaaccatatcagatgctattataaatgatactattattttaatttgaatttccaatagttcattggtagtataccaaaatacatgattttatattctgtgaccttatattttgtagcttcttaaattagttttttagacattttctatgcagacaatttttagtatgccattttttatgtagaaaaccatgttgtctgtgaaaagtcttatttcttcctttgctatctatatgccttttatgtatttctcttgcattttaacagaatttaggaactccagcacaatgttatgtagaaatactgagagtcaacatcatcatcttcatccttaagtatcaagtgtgagacttaactataattttagcagtagggttttgtagattctctttatgaggttaaaaaagttcactttactgtctttcagagggattttaaatcatgaatgaatgttgaagtttgtcaaataccttttcagcatctattgagatgatcataaaatttttcttccatagtctaacaatatggtaaattatgttgattcatttttgaaggttgaattaacattgtatttttgggataaacctctcgatcataatgtattgttcattttatatattgtgagattaaatttggtattttttgttgaagatttttacatctatgtttataagagatattctttagttttttgtgtgttttagtttttagttttagttctttagttctttgtttcttgtatattgtactataaagttaacataatcttattcttgattcaaataaattaaaatagctaagcaattttgcctttttataagcataaagtactcttattatatcacttataattttgatgccgcatattaattacataaaatctaatgtactacaaaatgtgttatgctagtatttatgctcaaatgaaaccttttgaaataaattgtttgcctagggttatttttatatcagtaaagtaaaatttaatattgaaaactaatttatatgtattcagattgtattaaattttttagaaaagttctgaacttaaatacttgataaatgtaaagcttctgatttaagttttaaaatcgaatgccttattagacaaattgataaaattggcagtcagtaagggaaactgatgcaacacactctaattttgatgaaaatatggactagagtagttctgtatgtgtcaatagtcttttcttatttgaggttgttttgaggtcatatttccttaggtaacactttccatacaggattatactctttttttattcgaacccccaaatgtggatgaatgtgagagctagctctgttctttgatataaatatttttattcatgtgtgcaagtctgtatatatatagagagaaaatacttctagtcttacattctggcatggagtgagtgtttacactgtaataaaaagactcggtcatcatattcattgggcttatattattaagagccttatcatgagactgaaaacacatgcaaacaaaataaatttttagaagcagtcagaatcttgtttttaacctaagcttgtttagtctaaaacacagacctgcctggaagttctggagtacagattagtgggtgtgtccaccaggagccattttgccagagggagtgaggaatctttgttcatataattcacatgaagataatagataatagaaaaaatagaagtacttaattgtgcttcaaagaaaatggctgagggacatatatgaggtgtgattttttagtgtcatatggtgtttgctattcagcttcatctgatctatcctcaaaagtgagacataaaaagacggagtcggccaggtatggtggctcatgcctataatctcagcactctgggaggccaaggtggttgaatcacctgaggtcaggagctccagactagcctgaaccaacatagtgaaaccctgtctctactaaatacaaaaaattagccgggcatggtggcacacgcctgtaatcccagctacttgggaggctgaggcaggagaattgcttgaacccgggaggcagagattgcagtgagccaaaatggcaccattgcactccagcctgggtgaagagtgagactctgtctcaaaaaaaaaagaagaagatggagtcttcgataaaagtgaaggagctcttgagacacaaacactcatcacaagacatccacagggagacccaggcaccattactttggcactgatataatgaagtctcttttcttaccatccaataactttttaacattaaactctagtgtgtaacatttttttttttacttacgaaagttcataaagagaaatgtcataaataaaagtatttatgaactatgtaataactactgtggtatatatgtaaaatgctgtattttggtttttaggcatgcttttcttcttcatacactaatacaatgtgtttggttttaggtttcctcaagagctgaacatgggaaaaataagtgccgaaattatgtggactctttttgctctggatatgaaatatgcattagaaggtaattataaatatttatacttattcgaatacatgttagagttaaatggtgatattgtgttcttggctttaaatgttgagaattgaaacattaaaacactgattactgtgatcagtttagttctaaaacttatttccgtatggtgaaaagataaggtctcaaagtactcaaaaagccctaaagaagtatatacatttttaattatatggtctaagttcttggatcataaaaatatttcactgataggattatgctcatatgcaagaatactttatggtagttcatttaccaaagcaggccatattgagggggtggatgagttgtttagtccagatatttgtctacgtggacttggaaatagtatccaccaggaggcgggtcaaaatcctaccaagtttgctcaagaacaatggcagaggtcttcacccgaaactccactctgaataagtacaaatcattcagtgtagaaaagagaaatacagctctaagttaaacaattctataaatattctttgtgcaccctcattgtgtttacagttagagatagaaccatagacctggttactatcctctagaaactaacaacctagtagaaaaatttctttgtacttattcagtgaatatatattgagcccatagatactaaatgaccattggtgcactggatgtaggggatgcaacagtgaacaagatagccctggtccccaccctcatcaagattgcagaggaggactacaagaatgcaaacagttgcaatgtggagtggtgaggacttatgatgacggagtgtctggagaagcacctacagcagacatggggctaggggacaaggcaggcttactatgggaacttcctctaagaaaatgtaactttgataaagacctaaaggataggtaggagtaagaagagcttttggtaggacagagcactagcaattagagaaagcacaaggtgcatttgagaagagagaactcagtgggcccaatgatcaagaaagaggtagcaagaagtaagacaggagaaattagcagggaccagcagacagggccttgtgggccatcgtgaggagtttgactctgtgctgagagaaacaaagtcccataaaggattttcagcaggtgcatgtcttacttagatttgcaacttagaaaaatcattttgattacaatatggaaaataggttgcgagagtgagacaggttttatagcgttcgtgtttatcatgctaatgtttaatagctttcctgtaccaggttgcagagggaacattcagtttttcttatttggaaaaaaaaggtactagatagatcataatatctagttttgtgataaagtcaggctctcccactcacaaatagagaggtttatctaatctttaaaatcacaccagaactgctcagaggtacaattccttactttgcaatgaggtgtttcttctacagtttattaatgacccagcccttcctacctcttccatctttgtctcctactaaccacatccttttacatctctctgctttcactgtctctttgggaccccaagattctcttacatcagacaggaactaccagtccactcagcaaataactttttttcagagagcgttcactaccctaggcctatactctgcatccccccaccctacttgaaagtctatcaggcatctgaagatttttagggtctgtatagattcttaatctcctttgtcagaacagactcttctctgctgttccctatagcagttattggtgccaccatttatgcagctacttaagcacttacgggttatcattgattcctttattgtcttcgctacagtaaaagtttattcctgcatgagggattttttggccagctgctctgatgcctggatttttcttcccaccaatcttcataagcagccatggagggctcagctactgacacctcctcagagaagatttccctcaccgcattatctgtagtagctcccaggaataaacttattttaatctgctgcgtaacaactgattttatttgtttatttgtttgttgatttgattatgtatgtgtcttttttaccaaaatgtaatttttttgtctatgacttttaccaacatatctacattgcctataatgatgtttagaaaatagaagctactcaataactacttgttgaacaaataaattgccaactttaccaggtaatcccaactcaatggattagtggcaagggcagtagaggagacatcattttgtgaccgtcttttgctgtgtgaccttgggaacattccaagagctcaacacctttgtgtttcactgttctccccttttgtttgagtagaacaaaactcagtgcattttcaaacatttattgcctttttgtatcataatgtataagctaaatgttatagaaagttgacaattaaccttaccatttaagttttagagtaaatttaaaacttactctaaatctatgtcttagagtaaatttaactggggacttgggtacaattctgcataactgtattttccatatttaactatgattcagcatacttcatatatattttgaagattaaagtgttttaatgctttttagtagaatagatggtcttactagtgacattttcaattatatgagattagagctttttgaaaaaaagaactatgttaaccatgtgtcagtccttaacacaagcctggcatatagtagttgctcaataaataatggttgcatgaaaatctaaggagcactaaagcagtgtgtaaatgaatatatatgagtagattagtgacataattcagaattattttcatttatattagagccaggcagttgtacattgttaaaatttcctatatgttttatgtatgtttgtttgtttgtttgtttgagacggagtctagctctgtcaccaggctggagtgcagtggtgtgatgttggctcactgcaacctccgactccctgattcaagccattctgctgcctcaacgtcccaagtagctgttttctagtcccttctatattgaagtacattgttcatcagtttaattgtccatattgatatttgcacaacagaatagtaaagctttagctcatcagaatgccttttagcctcaatccttacccaaaggctttctaatatataacaatctattttacattagcaaacacagcccacagaacacatggcaaaatgctgcttttatgagataaaaccacattttagccatcaaacagatttcacagactggttaataaaaatcagctgtcagactgtctaatacaaagtcgaaaaatattccattaaatcccctatgtcgttttagtggggaaatggagatcagggagaatagacgttgagaagcagggcaagaccaaggtggacagatgtgttctaggctcaccttccactgcttgttctgcatgtttcttcccgcaccctgtctgccctgccccttctttatctatatcttatgagcacctggtgcatttagggctttcgaagagattagacacactaaagcatttggggcatcctggttatcccttccaaaagatctgaaatcacaataaggaaataaacacattataattaaaaactgggagggttgggggcttggtaaatatatcctgcatacactgatgagctggaagtggctatgtgggaataaacataaaagacaataaaacgggagcaagaaatgaagctaattagcatccgcttttcacctctaaacacgtatctcagaaatttaggagattcttgcctcctttcatctttacattgaaggaaagcatcagtgttaataccattgacctaaacttggaagcacagttcctctttcacacttatagtaagcacattccacagtttcctccactggcagttcccttccaacccgcacactccctcctcccttgcaattgagttgaaactacttgttttgtatatctggagtagatagagaaggcaagctctgtataattaatctagaatcatgctgactaaaatatttggtttctaaataacagaagaaaaatagacatctaagactgtttgtaatgctattatttaggtacacctttgaccatctactaaatcactttgttatctatttcagtaaaagataattaaaatatgtttacctgagtaatataccatgctcttttgatagagatgaatacatcagagtaggtatgtaattaactggtcagccactttctctggtccaacttaaaaagtaatcaaatggaaagaacaggactaaactaacttctcaggctatgaatgtggtcccacttgtagtataggcaaatctatttgttgaacacacagctgggtgctctgatactattagaagttcaatggctaataacttcaataacttttaaatctgtctttctattatactatggtgaactttagcagaatctcacgtaaatggaaatgagtttccaaaagcccactgagctggtattagaatcaggatatggagacttacctgtttagatatttttaattagtagatggtcactatataaatagaacataaggccttaatgagtattttatccctgcctgaactcaaactctaagattctagttttatctcatataattctgcctctttggttttgaaataaggaacaacagtggacactgacattcaaggatttagttaagttacctggtcatctgtgctcctggaaaacactgagctttctcacatttttttgtttcagatggtattagaatttaaatttcttgttaactcaattcagagtctgtgttgtcgtgaatacagctggtctctcactgttgagcttggtactcactcaagtatgacaactttttttctttctctcttatatgaggcctcaggagactaaaaggctgagactgggtgatctttctctctccctcttacaacataccccctttctagttaattgttttagtagctaattatttttggtgtgcttaaggagtcagaaaagaataagatgaacagatcccctgcagtagcaccaaaatagtaaaagagaaactctcagcttggatacctaaaaaatataaggtttagggttagtgtatcagttacctattatgatataatgaattatcccaaaatttagtggctggcaacatacgtaagtagctcctgttgttgaagaactgatgggctgggggattgctttcctaggtgacatacttacatggctgttgagtagttgcgggctgtcagcaggagacctcagttgttctcagcatggacctctccacaaactccttgaccatctccaagatacagctgctagcttttcccaaagtgggcaatgcaagagaaaaggcagaagctgccatctttattatctatactgtgaagccacactcagtcacttctacaatatctcgttggtcgcacagttcagcttgttcagtgtgggagagagtatgcgaggtgatgaactctaagagtcaaggatacaggtgtcatcttgaaggctggctagcacaattagtatttgcctttctgatcatttctgtataatattagcatattcttattttaggtcaggtttttgtttgtgatgattttaaacaaaaataatagtcagtgtggataaaaccattttttttcccttcggcttcatttctctcagcccttcccataacaacaggaaaatgaggtgagcaagaaatgactcttgaaattttataaaaataaattattgtctaagatgctaaagctcttgttaaccctctctagttttcctcaccaagctcctctgggaagggaattctggttcactgaaaagaaattaaccagacactttcaggaaaggcattcattgatctactgtgctctcttcatttcagaacagtggttttcaacactgattatacattagaatcaccaggggtagagccttggccttttgaaacatgcccagatttttaatcttatttagcaattgcctatttagcacttgctaggtactggtttaaatgatttatgaatattaacttatttgatccccacaacaagcctatgaaataaatactatcattatcccccttttagagaggttattttgcctgaaattatattgcaattgaatggaagagccaagattcctggtgattctagtatgtattcatactagattgatgtattcatgattgagtaccattattcataacattaattacattttggtggccttcttggagaatctaataaaatatgtagactgtattactagaagaatgctaaatagcctatacatcaaaactctgcatatattctcccaaagatatgtatacaaatgccctatagcccaatcattgacttcttccaaggatccatggaccccaggttcaaaacttttgcttgctagagcagtgattatccctggaccagcagcatcagctaggcagttggtggaaatgcaaattcttgggccccatcccacatctacctaatcagacatcctgggaatagggcccagcaattcctgttttgacaaaacttccagttgcacctgatgtgcaccaaagttgagaaccactgctctagaaaaccgctgtgtggaagcaggtgatttaagtagcaaatgaacccatttcatgattctttatagacatctcattgttcttggctcatccttatgcaagtagaaactatcttctgttaaaacttggtttatttgataaaaatgatcaccaaaggaaaattactcacaaatattcatttaatttttcattaatacacacacttatgtattatgtattcaaggaattcccagaatgcttgctctatgccaggcattatgctagcaaggctcaatgcaacacaacaggcatgatccctgccttgagaaacttttactttacaataagcaaataattacacaaataaacatataagatttaaatcagtgatatggatgaaaagcatgtccattagacatctctaacttaaatgtttaaagtaaacctagaagtacaaccttctcacccaaaccctattcctctcttggtcttttttattacagcaaaatatgttaccatttgtggattatcagacattatctttgattccttatttctcttgctctaccaccatctccagacacttgacatagacaaatccataaatacttacctattctagctccaaagcatatttggctctcacacttctctccatctctactacctccaactagttctagccacaggcccccttcactttgatacctatcatagccctctaagtagtttgcacatttccactcttgctttcttatgatccattagctcataacattcagattgactttcacacacttagattacatcaagacattccctggtatataaaagtttccaaaggcttcctctttcaattgaccaaaatccattatttttactatggcgtataatgtagcatgtagtctgggctctacccatctttccaactttacctcattcacgttcctctcactcaaatgtagccacactgtcctcatgacttccttaactgagccaaatgtcttcccacaccagggcattcatatttgcttgcttttctgcctatgaagctgtttcccttctcttcatagagggctcctttccattcttcaagtctcatttcatggtcaccttcgttcacaaccctaccctgaccatcccatccctcagaacactcccacgcatctccaactcttttttctccccaaaacacttattatatctgaatcatattatttagcctggttatttgttcacttctttactactttttttctgtttttgatgccttttccttttttctgtttgtacatgttttggtcacaatccaaagcaaaaagaaaatacacttctacagcaatatagtacacacacacacacacacacacacaacgaaaaaaaaacttcatgaaatataaacatcatgataaagataacaaattctgaaattgtatttcttcatagctgtgtgtgtacattatatatatctgtatatacatgaagatattacatgtttataatatatagcatacatatatgacatattgcatataatttatgtatatatatttaaattctggtcataaccctctaaattgatgttatgacccactgatgggttgaagctagcagtttaacaacactgttcttaaaaataagcttcatagagtatgaaactttgtaatttcatttaaaattaaatactcctattcaaaaaataataattgaatattttgaaaatatattatgccaccttaaatctcacaaaatacatattttagatatattcagatatatttctatgttgataagtttgccagtataatacagcatatagataatttccccagcaatatttggaatttgacacaatttggggcctgtttttgtgtacctagctctttatttctaaatatacataaaaaatgttatatttatgcataaaaatgttttctcttcaaacaaattaagatattcatggtgaatgatcacatctcttgggcaaggtatttgaatggagcatttgaaaataaaaatctatagaaagccattattgccagaaggaaaaatatagtaagagttcaatcaagaaaataaagttggtattggctgaaaacaagggaacagagctaactgcattttgcatatgtcattatcataacatggtaggttttcacttatgtgaaaattatatatttaactttgtattttttctatcattttcctgctattagtttttcagccatgtaccatctgggaagagataggaggaaaaagaaaagagaaagtgatgaaaacttgcttagatttttcttccttattagtggtttttagaatttttttagagaaataataaattgaaagaattgttaaaattagtttagaaaatttcattttaaaaaggaaacagaaatatttacatgtcatggccttaggtgctcattgctgccttgctacctataataaagaggataaaattattcaggaacaaatgaatattatctaaactacttgaacttgaattgtggaacttgtaaatttggctgtctcctcattaaatcaaatgaatcacaagcccaacaatgcatgtagatatgtagatataaccaatgaaaaaaaaaatagctgtgactatttttgtaatatttcggtaaaaaaatctgtgactttgtttggagactgctgatactcagccagtgaaaatgttttggcaacaaaagaaacttgggaaggaggtagcagttggcatgaaatcagctttctagaaactttctcctgatgagaagcttaggaaaccatggttttttttgtttgtttgtttttatttggaaaccttccagggaaagctctgaagaaatgacctcctgttggttctgttgggttgactgtcaattacacatgtttgttttaagtgcgacctggctgcaaattgaggagaaggggaaaggacttgggtaaagcccatttatgctttagatcaaaccttttcaagcattatagataacattcacatgtgtgttatgctatcaagagaatacctgtaaatggtttgtggtgagtaacttcacagacatattaatcctatatcaatgggatattcaatttggcaaaaacaatagaattaggggcaagaaaatggcatttttagaatcatagtagaagaggaagatataggctagacctattgacagtctgctggctggaaaggacaggagcagcttggatcatggagcacatcttggagagaaaacaaaaatgtttcgtgggtaaattagtgtattgtgctgtgctctgctctggtcatccctctgcgtctccccaagaaacttcattgcactctgcattacttgtcattggaagggttctttaagaatgctccaaaatgctgatcttagcttcaaaatgtgtcctgataagccaaggctgacatgctatgtatacaatgccatgtgctacaagaaactccaggcctttctggcctaccagggaccacttcagcatgtgaaagagtatgagtgacattaggatatagtttattcttttacatgaataaacaaattatttgtaaaccttagtaccatcactagaatgagtagaaacacattacagtgagtaaaaactcacaattcactatgtagatggcagagttcaatgacaccgtgaccccaaatcactgctctggcttattggaaaaatacgaaagcagtaagtaaaaggataaaaactggacctggggctacaagagaagatttctacaatgaagggaggcaacaagtagtaagtggtttgcaaatgggagaattcacagtacaggtgaatcacaacccaagttatgaggctaaagaattttcatgctatgctccacataagaaaaacttacatggacaaccaggcatgagagatcttactaacagacccaaaggcaaatgacacctagaattaagtgattcctttctcaattattgtagtccctcttagtgctactattcaaagaaatttattcacctcctgagaagttagtctagatcagtggccttcacactgcgttctatggaacactaagttaaaatttcagggactgctttggtggtagctaaggttcagagaagaatgactactagccagctattttttcctctgtttgacatagtgtgtttattagtcatctatgcaacaaattatcaccaaagttagtgcataaaacaatgcaaatgcaaatatatcatcttagagaattttgtaggtcaggaagtctgatgtgggtttcattgggttaaatcaaggtgttggtagacagcctttctttctggagactctaggagagaatccattttcctttctctcacaagcttccagaggcttcccacatttcatggctgtggccatcttccaaattctttgtcagcaatatccaggtatttttctcatgactctaacaatgactctcctgcctccctcttccacatttacatgtcctgttgagtacattgagcagaactagaaatccagcataatcttttgtcttaaggtcagctgattagcaaacttaattccagctgaagccttaattcttctttgtcatttaacagaacatattcatattcagtaatctgggcatgatttcactgggtcctctgtcctagagtctcttacaggctgaaatgaaagtgtcatacaggacttggcctcatctgaaagttcaactggtgaaggttctgcttccatattatctcgtatggttgttgacagagttcagtttctcaaaagttatcacatggatggcctcacttcttccttggcatttggcctgtggccaccttcagtatctttacaagtagtgccctccaacatggtgccttgctttatcaaagtatgcaagccaagaaaccaagagtctgaaaacaaaaaaaaataaaagttgtaatctcttataacccaatcacagaagtgagaactcataacttttgttgtattttagtcattagaagcaagtcattaggtcaagtctatgtttaagggaaggggactaccccagagggggtaaatagtaagaagtagagattatttgggattattttaaaggctgcctaccatggagtgttgtttagtctcaaagacattggctttagtcagacaggatgagtacgaaaatctgtctccattacttacccgccatgcaacactgagcaattgttttgtcaactctgtacatcaatttattcttctgaaaaatcatattgttgtgaggattaaattaggtgctacgtgtaaaatggttagagaatttcctggtacatagtagtaagtgctcaaatattagctttggtgatgatgatcatcagtcttcacttgaatgaagaattcagtgctaaaacctgagttaaccattcagctagatatattctaaagctatatctgaataaagaatctatatgtttcattaatgacctacaaattcaatttttctactcttagaatatataaagcataacattttacaaataccagaggataatatgaccaaataatttcttcctttactattgaaaatgtatatgatatggtttggctgtgtccccactgaaacctcaactcgaattgtgtctcccagaattcccatgtgttgtgggaaggacccagggggagataattgaatcatgggggctggtctttcccatgctgttctcctggtagtgaataagtctcacaagatctgatgggtttatcagaggtttccacttttgtttcttcctcattttctcttgcttccaccatgtaagaagtgcctttctcttcccaccatgattctgaggctttcctcagctatgtgaaactataagtccaattaagcctctttttcttcccagtctcaggtatgtctttatcagcagcatgaaaacaggctaaaacagtatattatttttctgatttaaaaacttacaaaaaaattgaaaaatacaaagcacaaagaacttcagaattacccagtgtatttatccaaaaattatgtatacacttacatatttgcttttcacacatttaatacaattttatataaaacatttataactttaattttacataataattaaccaaaatactttttgtgaaagaaattgtagcttattatattttactattgacaacttttctttttatagtcataaatgttctcgacttagttatttggtcagcctatacctacaggtcaattttttgaggggaaatgttcatggattataatgttgtaagtccctgcatgtctgaaactacctctgttgtgcttgaaagacagtgtggctaagtatataattcttaagtgatacctattttctctcagaaccctgtggctacttctccattgtcttttggtatatagggttatagcaaagaattagaagaccagaataattttcttctttgaacacagcctgttctgttttgtttcagcctagatgtgaataataccttttatttatttcaaggttgaaaataaactgaagggtttctttcattgttagttgtgcctagtactccatgagtgcttaaactttgtagactcagatatctctttaattctaaaacatctttctactgtttctttgttttgatctgacaaaaatcaaatcatgtctctcttctgttcatgacccttgtcacacacagaatgaaatccagtctttaccctgaactggaaggccccgcattgttgctggaggccctgtctctgaactcatctcctttgactcccagctcatccctttgggacaatcgctctgaactctttgtccttccccaatcacatcatacaaacctgtccctcaggttgtctgcatatctgttccctctgcttggactactcttttcctgaatattcacttcaggtttctgataaggaaatcctttactactttataaaataggaaagtagagccaccctcaatctatcagccactgatatacttgtttattgcctgtttcccaccttagactgtaagctctgtgaaagggacttttctgtgttgtctactgttataaccctagcatctagagaagaatctgtcatgtggaaggtaggtacctaacacgtgttgcatgagtaaattcctcagtttaggttcctggtatggtctctgtgctagatctgaagtggatatgagtaagtacagctgcagaatccccaggcagtgtgccctttgatcccttgtttgcttccccaaatattgatagattgcaaatgtgcttgtactgtcccatggtgcttcctgactcctgccccaccctttctcggattggtggttgatcaatcactgaaggatttctgcctctttcttcacatgcttctctctcttccccccagcccccaatcgggtcccgtatttcccatatattgtataattccttaaagtttcttgcatgtgaatgctattcttctctagagtctaggcttttaaaggattttgtagcaatgaaatgaaacagtgctcaaaatgctttattatatttacggagttgtgcaatcaccattataatttaaatttattcatcattgcaaaaagaatctttgtaccattagcagccactctctgtctttccctctcattgaactgtagactttaaatgggtaaactttatgatatataaatcatatttcaataaaaagtaatttataagtgaaagtattatacgaatgtttttaattattgtgattgaaagagcaatacagaaattcctgaggacaagttaaagcattattcttttatgaacttcccatatttttccacgtctttatctttttaaaagtgtaatgatttctaatgttatcacattatccataattttctcaaatcacaacagttatttcccacaaatgataaaaagcagtatagaaacatatagttatatttagccttaacatattaactataactagtatttctcccatcatttctttaatcaaattcatttatgtatagcataatagaggtggataatttccattataaataggtattgatatttgtgaatatttattcacttgtaattttaatcagattttttcctaattgaattctacacaaggtacattcagattttatcatttactaatttttattatttatctccatgggaatttgatattgacatattgaaggcagtgtaatgacagcattgccattttgctattcctttaatttatttctatttgcctaaggagaactatgtcaatcactctgggagtaagtaacagaaagtaaaaagtaatatagttgtggataaaatgtaagtgatttgatttggagaataaaactgaattttaatggtattttatcttttatacttaaaaatgcatatggtacatcaaaatgcacacttgtaactaaaacactttatttccaaaataatatgccaatttgagggtgggaacatgggagcaaatgtttgtataactatcgcttattttttacagtattctatacattcagcatttttttaatttaaccctaagataacctctaatctaatagtatgttgacatgtttgataagtgaaaatttcagattctatattcagatttttgtgaataagaaaaaagctattcattctattttttaagttgtgctttatcaatttttgtaccacttacggtgataaagcatttttacatttagttttttactcttcaaattatgaaagtgtctggagcatattggttactgcttgatgaccaagtccaactgatatcagctattaaaacttttggaaaatttgtggtcagttgtaaaagaaatccaaaattattttactactactcttttcatgcttctttcgtattgaattttgcctctcatttatatgtttggatttttttttgctttcttatcatgctgaaggtttagacattttttaatgtgttaattgctcaaactcattagcctgttaagcctctcaacatcatataaggtaaatcagcattaaatattaatagaaattaaggtacacagaggttaaacaacttgtcaaattacattttctataccattgctgttaaaggagttatcttaagtcttgttttatcttgtttaaatttgcactaactgaataaaattttgcatgagaatttaaaacacattttgttttcactgcactaaatactatctcaggaatttcaagaactagaatgagctttctgggaaatggaggtctttcattcagttattccactgggaggttctggcatttgacaacaatatttaaatagctaatgtaactgagggaacagttggtgagtgggtttgaacaaatcttgcctccttagtgatccaagtcttcccacgggaaatttcagatgtcatgaaccatgttgcaacttctctttagagaaaacctgggcagaagatggtacacccaaagcagttacattaacactttttacttcctactgcccttgcaaacaaagtaatttgttaagtcactactcaatcaagaatattcagaataattattgctgacggagtactggacttggagatttattttttgaatgtttgcatttgttaaattatatatccaagaaatttaatgtataaagcagaaattcaggtttataacatgtgcaaatttcctggaataattaacaattttaaatattagatattcttaaatattgtgtcgccatattgggggatcatctctgccaactttacttctctgaatcacaagctttttttttctgccttgagagccaatactttttctgtgccttcacagtagttctgagaacttatctcctttttccattaatggctaaatatttggaatgtctaatagggtatctaatatgcaatatcacatattgtcagtacatattagtatattagagtgtacaactatctggttttatcttaaactctgaaatttgatgtcaaatatttttattgtttcactattcttgcaaaatccaatttttataaaacagatctacttaaagttaatatgcgctgcagtctatgtaatatgaattaattgccactgaggaagtatttttcaagactgttggttatacattcttcacattactttctttggtaaaaaacttctgtataaattggaaaatcatatgtgcaataagcacaagctcagagaattagaccatatggtctctgtagctataatacttggaggtatcagatagtcattctttaagatcattttaaaaatctactgcacagattctttctagagatcacattaatcaatttttacatttcaaaatagctagaagaaaataattcatatattcctagagtaacaaaaagataaatattaaggtgatagatattctaattaccctaatttgattatatgaatatatcaagttagcacatgtaccctgaaaacatgtacatctattatgtatcaataaaataaacaatttttaaagatatgatttctatatatttatatttaaatacatttctaacaaccacaaaaatgttactcatttgaccatttaataagctaatatttaaatagctactctgtgtcaggcactgtgctaagtacttgggacaataaagacatagaatctctgccctaatagagtccatagagtcagggagataggtatttaacaattattcttgcttatttaagtaagagcgactgtgatacctgttagaaaaaatgagtgtgtggtgttagaaaaataattgagaggggcattttgtcaggtgattcagaaaagcgttccataaggaagtgatttttgtgccaagatttcacaaacaagcaggatttaaccagttgaaaagggtttgtgcaatcaaattagaactcaggattaagaaactcactcaaaaccgcacaactacctggaaactgaacaacctgctcctgaatgactactgggtaaataacaaaattaaagcagaaataaattatttctttgaaaccaatgagaacaaagacacaacgtaccagaatctctgggacacagctaaaacagtgttaagagggaaatttatagcactaaatgcccacatcagaaagtgggaaagatcaaaatcgacaccctaacatcacaattaaaagaactagacaagcaagagcaaacaaattcaaaagctagcagaagacaagaaataactaagatcagagcagaactgaaggagatggagacatgaaaaacacttcaaaaaaatcaatgaatccaagagctggttttttgaaaagattaacaaaatagctgctagccagatgaatgaagaagaaaagagagaagaatcaaatagacaaaataaaaaatgagaaaggggatatcaccactgatcccacagaaacacaaactaccatcagagaatgctataaacacctctacacaaataaactagaaaatctagaagaaatggataaattcattaacacatatatcttccaagactaaaccaagaagaagttgaatccctgaatagactaataacaagttatgaaattgaggcatatcctaccaaccaaaaacagcccaggaccagatggagtcacagcagtattctaccagagatacaaagaggagatggtaccattccttctaaaactattccaaacaatagaaaaagagattcctccctaactcttttatgaggccagcatcatcctgataccaaaacctgccagagacacagcgagaaaagaaaatttcaggccaatatccctgatgaacatctttgcaaaaatcctcaataaagtactggcaaaccaaatccagcagcacatcaacaagcttatccaccacgttcaagtcagtttcatccctgggatgcaagtctggttcaacatatgcaaatcaatgaacataatccatcacataaacagaaccaatgacaaaaaccacacaattatctcattagatgcagaaaaggacttcaataaaattcaataccccttcatgctaaaaactctcaataaactaggtattgatggaacatatctcaaaataataagagctatttatgacaaacttataggcaatatcatactgaatgggcaaaagctgaaaacattccctttgaaaactggcacaaggcaagaaggccctctctcaccgcttttattcaacgtagtattggaagttctggccagggcaatcagatacgagaaagaaatgaagggtattcaaataggaagagagaaagtcaagttgtctctgcttgcagatgacatgattgtatatttagaaaaccgattgtctcagcccaaaattcctcaagctgataagcaacttcagtgaagtctcaagatacaaaatcgatgtgcaaaaatcacaagcattcctatataccaataatagacaagtagagagccaagtcatgagtgaactcctattcacaattgctacaaagagaataaaatacctaggaatacaacatacaagggacatgaaggacctcttcaaggagaactacaaaccactgctcaatgaaataagagaagacacaaacaaatggaaataaatttcatgctcatggatacaaagaatcaatatcgtgaaaatggccatactgcccaaagtaatttatagattcaatgctatccccatcagctaccattgactttcttcacagaattcgaaaaagactaccttaaatttcatatggaacaacaacaaaaaaaagcccatatagccaagacaatcctaagcaaaaaaacaaagctagaggcatcacactacctgacatcaaactatactacaaggctatagtaaccaaacagcatggtactggtaccaaaccagatgtatagaccaatggaacagaacagagacctcagaaataacaccacatatctaaatcatctgatcttcaacaaaatgacaaaaaggagcaatggggaaagtgttccctatttaataaatggtgttgggaaaactggctagccatatgcagaaaacagaaactggacccctttcttacaccttatacaaaaattaactcaagatggattaaagacttaaccataaaaccggaaaccataaaaaccctagaagaaaacgtaggcaataccattcaagacataggcatgagcaaagacttcatgactaaaacactgaaaacaatgacaacaaaagccaaaattgacaaatgggatctaattaaactaaagagcttctgcacagcaaaataaactatgatcagagagaacagacaacctacaaaatgggagaaattttttgcaatctatccatctgacaaagggctaatatccagaaaccgcaaagaacttaaacaaatttacaagaaaaaacaaccccatcaaaaagtgggcaatggatatgaacagatatttctcaaaataaggcatttatgcagccaacaaacacatgaaaaaaagctcatcatcactgttcattagagacatggaaatcaaaaccaaaatgagataccatctcacgccagttagaatggcaatcattaaaaaatcaggaaacaacagacgctggcgtagatgtggaaaaataggaatgcttttacactgttggtgagagtttaaattagttcagcaatagtggaagacaatgtggcaattcctcaaagatctagaaccagaaataccatttgacccagcaatcccattactgggtatatacacaaaggattatgaatcattctattacaaagacacatgcacacatatgtttattgcagcactgttcacaatatcaaagacttggaaccaacccaaatccccatcagataaactggataaagaaaatgtggcacatatacaccatggaatacatacagccataaaaaaggatgagtttatgtcctttgcaaggacatagatgacactggaaactatcattctcagcaaactaacacaagaacagaaaactaaacaccatatgttctcactcataagtgggagttgaacaatgagaacacatgaacacagggaggagaacatcacacaccaggtcctctcggtgggtgggggtgggggactaggggaggggtaacattagtagaaatacctaatgtagatgatgggttgatgggtgcagcaaaccaccatggcacatgtatacctatgtaacaaaactgcacgttaggcacatgtatcccagaacttaaagtataatagatttaaaaaataataaataaaaataaaaaaagaaactatcatcagagtgaacaggcaacctacagaatgggagaaaacttttgcaatctatccatctgacaaagggctaatatccagaatctacaaggaacttaaataaatgtacaagaaaaaaaacaaaacaaaacaaaaatcaaaaagtgggcaaacgatatgaacagacacttctcaaaaaaagacagttatgtggccaagaaacatatgagaaaaagctcatcatcactggtcattaaagaaatgcaaataaaaaccacaatgagattccatctaacaccagtcagaatggggatcattaaaaagttaggaaacagcagatgctggagaggatgtggagaaataggaatgtttttacactgttggtgggaatgtaaattagttcaactattatggaagacagtgtggctactcctcaaggatctagaactagaaactggtaattgtttcatgactaaaatattatgagcataatcaaatagctaaagatggacaagtatttcctctagaaataccatttgacccagcaatctcattactggttatatacacaaaggattataaatcattctgctataaagacacatgcacatgtatgtttattgcagcactatttacaatagcaaagacttggaaccaacccaaatgcccatcagggacagactggataaagaaaatgtggcacacatactacaccatagaatactatgcagccataaaaaaggatgagttcatgtctcttacaggggcatggatgaagctggaaaccatcattctcagcaaactaacacaggaacagaaaaccaaacactgcatattctcactcataaatgggagttgaacaatgagatcacatggacacagggtggggaacatcacacaccagggcctgtcgagggttgggggtcaaggggaagaagagccttaggacaaagacctaatgcatatgaggctcaaaacctagatgatgggttgatgagtgcagcaaaccaccatggcacgtgtatacctatgtaacaaacctgcacgttctgcacatgtatctcagaacttaaagtaaaattaagaaaataaaaagaaaaatttagaacaataaaaggaatagaaaaaatgcatttttgctatgcagttatcgtattaattttttaatgaaaaaattataagcaaaaagtacgtaacaaaatgtttttatttaagctgctggttttcaatattaacactgaccctgttagcccatagcctgcaaaatttgaaatttacatttctctgatggctgcctacagtgagattatttagtttatgtgcatatgcattcaccgatttggcatgtctggtaacaaacttgtcttttccccattgtaaaatcagtatccccttggataattgctttcactggtcaccgttttgcctcaaatattttttgtgtgtgttggcaaatccccagaaagttccaaaagaggaaatacatgtccatctttagctatttgattatgctcataatattttagtcacgaaacaattaccagctggcaagctttacatacatattcaatagcatctaaatattgttgttacatctattatataagcttcaaaggaactcactcaacagatgctctaaaatttataaaacttgtaactctcaaaacattggggcttcttggtaatataatctgagtctaatctatgactgatttgattgttcacattacagcttttccttccttagatctatctagtttgtttatttttgaggttcccacatgttccatttcttcaggattgagccattttcctgtaagtcacgccacaaagtttaatgatacaatagcttttgaggggagagtcttgctaggttagttagcacttaaggcatatcagagagtagtcagttagtccagttctgatcgattgcaaacaggaacactgttgacaaggaacaataatgatcactcaaggtcacacaggtggttagaacacagacgacatgtttgaacccatatatgcagagtatatccagtatggtttctcctatacattttataggatcatgattaagaccaagttttgaaatccatgaaattaaaaggattttaagtaaggtacttacaagcagctcaaggttttgctaccttttaggtatacgataaaagccatgtgtcattcctatgtcctttaatctcttaccttgtattctttgactatctaaaactcttacatttttctagttagcaggagtaagtgcattcataagagggaactagggtaaaatacacttcaagtcatcatcagtttagtctctttacaacatatttggtgaggttactcttaaggaaagcctatagactcatctatagaaaaaaaaggacacatgtctggaacagctcacattaacttttcaatgtaaaatcacctatccagcaggtgtagtcccatagaacttctaaactgcataaagtcagtgactgcatccttccaaactcaatggattctctgaagcgtgtcttctaatggctctgattcctctactaaaatatggatggaatataaagacgcccaactgtttgctcttcttctagtaaagactacaagatatgtccatgtctacaagagagctgcattttaaacattgaattcttttgtctaagtctttgtgttcaccaattgtaagcaagcacatttttaaaatgtagatttaaacggggttgaccactctgctctagtcaacataaggagtcctctttcttagttcctggttacatataactagaatcttcttccagtctctaaaatggcaagcagagcataccttaatgtttatgttcttgccatcaaggcataatttctctaatttgttatctaggtaaaatttctcaatctcttaaactgcttataatttatacaactgtgagttgcaattagtacctctagagagctggtggtgaggaaatatttctagaatcccaccagcacatcaagaatttatcctctcctcaaacctgttctttctcctgtatatcctatttttaattgtacttgacagcttcactctgacctcaataacccttcaagatcgctaagtaacattaagttcttccctcacctttacactttactcagagtccaagctcttaactcaataccttgtgttgtttgtaaatagcttactgaaatatattttttaatttaatgggttttagaagtttaacttataaagttctcacccttaagtatctggttctcttaccccttcttctcatacttacctgttactgcactagatcaggacaacattatcttcccatagaatccttcctagaagccaggctgctcaaattacctatgttctgctgctgtataaaatccatctaaactcaacgcatctctctcacaatctctgttacatggaatagtttgaaatacaaaacacttcactgggataccaggaataacagtagtaagtccaaaatcttttaaacaaattaattacctaatccttcatgaaagtgccatttatgtgtaggtgtgttactactcccaaaagatcagtaagaacccagtgcctttggtaggtttctttcgactatgtaatctagagtttacagtaaaatatataaaataggataaaattctcttcttcaaggaaaatgaaagttgataatgataattttgataattttgaagttatttgacttgtatatattgctcaattataatagaaataaattttaaattttaaattaccaagatcctacaatcctattctctagtcctacataagcatacaaaattttatataattgtaataatagcatagatgcatttatgtattttcacatatttttagatttttgcatattgatacaaagtctcaagtttttttatcaatatgtgatatttgtacatatttatggggtacatgtgatattttgttccatgcatataatatgcaaggatcaagataggatatttagggtatccatcacctcaaatatttatcattcctatgaattgggaatatttcaaatccttgcctctagctattaatattttgacatacacaatatattattgttgaccattctcacactactctgctgttgaacattagaacttatttcttctatctatggttgtaaccattaaccaacttctcttcatttcacccccactcctacccatacactcttctcagtttctggtatctctctctcatggtttggctgtgtcctcacccaaatctcatcttaaattgcaatccccataatgtatcaaggcagggatggagtgggacgttattgggtcatggggggtgggttcccccatgctgttttcttgatagtgagcgagttctcacaaggtctgatagctttataagtgtctagaatttctcctgcctccacttctctctcctcctgtcatgtgagaaggtccaaggtgctcccccttcaccctccatcatgattgtaagtttcctgaggccttcccactttacagaactgtgagtcaattaaacttatttcctttataaattacccagccttgggtatttctttatggcagtgtgaaaacaaacaaatactctctaatgctatgagaatcacctttttagctcccatatatgaatgagaacaggcagtactgtctttctgtgcctggcttatttcacctaacataatgacctccagtttcattcatgtggctccaaatgacatgatttcattattttttatggctgagtagtattccattgtgtataaataccacaccatctttatccatccatccattgataggtacttgggttggttccatatcttttctattgtgattagtactggaaaaaagatggggctgtagatatctctttgatgtagataatttcctttactctgaatagatacccaatagtgggattggtggatcctacagtagttctatttttagattttggggaaatctctatactgttttccatagttgctatactaatttacgtttccaccaacaacgtataagtgttcccttttctctgtaaccctgccagcatctatcattttttaatctttttaataatagctattctaactgggataaaatgatatctcattgtggttttgatttgcatttccctgatgattagtgatgtcgagcatttttaatatacatgttgaccacttgtatgtcttcttttgataaatgtctattcatgtcatttgactactttttgatgagattatttattttcttactgttgagttatttgagttccttctatatactgaatatttgttccttgtaaaatgaatactttgcaaatattttctctcattctgcagattgtctctttactctgttggttatttcatttgctctgcagaagtattttagattaatatagtcccagtcccatttgtctttttttctttctattgcttgtgcttttgaggtattagccctgaaatcctagcctagaccaatatcctgaagtgttttcttcaagttctcttctagcagttttattatagtttcaggtcttatgtttaggtgtttaatctatgtttggttgatttttgtatatgatgagtgataggggtccagtttcgttcttctacatatagatgtctaacttttctagcaccatttatttaagaagttattcttttcctgatatatgttcttggcacctttggagggaatcagtaggcacccttatcaaaaatcacttagctataaatatgtgaatatattttagggttctctattgtgttccattgttctatgtgtctgttttcataccaataccatgctattttgttgactatagccttgtaatatgttttgaagtcagatactctgatatctccagctttgttttttgatctgaatttcttgggctatttggtgtcttttgtggctacataggaattttaggattttttttttcatttatttgaaaaactacgttggtattttaatagtgggtacacttaaactattggttgatttacgtgtatgattgttttaacaatatttcttcttctaatccatgagcataagatatctttctatttgtgtcattttcatttgctttcatcagtgttttgtagttttcattgtggagtcttttatcatctttgtttaatttattcttaggtatttttttgtagctattttaaatgggattttcttctttctttttaaactagttcattattattgtatagaaacactactgcttttgtgtattgactttgtatcttgtaattttattaatttgtgtatacattttaagaattttctgatagagtcttttattcttttccaaatataatgtcttccacaaagagagataatttgacttattctttttccaattttgatgcctttttttctttttcttgcctgattgctctagcaaggacttccagtactaaattgaattgaatgaaattaggcatctttcaccacttgttccagttcttttttttttttttttttgagacaggatctcactctgttgcccaggctggagtgcactggctcccagattcaagcgattcttctgcctcagcctcctgaatagctgggattacaggcatctgccatcatgctcagctaatttttgtatttttgtagagaccagggtttcacaatgttggctaggctcgtcttgaactcctaacctcaggtgatccacctgcctcagcctcccaaagtgctgggattacaggtgtgagtcaccacgctcagccccagttcttagaggaaaggctttcagacttcctcacccagtatgatgttagctgtgggtttgtcatgtatagtccttattatgttgagttatgttccactatgcctagtttattgagaagatttatcatgaaaggatgctttttctacatccattgagatgatcttttttgtctttcattctttgatgtgatgtatcacatttattgatttacatatattgagctatcatggcattcctgggataacttgttcatattgtgctgtctttgtgatgtgctgttggatttgttagctggtattttgtcgaggacttttgtatctatgttcatcagggatattggcctgtagtttatttttgttgttgtgtccttttctggttttagtatcggggtaattctggccccatagaattcactggaaataattttttcctcttaattttttggtaataatttgaggttaattggtattaattcttctttatatatttgctaaaatttgagagtgaagtcatctggttatgggcttttctttctccacagactttgttactgattcaatctcattgctcactgttgatctggtcaggttttctattcttcctgattccatcctggaaggttatatgtgcccaggaatttatccatttcctctaggttttccagtttgttagcatatagttgttcataatagtctctgatgatcttttacatttctgtagtatcagttataatgtctcttttttcaattttgactttgtttatttggatctttttcttttattcttggttcatcaagctaatggtttatcaattttatcttttcaaaaatccaatttgtttcattgatcctttgtattttttagtctctcttttgtttagatttagtctgttgtttattatttctttctttcaactaatttcggatttggtttcttcttgcttttcttgtttcttgaggagcagcattagattgtttatttaaaaatctttttacttttttgatgtcagcatttattgctaaaaatttccctcttagcactgctttgactttatcacatatattttgctatgctgtgtttctatttttatttgtttcaataaactttctgattttcatctggattgcttcattgacccaatgatcattcaggagcatgatttataaattttcatgtatttgtgtagtttccaataggtcctctttgtattgatttctaattttattttattgttgtatgagaagacacgatgtcattttgatttttaaaatttgttgagacttgcgttgcagcttaacatatactctatcttggataaaatttcatatactgatgagaagaatgtatattccgtagctgttgaataaagtgttctgtaaaggtatattaagttcatttgctctaaaatttagtttaatttcaaagtgtatttgttaattttctgtctagatgatctgtctaatactgacagtaagttccctaccattattttattggagcccatctttccctttagatctaataatatccactttatatatctggatactccagtatggttacatatatatttagaactgttatgtcctctttctggatgatcccttatcattatataataatcttctttgtttctttttatagtttttattttacttaaagtatgttttatcttgtgtaaatatgacttctcctgctcaatttcggttgttgttgacgtggaatatcatttttcattcccttacttttgataaatgtatatatatacacaaatatatgtcatatatatacatatatataatatgtcatatatagtcatgtatatacatatatatgtatatgacatttgtatatgtcttttccattcctttactttgagtctatatatgtcagataacaggaaaagtgatcttttgtaggcatgatataactgtatcatgtacttttatccattcatccagtctatatcttttacgtaggaaaatttaatttatttcaattcaaggttatcattgatatatgagattttgttcctggtatattgttaattgttcactggatcatttgtatatcctttgtttcactttttctctcctattatttattattgtggtttgggattttctatagtcataacatttacgtcctttctcttcctaatttttttgtgtgtgctctaccagtgggttttatccttttgtgcatttttatgatggtggatgtcatccattcacttccaggtgtagaactggcttaagagtttattttttatatatatattacttttatatatatgtattttttattgtactttaagttctagggtacatatgtacaacgtgcaggtttgttacatatgtatacatgtgccgtgttggtgtgctgcactcattaactcatcctttacattaggtatatctcctaatgctatccctcccccctccccccaccccacaacagcccctggtgtgtgatgttccccttcctgtgtccaagtgttcacattgttcaatgcccacctatgagtgagaatatgcagtgtttatttttttgtccttgcgatagtttgctgagaatgatggtttccagcttcatccatgtccctataaaggacatgaacccatcattttttatggctgcatagtattccacggtgtatatgtgccacattttcttaatccattctgccattttcagacatttgggttggatccaagtctttgctattgtgaatagtgccgcaataaacatacatgtgcatgtgtctctgtagcagcatgatttataatcctttgggtatatacccagtaatgggatggctgagtcaaatggtatttctagggaatgggcacactgtcttctacaatggttgaactagtttacagtcccaccaatggtgtaaaagtgttcctatttctccacatcctctccagcacctgttgtttcctgactttttaatgatctccgttctcactggtgtgagatggtatctcattgtggtttgcatttctctgatggccagtgatgatgagcaatttttcatgtgtctgttggctgcataaatgtcttcttttgagaagtgtctgttcatatcctctgcccagttgttgatggggttgtttttttcttgtaaatttgtttgagttctttgtagattctggatattagccctttgtcagatgagtagattgcaaaaattttctcccattctgtaggttgcctgttcactctgatcgtagtttcttttgctatgcagaagctctttagtttaattggatcccatttgtcaagtttggcttttgttgccattgcttttggtgttttagacatgaagtccttgcccatgcctatgtccggaatggtattgcctaggttttcttctagggattttatggttttaggtctaacatttaagtctttaatccatcttgaattaatttttgtataaggtgtaaggaagggatccagtttcagctttctacctatggctagccagttttcccagcaccgtttgttgaatagggaatcctttcccaatttcttgtttttgtcaggtttgtcagagatcagatagttgtagatgtgtggtattatttctgagggctctgttctgttccattgatctatatctctattttggtaacagtaccattctcttttggttactatagccttgtagtatagtttaaagtcaggtagcgtgatgcctccagctttattctttttacttagaattgacttggcaatgcagtctcttttttggttccatacgaactttaaagtaatttttttccaattctgtgaagaaagtcattggtaccttgttggggatggcattgaatctataaattaccttaggcagtatggccattttcacgatattgattcttcctatccatgagcatggaatgttcttccatttgtttgtgtcctcttttatttcgttgaacattggtttctagttctccttgaagaggtccttcacatcccttgtaagttggattcctaggtattttattctctttgaagcagttgtgaatgggagttcactcatgatttggctctctgcctgttattggtgtataagaatgcttgtgatttttgcactttgattttgtatcctgagactttgctgaagttgcttatcagcttaaggagattttgggctgagataatggggttttctagatatacaatcatgtcatctgaaaacagggacaagttgacttcctcttttcccagttgaacgccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtagtaaatagcacttattattttgagatacatcccatcaatacctaatttattgagagtttttagcatgaagggctgttgaattttgtcaaaggccttttctgcctctattgaggtaatcatgtggtttttgtcttttgttctgtttatgtgctggattacgtttattgatttgcatgtgttgaaccagccttgcatcccaggtatgaagcccacttgatcatggtggataagcttgttgatatgctgctggattcagtttgtcagtattttattgaggatatttgcatcgatgttcatcagggatattggtctaaaattctctctgccaggctttggtatcaggatgatacctcataaaatgagttagggaggattccctctttttctattgattggaatagtttcagaaggaatggtaccacctcctccttgtacctctggtagaatttggctgtgaatctgtctggtcctggaatttttttggttggtaggctattaattattgcctcaatttcagagcctgttattggtctattcagagattcaacttcttcctggtttagtcttgggaggatgtatgtgttgaggaatttatccatttcttctagattttctagtttatttgcatagaggtgtttatattattctctgatggtagtttgtatttctgtgggatcgatggtgatatcccctttatcattttttattgcatctatttgattcttctctcttttcttctttattactcttgctagtggtctatcaattttgttgatcttttcaaaaaaaccagctcctggattccctgattttttgaagggttttctgtgttgctatctccttcagttctgctctgatcttagttatttcttgccttctgctagcttttgaatgtgtttgctcttgcttttctagttcttttaattgtgatgttagggtgtcaattttagatctttcctgctttctcttgtgagcatttagtggtataaatttccctctacacactgctttatatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattacactatggtctgagagacagtttgttataatttctgttcttttatgtttgctgagaaatgctttacttccaactatgtggtcagttttggaataagtgcggtgtggtgctgagaagaatgtatattctgttgatttggggtggagagttctgtagatgtctagtaggtccgcttggtgcagagctgagttcaattcctggatatcctcattaactttctgtcttgttgatctgtctaatgttgactgtggggtgttaaagtttcccattattattgtttgggagtctaagtctctttgtaggtccctaaggacttcctttatgaatctgggtgctcctgtattgggtgcatatatatttaggatagttagctcttcttgttgaattgatccctttaccattatgtaatggccttctttgtcgcttttgatctttgttggtttaaagtctgttttatcagagactaggattgcaacccctgcctttttttgttctccatttgcttggtagatcttcctccatccttttattttcagcctatgtgtgtctctgcacgtgtgatgggtttcctgaatacagcacactgatgggtcttgattctctatccaatttgccagtctgtgtcttttaattggagcatttagcccatttacatttaaggttaatattgttatgtgtgaatttgatcctgtcattatgatgttagctggttattttgcttgttagttgatgcagtttcttcctagcctcgatggtctttacaatttgacatgtttttgcagtggctggtaccggttgttcctttccatgtttagtgcttccttcaggagctcttgcagggcaggcctggtgatgacaaaatccctcagcatttgcttgtctgtaaaggattttatttctccttcatttatgaagcttagtttggctggatatgaaattctgggttgaaaattcttttctttaagaatgttgaatattggcccccactctcttctggcttgtggagtttctgccgagagatccactgttagtcttatgggcttccctttgtgggtaacccgacttttctctctggctgcccttaaaattttttccttcatttcaactttggtgaatctgacaattatgtgtcttggagttgctcttctcaaggagtatctttgtagccttctctgtacttcctgaatttgaatgttggcctgccttgctaggttggggaagttctcccggataatatcctgcacagtgttttccaacttggttccattctctctgtcactttcaggtacaccaatcagatgtagatttggtcttttcgcacagtcccatatttccttgaggctttgtttgtttcgttttcttcttttttctctaaacttctcttctcgcttcatttaattcatttgatattcaatcactgataccctttcttccagctgatcaaatcagctactgaagcttgtgcattcatcacatagttctcgagccatggttttcagctccatcaggtcctttaaggacttctctgcattggttattctagttagccattcgactaatcatttttcaaggtttttaacttctttgcaatgggttcaaacttcctcctttagcttggagaagtttgatcgtcagaagccttcttctctcagctcatcagtcattctccgtccagctttgttccactgctggtgaggagctgcattcctttggaggaggagaggcactctgatttttagaattttcagtttttctgctctgttttttccccatctttgtggttttatctacttttggtctttgatgatggtgacgtacagatggggttttggtgtggatgtcctttctctttgttagttttccttctaacagtcaagaccctcagctccaggtctgttggagtttgctggaggtccactgcagaccctgtttgcctgggtatcagcagtggaggctgcagaacagtgaatattgaacagcgaatgttgctacctgatcgttcctctggaagtttcgtctcagagggctacccagccacgatgaggtgtcagtcttcccctactgggggctgcctcccagttaggctactcgggggtcggggacccacttgaggagtcagtctgtccgttctcagatctcaaacactgtgctgggagaaccactactctcttcaaagctgtcacacagggacatttaagtctgcacaggtttctgttgccttttgttcagctatgccctgcccccagaggtggagtctacagaggccggcaggcctccttgagctgtggtgggctccacccagttccagcttcctggctgctttgtttacctactcaagcctcagcaatggcgggcgccccttctccagcctcgctgctgccttgcagatggatctcagactgctgtgctagcaatgagcgaggctccatgggcttgggaccctctgagccagacgtgggatataatctcctggcatgccgtttgttaagacgattggaaaagcacagtattagggtgggagtgacccaattttccaggtgcggtctgtcacagctttgcttggctagtaaagggaattccctgaccccttgcgcttcccggttgaggtgatgccttgccctgcttcagctcacgctcggtgcactgcgcccactgtcctgcccccactgtccgacaagccctagtgagatgaacccagtacctcagttggaaatgcagaaatcacccatcttctgcatcgctcacactgggagctgtagactggagctgttcctatttggccatcttggaaccacccaagagtttcttttagggtcagtcagtttttgcttgtcagggaaagactttattttgcctttatttatgaaggataactttactgtgtatagtatttttggtggatactttctttttcttttcagcactttgaatatatcatctctgtaagagatgtaagcttctacgtgttattttgttaaatagagttttttaaatattttttcctctccttctgggtcactgaaaattcatatatttagtcattttatgctaaagagtttattgcagggtcagtctagtgatgaggaattacctcagtttttgcttgtcagggaaaaactttattttgcttttatttatgaagggtaaatttttggggtgtagtatttttggtggatacttttttcagccttttgaatataacatctatgtaagggatgtaagctttacctaatattttgttaaataggttttttttattttttgttctccttctgggcctctgaaaatttacatatttagtccttttatgctgtcccatatgtcatgtaggctttgtttcaactctttttaaaaaaattgtctgactggattattttaaagacctgtctttaagttctgaaattctttcttctgctggatctagtcttttgttgaataaatgcattttttacttcattcaatgtattcttcagttccaggatattttggttattttatattatagctatctcttttgtatgtttctcatttatatcctgaattgtttttctgatttctttgtattagttatctgtattgtgttgttccttactgaccttatttaatatcattacttttaatttttctggtatttgataaatttctttttcattggaatatgtagctgcagaattattgtgtttttttggaagtgtcatatttccttcctttgtcatgtttcttgtgtccttatcttggtatctgtgcacctgatataacagttgcctcttccaattttttggatttgctttcatagggaaggacttcatactgaatgtgtatctgtgattttggttaggtagggaacattggctttgattctcagtgcatgcagtagtgtattatttgtatcatttatttgaccatacacagccaaatcagtggtatctgtgatttcctcagtgacttagggtgtgattcttagtggagactgtggcgaagctttgcttaggatggaggcatcacctgggtgagtcctcagaccccagtgtgagcagtgatggagcaaatgtagctgttcttgagcccaagagcaatgtacactggcctccatattggcaggtccaggagggccaattcttgggtctccacttggtttgctcagatgccagcagtggcagcagtgggtcaggttggtgggtgggtccttgtggccctggatagtgcgtggattatggcagttatagtggtggctcaatgctctggttcccaagccatctgcactggtgttgaacatggctgagacaggctgggcaagctggtcttctgtcccacaggtggtgtataggggtgggtacctacagtggtggcaacagcaggctggatgggcccatcttcagctgctgagaggaatgtttaggtgcaaatgctggtggatagggcaggacaatcccaagattcctggacagcatgctcaggtactaggggaagttggagaaagccaggttgggaaaacctgtcctcagatttccccatggtgcatagaggttggctgtggtcagacggagtgatcctcagaccccagcagcatgcttttgtggagatggctgcatctgcactgtggccctgctactgctaagggccagtttgctttcagtgtcggcagccataggtagctggctggggagtgtgcactttggccccaggtggcagctgccaatggagcagccacttttctatgtgcatgaaaacgcacagcagcccttctttctgggaaaatagagttgctgccagtggctcacatttagcccaggtggcagtagccagcagcagcagctctcagcaggggatgacaatgggattctaagggtgtggaaatgcagaggctgttggggcccaggacaggatgcattctggtggtggctaggttctcaaaatggcaccattttgtagctgcttagggcttgagtttccagtatgagggaccaaacctgagctcattctctctctctaaagcaatgccattgcacagtctccaggcagctttctctgtttatctccgtgcccacaagtgtcaagaaacattcccttggtaggattggaggggtccatggtgggaatgtagactgctagggatcactcacttacccttttcctgcactgttgagtctcactgggctcccagatgatactagctgagcaggctaccttgcttctctgtccttccttcttttacatgtctcctgtctcttatctgttgaatcctgatgttctctcttagaggatctattgaaagcatgactaccaactcactatttgttagatgcctctagtcagccatcttgaaatccctcttcagatggttacataatattccaccaaatccataaccttcagctttttaactacaccctatatttggataatcaggttgttagattttttaagtactgtaaataatgctacagtaaaaagttcttgtattttgccttttcctcattttgtttacatctttgtgcaaattatcaggaatgaatttactgagtcaaagatgattaacatgctataccttttgaaatatattgacaaatttttttctgatgttttcaacagtgttcactgccaccagctataaatagatattctcagttaagcacacttttgacaaaatggaatgtaggaattactttttttgatatagtatattatttttaatgtaggtgaaatacacataaaatttaccattttaaagtgtacaattcagtggcatttagtttattcacagtgttgtgcaacgagcaccccatctagttacaaaatattgtcagtttccccctccctcagcatctgataaccatctaccttctagctctgtggattggcatattccagacatttcatataaatgcaatcataaaatatgttgccttgtgtctggcttctctcactcagcataatgttttcaaggtttacccatattgtaacatgtattggtactttattcttttttataatttttattgtgatatatatatatataaaatacaatttaccattttaaccattaatatgtgtgcaaatcagtggcatgaggtgctacattcacaatgttgtactattatcaccatctattttcaggactttttcatcttcatccccaagagaaactctgtacccagtgaacaataactccctggcggggtgcagtggctcacgtctgtaatcccagcactttgggaggccaaagcaggcagatgacctgaggtcaggagttcgagaccagcctagccaacatggtgaaaccccgtctctactaaaaatacaaaaagttagccgggcgtgttggcgggcacctgtaatcccaaggtctcaggaggctgaggctggagaatcacttgaacccgggaggtggaggttgcagtgagctgagatcacaccattatactccagcccaggcaacaatagtgggggaaaaaaaaaaaacaacaataactccccatgcccttcctccaagcccctgatatcttctattctactttctttctctatacatttacctattctgagtacctcatgtaggtggaatcatacaatttgtgcatggccttttgtgtctggcttctttcacccaacataatgttttcaagtttcatccacagtgtagcaactcccagtactccatctcttttttaaattttatttattcattcattcattcattcattcattcattcagtagtttcaggggaacaagtggtgtttgtttacatggataagttctttagtggtgatttctgagattttagtgcacccatcacgtcagtagtatacactacaccaaaactgtagtcttttatcccttaccacccttgcccccaagtctccagagttcattatatcattattatgttacattaccatagcttacctcccacttataagtgagaacataggatctttggttttccattcctgagttacttcacttagaataatggtctccaactccatctaggttgctgtgaatgccattatttcattcctttctatggctgagtcatattcctctctctctctctctctctctctctctctctctctctctctatatatatatatatatatatatatatatatatgttttttaatccactcattggtagatgggcatttaggctggttttgtatttttgcaatcgcaaattgtgctgctataagtatgcatgtgcagtgtctttttcaaataatggcttaatttttctctgggtagatacccagtagacggattgctggatcaaatggtagttctacctttagttctttaaggaatctccatactgtgtttccacagtggttttactagtttacattccctctagcagtgtaaaagtgttccttttcagcacatccacaccaacatctgctttttttttttttttttaattatggccattcttgcaggagtaaggtggtactgcactgtggttttgatttgcatttccctgatcactagtaatttgagcattttttcatgtttgttggccattttatatcttattttgagaattgtctattcatgaacttagcctgatttttgatggggttatgattattattatgattattattttgctgatttatttgagttccttatagattctggatattagttatttgtcaaatgcatagtttgcaaagattttctcccattctgtgggatgtctgtttactctgctgattattccttttgttgtgcagaagctttttaatttaattaaatcccatctatatatctttgtttttgttgcatttacttttgggttcttggtcatgaactctttgttcgtcattgtctcaaagactttttctgatgttatcttctagaatttttatggtttcaggtcataggcctaagtctttgataaatcttgagttgattttgcataagatgagagatgaagatccagttttattcttctacttgtggcttgccaattatcccagcaccatatgttgaatagggtttcctttccccactttgccgagcatcagttggctgtgaggatttggcctcacttctgggttctctattctgttccattggcctacatgcctgtttttcataccaatatcatgctgttttgataattatagacttgtagtatagtttgaagttgggtaatgtggtgcttccagatttgttcttttttgtttagtcttgttttggctacgtaggctcctttttggttccatatgaactttaggattgttcttttctaattctgtgaagaatgatgatggtattatgggaattgcattgaatatatagattgcttttggcagtgtgatcattttcataatattggtcctacccatccatgagcatgggatatgtttcaatttgtttgtatcatctgtttctttcagcagtgttttgtagttttccttatagagatctttcacctcttttgttaggtttactcctatgtattttatttatttatttatttatttatttatttatttatttatttatagttgttgcaaaagggtttgagttcttgatttgattctcatcttggtcactactggtgtatagcaatgctcctaatttgtgtacattgattttgtatcctgaagctttactcaattcgtttatcagatctaggagctttttgaatgagtttttagggttttctaggtatatgatcatatcatcagtaaacaatgacagtttgacttcctctttactgattcggatgcccttcattactttctcttgtctgtctgctctgactaggacttccagtactatgttgaatagaactggtgaaagtgggcatccttgtctagttccagttctcagatggaatgctttcaacttttccatgttcagtataatgttggctgtggtttgtcatagatggtttttattaccttaaaatatgtcccttctatgctgattttactgaggattttaatcaggaagggatgctggattttatcaaattctatttctgtgtctgttgagatgatcatatgattattgtttttaattctgtttatgtggtgtatcacatttactgacttgcatatgttaaaccaaccctccatccttggtatgaaaccctcttaattatggcatgttatctttttgacatgcttttggattcagatagctagtattttgttaaggttttttgcatttatgttaatcacggatatgttctgtagttttctttttttattctgtccttccctggtttgggtattacagtgatactgccttcatagaatgagttagggaggacttcttctttctctatcttttggaatagtttgagtgggattggtacccattcttctttgaatgtcttatagaattcagctgtgaatccatctggccgtggacttttttttggcaatttttttaaagactattttagtcttgctacttgttcttgctctgttccgagtttctattttttcctggtttaatttaggaggcttgcatctttccaggattttatccatatcctctacgttttccagtttgtgtgcatataggtgttcaaattgccttgaatgatcttttgtatttctgtggtatcagtagaaatatctcccattttgtttctaattgagcttatttggatcttctctcttctttttcttggttaatctcactaatgatcttttgattttgtttatctttttaaacaaccaggtttctgtttcatttatcttttctatttttttgtttcaatttcatgtagttctgctctgcttttcgtttttttttttttccttttttttttctgctactggatttgggtttagttcgttcttgtttctccagttccttgaggtgtgagcttatattgtctacttgtgctgtttcagatatttagatgtaggcatttaagctattaacgttcctttaagcaccacttttgctgtatcccacagatttttattggttgtgtcataattatcattcagttcaaggaatttttaattttccatcttgatttcattgttgatccaaatatcattcggggcagattatttaatttttatgtatttgtatagtttaatagttccctttggagttaatttccaattttatttcactgtgacctgagaaagtactatatatacttttagttttcttaaatttattgagacttgttttgtggcctatcatatggtccgtcttggggaatttcccatgtgctgatgaaaagaatgtatattctgcagttgttggttagaacgttctgcaaatatctgttaaatccatttgttctagggtataatttaagtccattgtttctttgttgacttttggtcttaatgacctgcctagtgctatcagtggagttgacattgaaatctcctacttttattttgttgccatctatctcatttcttagatatagtaataattgtcttataaatttgggatctccagtgttagatgtgtatatatttagaattgtgatatttcctattagactaacccttttatcattatagaatgtccctctgtcttttttaaactattgttcctttaaggtctttttttttttttttttttttttaagggaatagctactcctgctcacttttggattccatttccatggaatatcttttccatccctttaccttaagtttatgtgtatccttctctgttaggtgagtctcttaaagacagcagatacttgattggtgggtttttatccattctgccattctgtatctttttagtggagcatttaggccatttatattcaatgttagtattgagatgtgaggtactgttctattcttcatagcagttgttgacttagtatctttttttcattgtgttattgatttataggtcctgttgatttatgctttaaagagattctattttggtgtattttgaagttttgtttcaagacttaaaattctttttaacagttcctgtagtgctggcgtggtagtggtgaattctctcagcatttgtctgaaaaagactttatctctccttcatttacgaagcttagtttctctggataaaacattcttggctgataactattttgttaaggaggctaaggataggacctcagtcccttctgacttgcagtttttctgctgagaaatataccgttaatctgaaatctactgtttcctttataggttacctgatgcttttgtcttatagcccttaagattctttccttcatcttgactttaggtaacctaataactatgtccctaggtgatgacctttttgtgatgaatttcccaggtgttctttgaccttcttgtatttggatgtgaagatctttagcaggatcaggggagtaatcattgattattccctcaaataagttttccaaactttttgatttttcttcctccgcaggaacaccaattattcttacgtttggttgtttaacataatcccaaatttcttggaagtttttttcatttttttctcttgtttctttgtctttgtcagattgagttaatttgaaagccttgtctttgagttctgaagttcattcttctacttgttcagttctattgttgaaactttccagtgtattttgcatttccctaagtgtgtcttttatttccagaagttgtgctcgtcttttctttatgatgtctatttatctggagacttttgcatccatattcttttttttttatttctttgagttacttttcacctttctctggtgccctcttgagtagctaaataataacaatcaaacttctgatttctttatctggtaattcagagatttcttcttggtttggatccactactggagagctagtgtgatattttctgagtgttatagaaccatgtttattcatattaccagaattacttttctggttccttctactttgtgtagactgtttcagtggacagatctgcggctcaaactctgctgttcagattattttttcccattgggtgatcccttgatatggtgctctccccctaggaatggggcttcctgaaagccagactcgagtgattgttattgcccttctaagtttgtccacccagtagggctactgagctctgggcttgtgctgtggaatgtttgtaaagagtcctgtgatgtgatccatcttcatgtctcccagccatggataccagcacctgctccagtggaggtggcacaggagttaagtggactctgtgggagtccttggttgtagttttgtttagtgtgctggttttcttgaatgctggttatgctagcagtgaagctgtcacttcaacagactcaggacctctgattagccaggttattgctggcagtagaattagctgttgtcttctccttcattggagcagggttgttctgttatgagtggctgtaatggctggagttggttggcctccagccaggaagtggcactttcaagagagcaccagctccagtaatagaagggggatataatcttaccctaagttggccaggataagtacttgggtttctcaggcaatgggcagggtcatagagctcccaagagtttacgtcctttgtcttcacagttttccagttgtcttgcagcatttgcagtagcaagctgcttctttcaaagggtctgtgaattttttcggtttttctggtatgttcttgcagtggtccttgaagcagaagttcacaaaatgaatctccacacactgttctgtccatccaagtgggagctgcacgttagtcctgtctcctattggccattttcctctcaagtctagaatataggaataacttcaaatctgctgttgtaatagttataaattaaaaccttattgtttgtttatattttttatttattttataacaaaagagtggaacatattttatgtttgttgactaattttatttcttgcatttttattcatgactttccccttaaatattggtcttcaatcagtatgtttgaatttcttatttttttgacttatttataaaatataatttttaatttttaaaacaattgctgcatatatttttcttaggatatttttattcaagttatattatttttgttgtaaagatttattataggttgagcatcccaaatccaaatattcaaaatctgaaatgttctcaaatttggcattttttgagtgctgacatgacactcaagggaaatgctcactggaatatttagaatttggattttcagattagggatgctcaatcagtcaatatattgcaaatattccaaaattcaaaatccaaaacactactggtccctagcattttagataagggatatttaacctgtatatcatataatctatctttgtatttatggtttcttttagcttaaatgtcatctagcaaaatattttgttagtctataatttgatttatatatgtgtgatgttctttaatctccatggtcttcattttaatattaaaaatccattaataattgtgaaaatactacatgtatttatgattatgggaataatttagtagacagagaaaaattgataatgcagaagagaaagtacacaattgtgacaattgagtcattgagtaaatcaggtaggattcactaaataaatagactggctactcttagataatagtatgagtaggtcagccacagtagcagaaggagaggcaaagtatgtgtctacagaagagagcagattggtaaatgtggtagtgatagatgtggatactaactgatcagttgagagtgaggagatttgaggggttgttcaatgtttgaagaaaaagaagaatactggtatgaaataataacttctgagagtaggaagcaaagatagtgaaatgcagagatcactgtcagtactggtcttaccttcaagtgatgaccacaaaccttttgagttttgtggccatcacttgaaggtatgactagtcagcagagttgtatgttttccagtcatgttaagtactgggatacaagcacaaaatagataaggatttgggtttacccaagttaggcctttgccaggggtgtgacaaagaaaaagagaggccaagtagttgagcatgtatataaaagagagactacaatcatgagccacaaactcataataaaaagaaaatagaattatgaagggactatttatagagaaaatgtaaatctcagtggatataagagggagtgaaattgagaggtgacaatgtgctggtggccctcattcgctctcagtgcctccttcgcctaagcgtccactgtggccatgcttgaggagcccttcagcccacagctgcactgtgggagcccctctctgggctggccaaggttggagctggctccctctgtttgcagggaggtgtggagggagaggtgcaggccggaaccggggctacgcactgcactcgcgggccagcgccagttctgggtgggcgtgggcctggtgggcccacactttgagcaactggccagtgcccccggccccggggagtgaggggcttagcacctgggccagcagctgcggagggggcgccgggtcccccagcactgccggcctgcccgcaatgcgcttgaattctcaccaggcctcagccacctccccaggggcagggcttgggacctgcagcccgccatgcctgagccccccaacccatgggctcccgcgcagcccgaggagcctccctgacgggcgccaccccctgctccacagcgtctggtcccatcaaccacccaagggctgaggagtgcaggcatgtggtgctggactggcaggcagctccacccatgggcctggcatgggatccacaagacgaagccagctgggctcctgagtcaggtgggggcttggagaactttcgtgtctagctagagaattgtaaatgcaccaatcagcactctgtgtctagcttgggggtttgtggatgcatcaatcagcactctgtgtctagctaaagtttgtaaatgcaccaatcagtgctctgtgtctagctaatctagtggggacttggagaacttttgtgtctagctaaaggattgtaaatgcaccactcagcaccctgtgtctagctcaaggtttgtaaacacaccagtcagcaccctgtcaaaatgggccaatcagctctcagtaaaatgggccaatcggctctcagtaaaatgggccaatcagtagaatgtgggcgggggggggggggggggccggtcaggtaagggaataaaagcaggctgcctgaagcagcagtagcaacccactggggtccccttccacactgtggaagctttgttctttcgctctttgcagtaaatcttactgctgctcactctttgggtctgcactgcctttatgagctgtaacactcaccgcgaagctctgcagcttcactcctgaggccagcaagaccacgaacccactgggaggaatgagcaactctggaggagaggagcaagcaattccagacgcgccgccttaagagctgtaacactcactgcaaaggtctgcagcttcactcctgaagccagccagaccacgaacccaccagaaggaagaaactccgaacacatccgaacatcagaaggaacaaactctgggcacaccatctttaagaactgtaacactcactgggagggtccgcagcttcattcttgaaatcagttagaccaagaacccaccaattccggacacaaaatgaaaaccagatcaagaagtaggatgctcgtcaaaaggcagaattcttgaaattgagagttgaagggaatgccattgttggtaatgacatgacagagggtaagaccatgggaggggatggctgaagtggaagaagggacaagcccaatggagaagagaaggtcagagacttatagccagggcactaaaaaggtcatctacatagttattaaaatcgcaacaaatgataacaggaatgatggtgacgataaagaagcagttaacgaatgtaaattataaatatcagtagtaatttctatgaaatttttatcatgtaagatttccattaacagcaattaaaagtgcctagttctccatatcttgccaacactaggtattatcaatatgctcaatatttactaatatcctaggtgaaaaacaatatcttggaatctgaattttcctttttaataattgatacagttgaatccattttcctatatgatcatttttattacattttccattcatgaactttgtcagtttttctgccagcatatccatcttttattagctatttaaaataaatcttcctggaatagagaaaactttctctgagctatcatttatcttccaagtatttttcaattatttttatgttgatattttagtgaagcattacatttttttattcttgaaaataaacattataattatttattagttgactgtacataaaacatcagaatgatgagttgtatttaatagactttttcttctaaaggatgaaaactcattgtatatgagttaaatgtatttttgaaaattctgtagtggtcatagtacaaggaaaaggactcatcttaagtttaaaaacttttaaatcaaatttttatttgaataattttagaaggaagaaccttagattcccgatagcagtcacatacatagaagaggtggtattgctccagataaattcagattatccagtagaaaatgagtgtaaattaatgtaatgttaggagaaatgcatgtttattgactattctcctggccagtaaaaggtattaaggacttacaaatggaatgcttttaaatgataaatagtattcaaaggtattcatggattgcttttttttttttaacctcttagaacttctattacaggcttcactaaaattgtcattcattgtctagccccaatgattatagaagttgatttgttataacaaatacatacaaataatacattatactctttctgtatattacacagataatacatatctgatggcagcattcagtatcatataatttcaatatatattgaagctattgttatctgcttttggaatatgcttgtgaggtaccacagcttgaaagaagtaatgaataaaactaaaaggaaacagtcaataagacagtgaccagaatagggtaaattctaagatttcaaatgaactgtgctagtgtatgattccacttatcttcagtttaccctaatacagtcaatcgatcatcaagaatacaccagaaaatacttaaatgttatagtattcatagttcatttagccaatccttttggcctctgaatgctgaatttaaattcatgtatttaaacattttatggcttctatgctttataaatactttggtagatatgataaaacaaataaggatctgagttatagactgcttatggggaagggttaataagaaaatgaaaggagccattagtataactccctactgagtaagaggtcaacatgaaatggtactagttagtaataacttattgaattatgagaatttgaagctacatttaagtaaaatgatgactatggctgaggctagataaaatgataactcattcaggatggggagaaaataaccaatgtgaatgcacagaggcaggaatagtagtatgattccagaaagatggtcaaagtgtggcattttaatatgacagatattcggctaacaggattggggatacataatgaggattagactttggaattcagaaacagaattaccagaacaaagatatcaggttaagactacataagaagcaatgtaaggagcatgatgttgcatatatttaagttattttccgctaaagcctgaattattcctagaaaagtgctttcagatgtcaatgtgcaaaaagattatgtgcgtagacaagaatcttgtccatcaacagatgaatagataatgaaaatatggtctgtatacacagtggaatattattaagccataaaaagaatggaatcctgttatatgcagcaacatggacggaactgaaggttattacatttaatgaaataaactaagcacagagagtcaaattttgcatgttctcactcatatgtgggagctaaaaagaattgatctcatggaggtggagagtagaatggtggttaccagaggttgcaaaggtggggaaagagaggttggttaatgggtacaaaaatacaattagatagaagaaataacttctagagtttgatagctcagtggggtgactatagttaacaagaatttataatgtatttcaaaataactgcaagagatttagaatttcagaacacaaaagaacagtaaatgactgaggtgatgtatatttcaattaccctgatttgatcatttcacatagtatgcatgtatgaaaatatctcatgtaccccattaatgtctacagctattagacatcaatttccaaaaaagtcagctgaactctggatactggtattctgacgtatgtgacaaaagggcatgttggagatgaacttcaggctgaatttgcctgtggaagtaaattgatcttgagacactatcgtgtcaggatgttgcatctttaagacaaaaaaattatatatgtgattattctcttttggcaaataaaaacagaccccacccacacacacatatttgtattcctaagaagcgtatcagtgttccatggacattcagtggaggtggggtgggattggaagattgattttcccatttattccaacaatcaggtattattttagtaatttgaaaaatatcaaataaaattcaaaaagagaaaaatgtaataaaagattaataatggctatgcaaataagcagtaaataaaggtgacaacaagaagcatcttaaaatattatgataaattgggaaactaatatttgatcctaaagaaattaggagacctgtgaatttccagagctactgtattgaccagcattattctagagaagtagttccaaacctgactgtgcattaaaataaactgtgacagttgttaaaatattcagacttctgggacctacactggagtttctaaatgagaatttctgggcacaaaaccatattatctatattttaaacaaggactggaaatacagctgtgaacaagatagacatggttccttcgttcatggggcttacattttaacagggaaacataaatttaaataactcaagaagaatttttcagtaaatgatggagttttccaaaattgtagttatttgatgaaactaattatgataatgatggctatttaaatccaaatatttgccaacaatttctaaatgaaaagcaaaaaagtacacaaacttgagtgtaactagaggacagagatgactacaaatttctttttttttacaagattttaagttttcatcaattttattattgttttcattacctcaaatatttatcatttctttctgatgggaacatttaaattcctctcccttagctattttgaaatacacaataaattattatttactgtagtcaccatgctatgcaataaaacaccagaacttattcctcttgtttaacctaaactgtctatggtttcactaatatatccccttctccatctaccctgctctcccatcagcctctgataaccacaattctattctctaattctttgagtttgactttttcagatcccacgtctaggtgagatcatatggcatttgtctcactaagcataatgtcctataggttcactcatgttgtcaaaaatgtcagactgccctgctcttttaaggctcaatagtatctcattgtgtgtatatttcccatgtttttaaatccattcattaaatgatgatcacttcagttgtttcccacattgaataatatttcaatggacatgggagtgtagatgtagatatctatctcttcaacatactgatttcaattcctttggctatacacccagaagtgggattgctggatcatataatagctccattttcagttttctgagacacttccatactgttttccaaagtgcctgtactaatttacagtaccaccaacagcatgtatgggtccacttttatccacattttcaccggtactttttatattatatctttttgattatagccaatctaatagttgtgaggtgatatctcattgtggttttaatttgcatttatctgacattgagcatttttcatgtatctgttggccatttctatatattcttgtgagaaatgtctacttaggtctcttgcctgtttttaaatagggttgttttattgttattgagttgtttgagttcattgtattaatgtattttggatattagtcttgtatccaatgtatttatttgaaaatattgtctcccaatccatgggttgtctcttcacttttttgtttcctttgctgtgcagaagctttttattttgattcattccatccatttttgttttggatgtctatgcttttggaatcttagccaagaaatcgctgccctgatcaatgtcgtgaagattttcccctgtgtttccttctagaagttttacagtttcatgtcttacttttaagtctttaatctattttgagatgattcttgtataaggggtgagttaagggtccattttcattcttttgcatgtggctatccaggtttcccagtaccatctgttgaaaatactgtcctttccccattgtgtgcactggcgcctttgtcaaaaataaattgactataaatatgtggatttatttctgggctctctatcctgttccattgcttagtatatctgtttttatgtcaatactatgcacttggtttattatagctttgtaagtattttgaaatccagtagtgtgatgcttctcctttggctcaagattactttggctatttcaagacttttgtgattccttacaaattttaggattgttttctctatttccgtgaagaatagcattgaaatatttatagacattttgctgaatctatagattgattttagcactatggacattttaacaatattaattattccaatccatgagtaagggatgtctattttctcatgttacctccaatttcttttatcaatgttttagagatttcagtatacagatctttcacctccttaactaaatttccttctgtgttattttttatgttattgtaaatgggattgtgttctcaatttctaattcaaacagtttattattactgtgtagaaatgatactaattttcataagttggttttgtatcctgcaacttcactgagttcctttatgagttctaggaatgtttcttatgtagagtcttcaggattttctttatataaaatcatgccatcagcaagcagatttttctttcctttcccatttggatgcctttcatttccttctgttgtctaattgctctggttaggactttcagtacagttacccatcagtattcacatgtctctggttccaggaccccctgtagataccaaaatctgtgcatgttcaatccccttatctaaaatggctcaatatttgcatataattaatgcatatcctttcatatacataaaatcctgtctagtttacttataatgcctaatacaatgccaacacatcacttcatttatgtgggttcagggtagtacttggtacacagcaaattcaagttttgctttttggaattttgtggaattttttgtgagtattttcaatcaatggttggttgaatccatgatataaaaccaacagttatgaagggctgactgtactatgctgaacagaagtggtgagagtagccatccttatattgttcctgagatcagaggagaagtcttcgactttttgccattcagtatgatgttaactgtgagcatgtcatatatggtctttactctattgaggaatattccttctaaaactaatttgttgagtggtatgttttatcataaagtgatgtttaattttatcaaatgctttatctgactcttttaagatgctcatatggtctttgttcattctttaatataacatgaatcacatgtattgatttacatatattgtaccatccttgcatcccagagataaatcccacttgatcatggtgttcattctttttaatgtactgctgaatatagtttgctaataatttagttgaggatttttgcccatctatgttcatcaggatataatgaaaataaatgtatctgtctggctttggtatcagtttaatgctagactatgaaatgtgattggaagtattcctacctcttcaatatttggaagggtttgagtagaatatgtattagttcttcttgaaatgtttggtaaaattcagttgtgatgcttctggtcctggacttttctttaatgggagacatttaattactgattcagtctcctcactctttattggcctactcagatttgctatttctttgtgattcagtcttggtaggttatatgattttaggactttatccatttctttcaggttgtctaattagtttgcatatagttgttcacagtactttcttatgatcctttgtactttgtgttatcagctgtaatatctcttttttcatttatgattttatttatttgagccttctctcttttttcttagtctaagaaaaaagctaagattttttcaattttgtttatctttttaaaagccaattttttgtttcattagtcttttaaattgcttttctagtttttattccatttatttatgctttgatctttgttgtttccttcattctgctaatgttgcatttagtttatccttgttttttagttacttgagatgtaacttttttttacttttagatctttcttcttttttaatgtaggcatttattgctatatatttccctctcagaactacttttgctgcatcccataatactctcaagatattttcaaattttttcatttttttaaccctatagttttttaggagcacattgttcaatttccatatatttgttaattttacataatttttcctgttattgctttctagttttatataattatggttggaaaagatacttcatatgattttgatcttctcaaatttgttaagactttttgtggcctaatatttgatctatcttggaaaatgttctgtatgcacttggaaagaatgtgcatttgttgctgttggatagaatattctgaatatgtgtgttatgtctgttatagttcaagcaaatgcttttttagttgatttctctatttgggttatctatctattgttgaaagtaggatactgaaattccctacaatgattgtgttgcagtctgtgtctctcttcagatctcttaatgagatctgtagttgcatatgcaggtgcttcaaagttgggtgtatagatctttacaattgttttatcctcttgatgaattgaccctttatcattttattatgacctttgtttttatagtttttggcctaaagtctgttttgtctgaaataagtatagatgcccccattcccctttggctttctttgcatgttctaccttctcctattccttcactttcagtctatgacttttccataaggtgaaaagacctaactatatgctatatgtaggtagcatataggtatagtctaacttcttaagacttattttgtggcctaacatatgatctatcttggaaaattgttggtatacacttgaaaaaaatgtgtattttgttgctgttggatggaatcttctgtatatgtgtgttatgtctgtttgatgtagttcaaattaatgctttttaaattgattttctatttggattatctgtctatgacttgtctgtaaggtgaaaaagacccaattatgtgctatatgtagctagcatatagttgggtcttttaaaaaattaatctatttagctactctatgccttttgattacagaatttaatccacttacatttaaaacagttgttgatagataagaacttacaagtgccattttggtattcgtttgatgattgtttgcagatcctttattcctttctgtacctttgcttactttcactggtttcatggctttctgtaataatatgctttggatctttcctttttatcttttgtacatctattatagcctttttcttgtggttaccctaatgcttacataaagcctctcatactttaaaactggctattttaagctgataatcacccaactttgatagccaagaaaaactctacacttttatttcctcttctccttgtttgtgtttgatgtcacagtttacatcttttaataatatgcatccattaacccattatttaaattttagttgtgtttaacagttttgccttttaaactttttactgaagattatcattgacttgcccattgttatgtcagttttatagtgttttggatttgacttttctttcattaaaaagtgcttacttttaccagtaagttctatacttttatatgttttcatatcagtaattagcatcctcttccttaatcttaaaaatttgctcttagcatttcttcaaaggcaggtctaatgcagatgtaccagtgataaactagacccgccattctcttcttttatttgtctgagaaagtatttatcactccttccttttttctgaaaaacagagttgcaatgtatagtattattggttgacagtttttttctctttcataattttgagtatatcatctcacttacttctggcctagaatgtttcttctgaaatatgtactgataatctaatagacgttctcacatatataacaatttgcttttcctttgctgctttcaaggctctctttttgtttttaacttgtttccttttttaaaaataatttaaacatgtatttcatatttggggagtcggacatgtacagatttgttgcatgggtatattgcattatgctgaggtttggaatatgaatgatcccattaccgaggtagtgagcatggtacccaatagttattcaaccctcttttccctctctcccccacccccacatctagtactccccagtgtctgttgttgccatctttatttccatgagtacctaatgctcagctcccactaaaagtgagaacatgtggtatttggttttctgttccttcgttaacttgcttaggataatggcctaaatatgtatgcattagatgtttgttggagattattttattgattatttattttattttattttattttattgatacataataattatacatatgtatgggacatatgatattttgatacattcatacaaagagtaatgatcaaatcagggtaattaggatatccatcgccttaaacattgatcatttctttgtgttaggaacagttcaaatcttttagttagtttgaaatatacattgaattattgttaactttagttacccccgctgtgctggcaaacactacaactttcttattctttctttgtaactttatgtttgcacccattaaccaacctctcttgattctctcctctacccttctcagcctcttataactatcattctaccctctaactccatgaaatcagcgattttagctcccaaaatttgtctttctgtgcctagcttatttgacatcatataatgacctctggttccatctatgttgctgcaagtgcaagatttccttcctttttacagctcaatagtattccattgtgtatatataccacctcttctcttttttctttttttagtttttttttataaatttatatatgtttatgggatacaagtgcattttgttacacatgtagtggtgaagtcagtgcttttagggtatatatcacacgaataatatacattgcatccattaaccagtttctcatcatctttccccctcctaccttgtcacccttctgagtctctaattatctatcattccactctctacatctgtgtgtacacctttttaaatgagaacgtgtgatatttgtcttctgtgtctggatttctgcaaaagacataatgtcattatttttatggccaaataatattccattgggcttactgcattttttaatccatctatccattgatgaaaacttatcttggctattgttattagtgctacaataaacacgggggtgcaggtatttcttttatatattgatttgttgatttgctttttttgggaggggtggtaaatacccagtagtggaattgccagaacatatggtagtcttatttttagtttttatgataaatcttcatactgttttccataatggctatactaatttacattcctaccaagagtgtaagagttcttttttctctgcgtcctcaccagcatctgctatttttttccttctgataatagccattctaactgaagtgagataatttctcattgtggttttgatttgcattgccttgatgattagtgatgttaagcattttttcatataccagttggacatttgtatgtcattttttttgagaaattattcatgtcccttgcctgctttttaatgtaattatttgttgtgtttgtttgttttgttttgctgtttacttgtttgagttcttgtatgttctggatattatttttgtcagatgaatagtttgcaaatgttttctcccattctataggttatctcttcactctgttgattgtttcttttgctgtgcagtagctttttagtttaatatagtcctggtgttggtccatttgcactggtataaggaatacctgaggctgggtaatttatgtctttttggcttatgtttcttcaggctgtacaagaagcatggtgccagtatctgcttctggtgagggcttcaggaagcttccacccataccagaagaagaaggggagcaggcatcacacgacaagagaggagaaaagagagagggaagggaggtgccagacacattttaacaattagattttatgggaactaaaagtgagagttcactgaatcccacaagaaggataccaagccattagtgtgaagacatccatccccatgactcaaacacctcctattaggccctacctacaacattagggatcaaatttcaacacaagatttggagaggacaaatagccaaattatatcactctgatttgtctgttttttcttttgttgcctgtgcttttgaggtcttagccataaaatagttgcctagaccagtgttctgaagtgttcaccctgtttttgtagtgtcaggtctgatagtctttaatatattttgagtttatttttgtgtatagtgagaggggtatggttttttgtttattattattattattattattattattattattattattatactttaagttttagggtacatgtgcacaatgtgcaggttagttacatatgtacacatgtgccatgctggcgtgctgcacccattaactcgtcatttagcattaggtatatctcctaatgctatccctcccctctccccccaccccacaacagtccccagactgtgatgttccccttcctgtgtccatgtgttctcattgttcaattcccatctatgagtgagaacatgcagtgtttggttttttgtccctgcaaaagtttactgagaatgatgatttccaatttcatccatgtccctacaaaggacatgaactcatcattttttatggctgcatagtattccatggtgtatatgtgccacattttcttaatccagtctatcattgttggacatctgggttggttccaagtctttgctattgttaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttttttcctgactttttaatgattgccattctaactggcgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttgtttgtttttttcttgtaaatgtgtttgagttcattgtagattctggatattagccctttgtcagatgagtaggttgcgaaaattttctcccattttgtagattgcctgttcactctgatggtagtttcttttgctgtgcagaagctctttagtttaattagatcccatttgtcaattttggcttttgttgccattgcttttggtgttttggacatgaagtccttgcccatgcctatgtcttgaatggtaatgcctaggttttcttctagggtttttatggttttaggtctaacgtttaagtctttaatctatcttgaattaatttttgtataaggtgtaaggaagggatccagtttcagctttctacatatggctggccagttttcccagcaccatttattaaatagggaatgctttccccatttcttgtttttctcaggtttgtcaaagatcagatagttgtagatatgcagcgttgtttctgagggctctgttctgttccattgatctatatctctgttttggtaccagtaccatgctcttttggttactgtagccttgtagtatagtttgaagtcaggtagcatgatgcctccagctttgttcttttggcttaggattgacttggtgatgcgggctcttttttggttccatatgaactttaaagtaatttttccaattctgtgaagaaagtcattggtagcttgatggggatggcattgaatctataaattaccttgggcagtacggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatctgcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccacttttcaaagggaatgcttccagtttttgcccattcagtatgatattggctgtgggtttgtcatagatagctcttattattttgagatacgtcccatcaatacctaatttattgagagtttttagcatgaagcgttgttgaattttttcaaaggccttttctgcatctattgagataatcatgtggtttttgtctttggttctgtttatatgctggattacatttattgatttgcgtatattgaaccagccttgaatcccagggatgaagcccacttgatcatggtggataagctttttgatgtgctactggattcgctttgccagtattttattgaggatttttgcatcaatgttcatcaaggatattggtctaaaattctcttttttggttgtgtctctgcccggctttggtatcaggatgatgctggcctcataaaatgagttaaggaggagtccctctttttctattgattggaatagtttcagaaggaatggtaccagttcctccttgtacctctggtagaattcggctgtgaatccatctggtcctggactctttttggttggtaagctgttgattattgccacaatttcagatcctgttattggtctattcagagattcatcttattcctggtttagtcttgggagagtgtatgtgtcgaggaatttatccgtgtcttctagattttctagtttatttgcgtagaggtgtttgtagtattctctgatggtagtttgtatttctgtgggattggtggtgatatcccctttatcattttttattgcatctatttgattcttctctctttttttctttattagtcttgctagtggtctatcaattttgttgatcctttcaaaaaaccagctcctggattcattaattttttgaagattttttttttgtctctatttccttctgttctgctctgattttagttatttcttgccttctgctagcttttgaatttgtttgttcttgcttttctagtccttttaattgtgatattagggtgtcaattttggatatttcctgctttctcttgtgggcatttagtgctataaatttccctctacacactactttgaatgtgtctcagggattctggtatgttgtgtctttgttctcattggtttcaaagaacatctttatttctgccttcatttcattatgtacccagtagtcattcaggagcaggttgttcagtttccatgtagttgagcagttttgagtgagtttcttaatcctgagttctagtttgattgcactgtggtctgagagacagtttgttataatttctgttctttttcatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgagtatccttgttaactttctgtcttgttgatctgtctaatgttgacagtggggtgttaaagtctcccattattaatgtgtgggagtctaagtctctttgtaggtcattcaggacttgctttatgaatctgggtgctcctgtattgggtgcatatatatgggatatccagctctcctggcaccattattgaagagggtatctgttcaccaaggtgtgttcgtggtgcctttgtaaaaattcagttggctataaatccttgaatatatatgctgtccagtgcttcaagtgctctgcagtgcttcaataatcacggggattattgaaatccccgactattattttatgggggtctctctctctctttagctctaagaatatttgctttatatatctgggtgctttggtattgggtgcatatatatttatgattgatatatcatcttggtaaattgatcccttgattattatataatgttcttctttttctctttttctgtttttaatgtaaagtctcttttgtctgctattagttattcctgcatgcttttgatttccatttttgtggaataattttttaattccttcacattcagtctatatgtatctttacaggtggagtaaatttcttttaggcagcatacagtcagatttttttaaatccatttaacctgtttacatcttttaatcagaaatttaaaacagtttgcattccaggttatcattgttaggtgataacttactcctgtcattttgttatttgttttctgattgtttcatatatccgtttttctttattcatcttttattgtttgcctttacaattttttgggttttcaaagtgataatgttggattccttttagtttttttttctgtatgcactctactagtaaattttatacttttttgttttcattatggtagatatcatcttttcacttccaaatatagggattccttaagcatttcttgtaaggcctgtgtagtggtgatgaattccttctgtttttgtttgtctgggaaagaatttacttgcctttcagattcgaatagtagctttgctgggtatagtattttttattggcagttttttgttgttgctgtttgtttgtttttcttttgcacttgggatatttcatcctattctctcctggcctgtaagctttctgctgagaagctactgttggtttgatggagactcccttatatgtgagttgactttttccttactgtttggagaattctttctttgtatttgacttttggcagtttgatgataatattccttggaggaagcttttggattgaatctgttggaagatctgtgagcttcctgtatttgaatgtccatatttattgtaagacttaagaagccttcatttagctctgctgtggtctttattatttatttattatttaagctattatatttaataatataaaatggttttctattccattggctttcttctcaccctctgggacactgaagttttgaatattttgtcactttataatgtttcatgtgttacataggcttcgttcattctttttttactcttttttttttttttagttttgtctggctgggttatctcaaaagacctgtcttcaggtttataaattcttcactctgcttgaccttctctattgttgaagttctcaattatgttttttcattcattaaatatttagttccatgattttttctttataatgatgtttatctctttgttgaatttcttattcagattatgaattttctaattcattcgtattgtttatctgggttctcttgctctgtgtttctttagtattaccatttttaattaatttttaagtatttcatatatttccttttctatgaaatttgttactagagaattatcgtgttgctttgcaggtgtcatgtttccttgctttctcttatttcttgggttcttgcatttactatctgcacacctggtgtaacagtcactttttctaattttatcaattagcttttatagggaaagcctttttcctatagtcacatgtaaggaaatcagattagcagcagatttctcagcagaggggatgtcagcagggcttcagggatctatagatgcactagctgtagggtctcagggtacaatgtattctcatgaggacttggctctcaaaacctatgtaactatagtattggtttggtaggatgctttggttttgtttctggcagggcatagtagtgtgttctctgtaccattcctttggctgtaatcagtatcattaatgtcttggagttcctctgtggtttaagctgccgttattagtggaggctatggcaatgcattgctgtggatgggatgctaggcatgctggtcctcaggtgccagtggtggtggcgtcagtatgcataacattggcagtggcagtagtggtggtgagccaaccctcaggcccatgagtggtgcatgctggagccagcagtggcagtgcaggactgggcaggccagtccctgacccctgagaaacacacttgggtgcagactgcaagaaagaaattggcctttcctaatgctcctggatgacatgcacatgctacagtgggggacagggtgagctgatcttcagggtcttggaaggtgtgtgtgtgtgtacctgcagtcggcaggtgggttggatcagtccccaggtccaggatgatacatgcaagtactggttgcagcagcagtggctttcagggcgcaatatagtctggtgaggctgggctctcaaaatagcagaatgctgcagctgcttgggttttggggggtttatgggacaaggatgggcctgtctttgggtccctggatgctgtatgcaagcaccagtggtggtgggcaggacacagaatccagaggacatgaaaagttgctgcatctgtggtgtgtagagcagccctgtcctcatgtctcctgatggtgcatggggatgccagcagtggcaggcaggatggaccaatccccaggcctccagatgacctgtgtgggtataggcagcagtggtgatgtgcaggacaaatctctcctcaggtcccaggatgacatgtggatgggcccataaccaaggcccttgaaggcacttgcaggtgtgtggcagcattgctcctgtgaggggcagggttgctctgcatggcagtggtcctaggcaggtggctctcaagccctggggaatatacactttgtctcgcttttttctcatggcagcctctctggtgtgctttaccacatgttccctggggtgtaaggcactgcatgggctagagtagtggaaactcagctgcactgccgtgtccagctagtgtcatgatactgcagtcctcgggaaggacatagggggatgtcagcagagcttcagtaacgtaaatgcaggagcttttagccctctgggcacaggatagtccagtgaggcctgggctctcaaaatagcacaatattgctgctgtttgggtcttggaggggttacaggacccagcgtgaactccttctttgaattaatccaatcaagtgaactcgcagcagctcctattccagtctcagggcctgtgagagccaaagggttctcctgtgttaggaatgtaggagcgggcggtgggaatttaaaccactggggatcttttgttcacctttttcccacaatgggaggttcctcctgactctgagctgatcctgaggggccagctacttcacttctctctccttcctcgcctcagaagttctctgtctcttccctgctgaattccactgttctctcccagatgctgtattccacatgtggttacctacttggtgtttaggtccctctgtgtggaggaggcaagtgccaggtacctctagtttacccatcttgaagtctcctgcacatttaaaatgttgatatatattgccaatttttccctaatgggaaaagcagtgtatattttactttttgtcagtctgacaaatatctcattaaattgtcatttctttaaatatgaacatagttatacatttttcacatgtctaaaggccattgtaaatgagaatttcttatcctctaactttttaatgaactagtttattaattgttattaatttataaaaatcatttgaatattaagaaaatttaactatttgtcagaagtgctctaaacatttaggtagcttttaacattatccaatttaaattttacagtgaatattaattttctaatatagtgaatactagagctgcaactccgtcataatttgtaatcttattctctaagtgtcttttcttcttatggctttgttttcttatttcatagaaaataagacatcatcttaccactttgcatgcttttaaattaaatttatcttctgctcttcagctggtttttcagagatctgtgttaaccttggtgacagtgtctgtcaacataggccagccaggtcacctgcattatattcatctgaatgcttatattcacctgaatgcttattccagacttaccaaatctctgagagtaggggtcaggaatctgcattttaacaagctcagactaaggtttgtgaactactctaaataatccagatgattatttagaacaatttttctttgtttttaatttcttttcatgagaattacgctgttttcttttcttttcttttcttttttttgagatggagtctcactttgttaccaggctggagtgcagtggcgcgatctcagctcactgcaacgtccacctcccggcttcaagccattcacctgcctcagcctcccaagtagctgggattacaggtgcgtgccaccatgcccagctaatttttatatttttggtagaaatggagtttcaccccgtctgcctctgcctcccagggtgctgggatgactgtcatgagccactgcgcccagccctgttttcttcacattacttattttctgtctttgccattgcataggatgttaaggttattttaattgtgagaaacactctccctacaatgcaaaatgccactggcatttctttgtctccctctcacctttttacctaccttttaccaacagaaacacacatattcacggaacatacacaaacacacacagtacatacacacacacacatgcacactcacacacttcctggctagttatcttctggaagtggtcttccatacctttcatacattgaattatttgttgcagggttgggaaggattatgaatcagaactctggcttccctgaaaaaaaaaaaccagcatctaggaagctgatgattagctacacagttttctcttatatgcattcatacctggcaagcaactggaggtgaggaagagatgaacagcaagagtcaggattatagtgggagacatggtcttaggtgctcaaacacatctgaatgggtcattgtattgcagttttataaatccagttgttttgaaaatttcccctaggtcctagccatggttattgattggttttactttttagcgagcatggaagtattcataattttctgtgttcacttatgcgttttcagtgtaaaattgagacatgatacattaggaactcctatccagatgttattttaaaaccatgagctgaattgaacatgtcagaactaaaatggcatacagagaaaggaaatttagacttattaaacaaatacattatcagtaaagtaagtaaataactattcctgccaataatacattttaaattgatcaaatatttaggatgtttttacttcctgtcaaaatataaactaagtgaacatgttttcactttatcttcatgacctatcacttgggcccatctccttagtaaataataaggagatgaaggcaaattcagaaaagctaaggaaaaaagagcttagttgaaatctaccaaaaagagaaattcctacagtttgtttttgtatgctgtaaatcattgatagaaatcaatttcctcccacaaaaaaggatctcaattacaggttacatttaaataagtaatgagaaaatgtaccataaatttcaagaggtaaaatccacaaagatttgagtgttttaataaaaaactataagtaatgattttgtaataaaagttataagattctgagacatacttgaaactgattatttatgagtggttaatttgaactattatggatgaattttttttttgttttatcaacaattcttagcaaaaaaatttactgacacaatcagggccttttattttaatacagaaaaaaaaatgagtaagatgcagcagtgacttttccccattggaagctataaaccagcaaagctgtaggccaagtccaatgttgattagtctgattgatgatccacttcattcccagtaagacctagaagaaaatgaagaaatggaaatggcaaagaaactggatacaatctttacattctttcatccatttatctattcatctattcatccatctatggttctaagcaaacaagattgagcaaggatacaaaatttcaataagttaccatttctggtctcaggttatttagtaggaaagaggtgagaggtaaggctatgtagtggaaagacacagaaccaagattagacttcatgcctcaccgcttctaccacaatcatcactgctaccacccaagtgtccaagctgccctgtcccttgttctactgcagtagccttctgcatctccttctgcctccactttctcatccctgtcttctgttcaccagatagcaaccgaagtcatgttttacagatgtaaatcagaccaaaatcatgcagttttattccataactcttagaggaaaatgtctcagtcatgggttacaagatcctatgtgacctagtccgggtttctctctgaacccagatctcaacactcccctgaactcactttgcttcagtcacactggcctccttgcatctctttgagcttgtcaagcacacttttttgcttgagggccatttcactgtctgtattctccaccaggaatgctcttccagaagatggctctgtggtttgctttttgacttcattcagttctgctctcttgtcatctcatgagccaccttccgtgagcaccctatcaaaaaaggcactccaggcccacttcctccccttacattacattatatattttttttccagaacacatacctcacattatacttcacattatattgaatggcatttattgtctgccacttgtcactatattataagctccatgatggcagggacaccgtgtctttttctttgctgtatttcctgtatagaaaatagtacccagtggccgggcatggtggctcatgcccataatcccagcactttgggaagctgaggtggccgcatcacttgaggttaggagtttgagaccaacctggtcaacgtggtgaaaacccagatctattaaaacacacacacacacacacacacacacacacacacacacaatatcagtgtggtggcgggcgcttgtaatcctagctgctccagaggctgaagcaggcgaatcacttgaacccccaggaggtggaggctgcagtgagccaagatcacgccactgcactacagctagggtgacagagcaagactccatctcaaagaaaaaaaaaaaaagaaaaagaaaagaaaagaaaaaagaacatagcacctggttcatagtagaatagtcaataaatatatgttgtataaaggaatgaaatccacattttagtccttagttctaattctcacagatatactttgtactatatttatttataggattatgggtaaatatgcaaagtaagtgaaacttatcttttttaatacacttagtcaatgatttgtcaattaatgccaagagctttggacacctatcttttatcattatgatccagcctgttggctgtctcttttttaaaaataccctttctctttccatcccattctttttctttataactatccatctctatttccaacatcagattatgtggatctacctgtatactgcttcctaatttttcaggtctatggcttggacaagtcatgcagcattcttccaagtcatatcatggagtgactcttcctctaaacatgccagtatggctttagatctagaccagaactagatataagccaagattcaagtaggtcaatcagagagtatatctaagaggaatgtccaactggaacatacctcatagatcaaggccagaattctaagtggatcaatcagagagtatatctatgaggaatgtccaaccagaacatactcatagatctaggccagaattctacgtagatcaatcagagagtgtatctatgaggtatgtccaacctcacatcattcctggtttaatgaacccagggatcctggattcattccgggtttctgctgaggaattgtttgtgactatgagcagaactaccaactgctactcctctcaagaataaagcttcctttggcatgagtttcagtggtcataaagtaaggcactatttctttaattttctttgctttttttcctggtattttgctaagatttaataacagaaatgtgtcatgaaagaaacttctatatcttttttcttaccctacaaaaattaactatatttgttcctccaaagtcattgattctaaagaaagtttattaccataatggccaggcacagtggctcacacctgtaatcccagcactgtgggaggctaaggcgagtggattacttgaggtcaggagtttgggaccagcctggccaacataatgaaacaccatctctactagcaatacaaaagttagccaggtgtagtgacactcacctgtaatctcaatgacttggtaggctgaggcaggataattgcttgacctcaggaggtggaggttgccatgagccaagattgtgccactgcactccagcctgggcaacagagcaagattccatctcaaaaaaaaaaaaaaaaaaaaaaagacagagagagagaaaagaaatttgattaccataatttacaattgtgactaatctttccttttttcctattttcctctctagaggattcacattggtccagatgatttttcctgacatattacgtatagtcatttattttttcatttttattactctaacctttaaccttgttaacactatagcttacttttggcagccaggattttgatgatttcttgcctccaaagatatcccaacattataagatctttataaagtttctctaaaatggaaaatggcaactcatcctaccttattttttcaacttctaattacatggcttaccattcttagcatataaaaaagaactcatgatcccatctaaatattgttaatgtgaagttataattaccttggaaatgcttacgtgtgttttgtatctatcatagtctgtcatagtttagaaccaacgtttcctggtgataaaattttgtgtttgtgagcacacaatagctagtaaaacattatacatactgagtcctaatacaggctttttatttcatattgtttccagaccattcatattaccacctattagagctagagcagtctgccaaacatggagagggataattaaaatagtcttaatgaaattatatgttacaaactataggataaagcagtgtttatgcaataaaatgatgtcacaaagtaaggactgaaaaacaacactgtgatgatagcagcaaattttcctttggcatgagaataggtcaagaatataccattcctattatgtaaaccaaaacataattgtacactatacagaaaaaaactcatgaataaacactgactttctgaagaaaatatattattttcaagtgaatgcttgtaagcaccatttaaaggaaaatagtcacattcttcccaattgccaagccttttccttgtacagttttaatgaaccatttttattctggtagtaaaatattcacatttctcattgaaattcaaagattaaattttgtacaaaattatactgcagtttggaaaactaattaaatgttttattttgtaaatgtaatgagctagttaaatctttgttgccaaaattaaaaatgtaggaggattgatggctaaataaattctaagagtcattcacatcagttgagattgatgccattttgtcaacgcagtctaccactaagcagaagataatttgagtagaaataaaggtaatttgaactatatttttgaatttgatatgacaatatcttacattgattatttggtaggcattagttaggatataattgtagtttattttaaatatctcctgtataatatgtgattactcattatggaaggcatatatgaacacataagaaaaacaggcacttggattttggaacaataacagctcactttttatagaatcatttaagaggcattaactacccagaatgtaactgagagaccacaaatatgaaacaaggatgacaggaaggtaaaatatgtattagattatccacaaagcctatgtattttacttgtatgattactccccattcaaagcctgtatacttttatcttagcatgaacttaacaaatttgattaactggttttctgtgcagtggtgcatcaattcatagtggagtcagctagagttacactgatacagttccaacagggcaaggagacagcctcaatgtatgtgtgtatatatacatctatatgtatgtatatgtatgcaagaagaaagaagcaggaaattagaaagcagagcactctggaggataattaataagtgggtattaagcttggaaaatcttgttgtgatgtagcagagccccaaattcaatcatacagcaaggaaggctggaaaatgtagtctggttgtgtacctgagaggaaaaggacatagtttggtaaccagttagttaaacctgccacaaatactggggttcatgatgatttctgtactacaagtcactgcaaacaaaccaacaaaatcttatgtttagtatttgccacttaagggcaaacatcacaggtagatctcattatatagaagcatatcatttcttttcctttttgtttgtactgtcctcaagatcagacttgtatcaccaattaactcaatatattgaaaatcttttattatatcagctgaagtgcataatgcatgaaaaaacccaattactcttttgttgaactggcagaatgggcaaacagatactgagctcccctgtttctgtccacggagaacaataaatatcagctgatagtgcatgagagaaatatagcataaagggataaagattaattcccatgggtttagaagcaactttgtaaggaggaaactattagtaatttttctaatgttttttcccagcaaagaggctggtaaaaccctgatacttagagttatcatagcaggtacactcttaggaactagaatgagtagtctctagataagaataaaactagttttaattctttagaaagatttaggtatctttcctatctcctttcccatatccatcctcaacgggaagacttgtgaagtgaagaagtggtctgcctatgtgtggctgcagtaaagtagacagaagtgtttcttttgtgggaacaacaggaatgaagagactgcaggaatgtagggagtttgcagagtccaggaggatgaattggaggagatctataagttctgagcagagcagccagagaaggaggaagaaacaactcgaattgaagaacaaatgggttaagcaaatgaactgaaggtcttgtctgaaaaactgaccagaatgcggcctactgctggcttttacctgctttccaaagtgtagaggctactgcattgcaagggacagggattgggaaacttttttttttttttaatggcatggcataaattcaacattcacccagacttaccaccaaaatatttaaaaacatgagtagagagacaggaaaaagctcaaggttttaattggaaacatagttacataattttgcggacatgcacacatcttaaatagtatcccatttaagtaagaaaaatgtcttgttttatgtttcttttgacataaattcctctctcccactaaataccactatcggcagatcatttcattattaagttgttcacttaaagcacaaagtacagctaaattcatctcctccaggagaccacaacatcctgtacctgtcgaaaatcaaggcacttgccatattgtattgaattgaaagttaacatatcaccctttcttcctaagctccatctacttcagatcaatgtgtttatatttatatttccaatgcctcacatgcaacctggggcaagagacacacccagtaaacattttttggtagtaaatgaaactgagttgcttttttctttagcattctcttcatgtacaaatgctcttggaagaaataacacattaattcaggctcattcctaacatttgcagaggcaagagcatagatgaagatccacataccatagacctaaatagttataatttataaatctaactaataaactgttaaataaaacatatcctaacttcctaccaaaggaaaaaaaaaccttcatatcaacatgataaaagttgtacgtaatagcagttatattttaagatgctaaaagctggaaaaatgcaaaagttaaaatgtaattatcaatatgcatatttgagtgttgtgcttagattggtaatatttttgtttttaaataaatgtatgcataaatcagtatattttttcagaaaatatactttctcacctttattttagcaaaatcactaatttgttcttataataaaaattttcaaatattttgcatttggcttaatgtggtgccaaacaaacaatacctttcctaagtcacatgatatctgcttgctttcattattttctgtttttaaaatttaggcacacctggccgggcacggtggctcacgcttgtaatcccagtactttgggaggccgaggcggggggatcacgaggtcaggagatccagaccatggtgaaaccccgtctctactaaaaatacaaaaaattagccgggcgtggtagcgggcgcctgtaagtcccagctattcggagaggctgaggcaggagaatggtgtcaacccgggaggcggagcttgtagtaagccgagatcacaccactgcactccagcctgggcgacaaagcgagactccatctcaaaaaaaaaaaaacaatttaggcacagcttcactttgaaatgttttctctctttttgcttttcagcctttactttttctactcatatattttctttttctacctaatcagagtttacacagcttgttaatatttaaaggattaaaaaataaaaggttgccgtattccaaacacacatttgagtctatagtttatacaaaggttcaatttaaactttcaaatacaaaaattaaaacaaaattatctctatatgtgttctcagatacagtttatatatagttttcagaaggttttttctaaagtacccaaaatatttatttaaatgaaaacaaaatacaaattattaatattagatataaatttctaaggtaaatcatttgaatacagctaaaatttagttaaacctcatgtatctagattttaaaaataaaaactattgaccattttaacattaaatggccatctagttggcaaagaagtatcaggcttcatgtatattaacatagaaatttacatgcacaaatttaaacataatatgaattatttaatacttaacatagttctcagccattatgtacacctgttttgattaatggtactgcagtgatttatgagtatcttcagacacatacagttgaaccaaaggaaagtaagcaagtgggtgcttgttaatgatgctttattatgcaataatctgctgcatttctgctatccaaaggaagaatttggcaagttaattagtttgccccttctcttacctcagtgcttccagagcacaaatttctccccacactccaaagcagtatctttctgttgtcagcaatggtacaacccgcaaaccttggtagcatttggacattgtcaccttttgattctaggacacaggaggaaaaatgttccaaaatgtttctctgggtcttagagggtgttaatcataagagtaggtggtgttactcacaagaggaaatatttagtattctggcttgttctgtgccagcaccaagtgtaagatcccaagtgatagaggagcccaagagctatttaatgatgagtctatatttgtgataagttgaaccttctaaattcatcagtccccgagcgaaggtctccatgatctgggtttcagggtagtattgtgtgaaatttctacctgagtttatcaagtaaatgttttctcttaaagagcacagggatattagacatctgaagaaagacgttaggggagagcttacactgaatggtgaaaacagtgaaatgaatttggaggaacctaaagcaaaatatcatcttgactaaaatcttgtttgggagtttggcctagaagtattagtttattactcttgtttctatgtgagtacatgtctttatgttcccctccctcccttcctgcctctctccctcactctctcctctctctctctttctgtctgctctacaacttgtcttgaattaatcattgttcagataatttggaaatgtttgacctggggttgagttctctcttatgttcacgattgggattttagtccctctatattccggttttgaaaagcagggatgcctttaatttgtttataacaacctaattcttcaaatagtgttttaagaatttagcttggaatgtaaagtataggatgtttctgctataaatcaaagtccttaggagactcacagacctcaagcagaatttctcagagggcacattcaacctggatatagctaggtatattttaggtttcattatgtttacagttgtagtgaaaactggccaaatattattaaggagggaaaaatagcatagataaacattctcagtaacattattatttgtctctattccccagccctgtatgtccaggtcacaatagcttaacaactgtgataagctatattttttgagcaagagagaaaaaaatgccacatattaggaaatcctgctaagaatgtatcaaaaaagccaaggggtgcaagataactttaggtaaacctacagaatgaagaagaaatcatgtgcctcataagttagagatattttctctccttttcaactattttaatgctttagggggtaaataactaggccagaaatgtgatctactcacttcatatctccaatattgattaatcaatgattatagctcctgactcatgttttatgcatgcttagaacaacatggcacatgtatacatacgtaacaaacctgcacgttgtgcacatgtaccctaaaacttaaagaataattttaaaaaaagaattttaattctctctgtcactttgcatcaagctaaaagcagtaaaaatatgaaaatttgcagataaacagaaattttagtatgttattactctgtaactacatctgacttttcacatttttcagtaagctggattagaacattgaagttattttgcattactgcttgacctattctatgtgggacttataattatttctgcattttataaaattttaggtcagcttttagcaattcattatacctttacatctaatatactattttcttccttttagaaattctattaataaaaatagattggaacatagcagcattgttggcaaaccaagctttattaaatatttaattttatctgttatagaacatgaaaatcagcggttatgcaagagcaccgattatatgaatttgcatttcaaagttaaatggttttataatgaatatgtgcgtgaacttcctgccttcaaggatgctgttcctgaatactccttgtaagtagtgattttaacacacacaccctcagatctaaattcacattcctgtaaaattacacctgaattgtgtaccactaaaatctcttcacataatcttcattggaatgcagaaatttccattatgaagttaacattaaaggatttgcatgtctttgggaaccatatttaattgaattgtgttgcatatttcaaatacgccctacctggatattcaactcaaagacaaaaaatgcataataagacatggctcatgtgataacatgaatgattttctgtaaaaataccagaacacagatttttttggggaaagtatggtgcttgtatattgacctatatattcagattttcctttctattcaaacttgtaactctcttaggaattcatatttctaaaaatagaaatagtggtttaacagggaactttctcataaatatgcctctttcaaacacattttaatcacacaaggactcatgtaataatttgcatttgatatgtattagaattctgttttattctattgatggggtcttccctatggcaggcactttccaagtgctgtagagcaatagaaaataaagacccccaccctgaaaggaacttatactctaggagatgctgataagcttaaatatcattataaagcaaggcaaagtgaaatatgtgctaatttaaggagcataagcaaagcgcaatagggtttcacagaagagagaaattacctctatttggggaactccacacaatatttatagatgggatagcatttgatgtagactttataaaatttgccaggttacagaaagaaaagggagaaaaagcattaagatgaaaatgaaagttatgagcataattatggaggtaagaatatatgagctatcatccataggaagtaaggcatatttccatttttataaaattaatagaaagtaatattttaaaaaaataatgtaggaaaagtagttttgagctagattgttataaataaatattgtgaagcttgtaccacattcatcaggcattgtgggagttggaagagacaaggaatggggggcagagaagagatttagaaggtaatgagtgatttagagatgaaattagaacagccctttaacacaacttttctcatacaaagtatataagaagtaaggggacagtgggataacttaaaaatgccgtactatggggtatagggtgttggggagattttggtcaaaagatacaacattttagttaagtaggaggaatgagttcaagagatctattatacaacatggtgactgtaattagtgtatcatactctgaaaagttgctaagagaacatattttacatgttctcaccataaaaatgataagtatgtgaagtaatgcatttgttaattattttagtttagccattccacaatatatacatatttcaaaacaacatgttatacttggtaaatacatacaacttcttttgtcaaataaaacatacttaaaataaatacaataaaattatagtctttatgttaaataaaggccatactgaaaatatagagtgattgcagcaagtatgtaaagggtgaagatgtgggagagaaattttgaagatagaatttacagaatttgtcaactaaagacatatggggttaaaagaaagaggaaaggtgaagattccttaaagaactaaaagtagatctaccatttaatccagcaatcccacttctgggtatctacccaaaggaaaagaagtcatatacaaaaaagatctttgcacatgcatgtttatagcagcacaattcacaatttcaaaaatgtggaaccagcccaaatgcccatcaatcaacaagtggataaagaaattgtggtgtgtgtgtgtatatatatatatatgtacaccatggaatactactcagccataaaaaggaatgaaataatgacattcacagcaacctggatggaactggagaccattattctaagtgaagtaactcaggaatggaaaaccaaacattatatgttttcactcataagtgggagctgagctatgaagaagcaaagaggcatgagaatgatacaatggactttgaggacttgagggaaagggaagttgggggggaaggataaaagactacacattgggtacagtaaacactgcttagataatgggtgcaccaaaatctcagaaatcaccactaaagaacttattcatgtaaccaaacaccacgtgttcccctcaaaacctattgaaatgaaaaaaatttaaaaatagaaaaataaacaagaaagaggaaagagttaaatatgaagtctgtatgcctaagttgttggtagtatcattgatcaggaatagagaagtaaaacagaggagctatttgccagatgcttctgcttctggctctgtctagacactctacgctaaactaaaatcagactaatattttccctgatggccaacaaaaaaggtaaataaaattaaacagcatcagaaagacaacaaaggcaaccaggacttgagaatctaagatccctgagaaaagaaaaatgcactaaggtgagtcctgtattttgttgcatcttctctcccatgttttcacccccatacatctgccaatttgcaatacggggcttgcagagcaaacagccaacagtagctcagagtttacagctgtctccctggactggagaaacaatatgggttatggggctatgaaggctgcttggatttgtgagaccaagatcccagagaaaaggaaaccacagagatatgagtccaacatgctacaggcagttcccactgaaggcattttctgatgcctaatttacctatgtgttgagattggggcagaagaaaatcaagtagaaagtggccactaagagattgggaactaagtagatactttagcagtctcatagtgctgaagggacaaatgttagagatcaaggctggtcccctttgtgcctacttacagtaacagtctctccttctgttgcagcagtaaccaccttctgatgcctaatagcatagattagttttatagatttttatactttttataaatggaatcatacattgtgtacaaaaaataagaaagaaggaacattataaacactctaggctttcaggtgagatttttgaaggtctctgccctagaaataatgacaaagtggaaatagaccaacctaaaacccaacactgtctagatcaaaggtccacagcttttcatggacaatatataacattcatcaaaaaattaaaggctaccagacaacaggactaaataactatctggagattatgcttcttcagcaatgaattgaaaaaccagaccccaacaaacagtaagaacaaagaagtttgaaaaatctgaataaaacatttagagatatctatctatataggtatctacatttctatatctatatctgatcatccagagtttccataatttttcattgacaatgcttacacacaaaaacacccatataaaatttataaacaaaaacaataaaatacatattgttattaggaacacatggtacatttaccaaaatagactgcctcctgagccataaaacaaaactaatacatgttaaggggagaaatcatgtattatatattcttgacactgtagaattaagacacaaatcaactccaagaagataattagataattaaatacagaaaagcagcagaatattctaaatactcatgagtaaaaaaagaaatcatggtaaaaattacaaaatattttgaattaagtgctaataaaatatggcatatccaattttgtagaatgcagctaaaacaggaagtagatgaaaattcaaaatgtttttgaagtagaattttaaaagtaagtgtggtctatttaaaactttattaaatttctgtattatagccacaaacaattagaaaatcatatataaattgtaccatttaaataacattaaaatcaccacaaataaatgtgatgaacggcgtacaagccatgttttcaagcaactataaaatattatgagagaaatttaagatgaactaaatgaaatctgtaacattcctaaaaagatgcattattataaagatagcaattccccccacatggacctacagtttcaatacaaccctatgcaaatttcaaaagatatttttgtgcaaattgacaagacttttaaaatgcatgtagaaatgcaaagtgcttaaaaatacaaaggcaatctacaaactggagaactacattattggttagctaataaagtagagttcttaagagagtgtcatgttaatgcatttctcagtcctttctcacactgctataaagaaatacctgagtctaggtaaaaaataaataggtttaattggctcacagttctgcaggctgtacaagaagcatagtggcttctgcttctgggaagtccccaggaagctttcaatcatggcaaaaggcaaagagagaatggggcatctcacatggggggagcaggagcaagagagagtgaggtgggatgtgctgcacagttttaaataaccagatctcatgagaactcaaacactatcacaagaacagcaccaaggggatagttctaaactattcataaaaactccacctgcatgatcaaagcacctcctaccaggccccacctccaacattgaggactacagtttgacatgagttttggtggggacacagatccaaaccatatcagtgcataacaaataaaccaagggaataaaatagtccagaggccaattcacatgtatggcatgatgacctgatttgcatcaaagatgcaaattcaatgcggtgggggaataaagggtgttctaaataaatggtgctagatcaactgggcacacatacagaaaaaagaatttatgctcagaatggagaaaaaaatatcctacacaatttccaaaaatcagttgtccatagattatagatcataactaaggagtctgaggtaagcacccacgatcggttacagattagtgtgaatgggtagaagctatatggcaaagaatttaaaaatgaggaaatgcgttgatagggaagagagcacacaaggtctacattttacaagagtttgaattttgaagggaattacagagtaactgttggaaactaagcatatttgaggcagcatgcgaagaaccaagacgggggtagaggttggaggtaaagaggaggagactgatttgatggagaacaggtaaaggtctctgaggaagcaaaactgcaagagagaatgaaaggagattgttgattctaaattactctcatatgcaaaaagagcagcattcctgttaattttatgcaaatgatgtcctttgtggtatgtaacattattaatttgttataggtggtttgaaccttttgtcatgcaatggctagatgaaaacgaagatgtgtcaatggaattccttcatggagcactgggaagagacaaaaaagatggagtgagtttaaattaccttaagaaagttcattgccatgattcagtcacattgcttacttttaacctaatgggaattattagactcattgttattaattgtttccattccccagtgaccaaaattaatttaaaacacaatttcagtggtctggtcagaaccctagaaacttgcctacatttattaaaaaaaaaaaaaatcaatcacccatttttcccaagattttctttaattcttacattaatctgaatctacaggtttcctaaccttgtacaaaacatctttgttgtcctggaacttttccaggatttctagattaggagcagacattctcccagtccctgtgaagcagctcccaaaatcgtgagccacaaccgtcttgctaagctaacctattgcctgtggagaaaatgaaagacaaaagaaccagtacctcaattcagcagtggaaaaaccaattagcagtagcttgccccatgatattagttccaccacactttcaagaaaaggagattaatgattttaaagtgggtaagcattttattactgggaaatgtaaatatgtgatacgggagattcagttgttgatgggaaacagtgaagatttttccattccgcctctaatgtactgtttgggatggtttcacctcctctccccacagttccagcagacatctgagcatgctctcttttcttgctccgtggttgatgtctttgctcagctgaatcagagctttgaaattattaagaaactggaatgccctaatcctgaagcattatctcacttaatgagaagatttgcaaaggtaggttaaataaaatgagtcttctttttctctgggtctgtggcaatctgaaaaatgctattgttttgtggtgttagtcttctctgtcaccccatcccagtttatttgtaattctgtactagtaaattcagttgtttccaggattcccatctgatttcctacacttcctgtttctttaatatggatttatcatcttaaaaacctatttattgttcacttcgaggactcagttacttataatcgaagaaattaccatggatttccaaattactcccatttcaaatgtggtgttttctagctgaaagtaagccttggcaatttcacattcaaattgccaagtgttttagcagacattgtagtatagtgcaatgtatattgaacttggagccatgaaaactgatttctgattacaaatcaaccaataattgtaattgaatctcaatagttcaagttttttatgaatttagttttcatatttgacatattgattttgataaaccaagttcatcttaaggccccttctcctcttaaaatctaaaatggcttaccatgtgcttactactttcccaagagtttcaagggaaatataagaaataaaagaagcagccactgtctatcaaatctcagaaaaaatccatataatatgcaagaccacatgacataaactaattgaaagatgacgtgaaaagggacacaattcagcttcaagcttagtgagatcaaccgtaaattgagtggagggaaatctgatgagagccgaaatagacagaggcttcatgacaagggcagggctcatagaagactaaaacggagaagttagaaaagtattctaagccagaggaatagcgggaacaaaggaagaggtaaagctgagactgacatgggaagggcagggagaaacaacccttgtggggagaagcagtaggaaatgttgggagagtgaagataccccagatcttgaagaactttgcttcccaggttgagaagtttagacttaatgtgctggtcaacttaggaaacgcagaacctttggagatttttatgcagggtagtgacataacaaacatagtaatttagggaaactacttacacagttctatgtctggctgatctaaatataagtctgattccatggattgaatgatgactgaggttttaggctgttcattcaacaagtgcttgcctatatgcctcactcgcacacactataagccaccttgagggatgtagtcatgaataagcataatctgtgacctcagaaaacttgtatggaagggccaaagctgcaaacaactatgacaaagtcaaatgttataatcagagcatctcagaagttgaaagaggcccagaatatagataaagaagcagagacagacagagagacactaaactgtattatatttatttgccatgaaatattctgatctcatcttcattaattaagactaacctcctacttttaaaatattaaataatagccagtaatcatttatttaaaccattcttagagatgactttctgagtccccttagatgattctaatttcccaatatagcgaaatctgtagagcataattctaaaaattctctaagtcttttcttgatgagcagctgtgtttgggtgaatgccaagaaaagaatgaaactgggtcattaggaatagtgtttgacaaagtatgtcacgtactattcttggaattctgtaggatgtaggggaagcaggctcatatgagaatttaaaaatctcagggttaatatatttaggttaatatatttagtaacatatgataattgtacctgatattagaaaagtaactagaattcaccctcagaatagtcaggcaggtaggttatgtaagttgggcgacatgagtgcacggtaacagagtagaaagaatgctgaattgagattcctagaccctgagctgcagccacccgtttgtagctctgacctttcttcagctgtaatactgaacatagccacaatatgcctgcttgggtataaccaaatgtactgaatggaagtataaaagggtgggaggtcacaaggaaggtcatattagaatcacactcaggaaaatacattctctgaagcaagaagaaaagaatcagcttccatgtattactgaggagatgtgtgcttttattggtgcaataaaaaattcaattaagtaaaacatttttaatccatggaaattcaacaatatccaattgtcagcaggatatagtgtaagaacaatgagaagcattttctggaaaagaagaaattagtgattttcattgaaaaagaaattctattttattggaatgatttaaaaatctcttgccagcatttctctttttaactcttgcagtaacttactatacagaataataaataaaaagcaaaatcaattaaacataaatataaaaataagaaacatcagtcaaatccattttaccattatcagcctttccttttttttttttttctttttgagacagagtctcactctgtcactggagtgcagtggcacaatctccgctcactgcaaccttcacctcccgggttcaagtgattctcctgcctcagcctcccaagagtagctgggattacaggtgttcaccaccatacccggctaattttttgcatttttagtagagacagggtttctccatgttggccaggctggtcccaaactcattatcagcatttctatctataatttgtattttatataacaaagtagataaaaatcgtttgtgtttactataattagccatttcacaagaactgcaaactattgcaatttgtttttatttcatcagatgtgactgactaattagtcttgaaaactctacgcttctaagtattggaatccttatatcaaaatatactaaaatcccattatctttatgggatttatattgatttaaacagtctcctggagatcagacacattaattgtatctgtagagatttaaaaatttttgcattttaaaatgggatttaaagggacaatttattcttactaaacaggatataagactaaaaaaggtaccaaacaaaatgcttcaaatttcatatcaagaacattcagaagctatgatgagtgataaaatgggcacatgagtagttaatattcctatgattatagtgctgctcttgacaagtatgggtaatttaattttaaaaatagatatgaagtaatgttatttttaatattgcctaaaaacaaataaacaaatattaagtcctgggtatgagtctggctgtttgccaggtgctgcagatactgtggtaaatgacgcacacatatttatttctattccttgttctctgggaacataattctaatttttaacaataataatgataattcattgagcattattatatgctaatcactttatacattttcttattcttcacaaccatctaattaaatgggtactattattttccctaatttccatccatgatgaaacagactaaaaacgtttaaataattgaaatgatatagatagaatcaaccactaaactatactcacttctcattctggtgtgatcagaattaagttagaaatttggagaatagaatctcactatttgttttttacccttaaggtcaaacctaggcatttatggtgacagaaatgggagaccctatcttatgttggatgtgttaaaatacattacataaatccgtgaagtcacatttcttcacaatatgacagttttcttgtcttccttgtgttgctctaatactgcattgttccatgcataaaatgtgaatgaaaagatggattttgaaccacacttcttatctcactgatcataagagcagtacactagatggaataactggaagtgttgacaggatatttagcccactcctaacagggtggcattagctcagaaaaacacaatgcctttgtctgagtaattgatggccgtcccactcaatgctccaccagtacctgtgtgtcaaatcagaactgattgtagctgaaagatatttcagtcaccctgtctaatcctttaaatgcagcagaatcactctctgtactgccacactcctattagaatttcattttatttaatctggaactttttgaatagcagctctttataggcatccgtaaaagagccctctactcctcatgactatttctttagaacaagatgcaacagtccctgctaggctgtttgttccctctgtctgcactatactctcttctgaagaccagtagttccccaaagataaaatcatgacctaagctcacacacccagaagtcttatgttccaggccttgccaggtgccccgtccatcacagcttttctctgaagagttacctccaccctgccatgcattcgttaagatagtggttctcaaactttgtatgcattggaattaccttagacttgttaaaacccagacagctggagcccacctctggcatttctgactcagtaatttaggataggaccaaataatgtgcatgtccaacaagttcccaggtgatgcttataatggtgctgattccagaactacattccgagaaacaatgagttaagcatgtcataagcaacagcttattagtattaaagagctattgtgtgatagtggtttacttagctgaataaattagaatgaaattgaagttgcccacaaaatgtactttgcacactctcattcaagtgtacattgtacattagtaaagatgggagttattacggcagtgtgcttgcaactcttataggcacacagctttaagctatattcttttttttttttttttttgagacaatctcgctctgtcgcccaggctggatatattctatatgactgtgcactttgtcttacctgcagcccatcctgacttgctaaccattggcatttgtaggctattacgtgtgagatcccaggattccttgtctctaagcataaattcaagggactaaggttttcctatgaagtagactcaagctgtaggccatagggcatacttcaagaattatcgtaaagggtatccagcttgctctttcttctttagaaaacgataacaaaggcaaaaaacaaaatctatgctgttcagcaagtcacccggcagctgtaggatgtaggggaagcagaatcataagaattaaaaaatctcacatggcagtaagttgtagaggattttcacacagcccaaactttaccttaagcaagttacaatgtctgagttacaacgattgcctaaagtcaggtttatggtttgtgtttatatgttgttgtgtatgcaatacaatataataattcttcaagtttataatgtcatcaagaagctgtagattgagagtagtattcatacgtacaaacgaataagtatttcataggtaagtccaaagtaattgaacagtatgtctaaagtaaaatttgaagagacacatttgaagataattcagtctgatcagtcatctgtttaccaggatttattggtctgctgcttgataagattttatattttcaaggtcaactttctatttgagctgatgcatattatcacgttactgtgtacttcaacgaagtattgattttctgtctgtgtgttatctcttatttcaggatttcattgtgattttcaaagtgtgtaagcaagcttataatcaatttagcgaattcaggtttataaattaaacatctcttcttcagcttaactctttggagtgtctccctcagttgattttgagccactaagaaaattcaggcatatgttgtacaaataagaaaataaaagcttttttgtctttacttttctatcaaaagagatgacatttctactgctattgttgccttatctcttctaagaaaatcatatctacatttggcttatgataatttaatctatgtataaaagcagtgagtgcaaacacattcatgcatctttaagtaattgaaataaaatttaattaacatggtttattttcctctgctttgcataattaatgaaaacagagggcattcttaggctcagaaacagttgttagagggagaaaaaaatgtagaactaagatgaaaaagacagcaagaagttaacttaggattaaactttatagcatatttgtaaactacatacttacctgggtaaagttcacaatgttttctttcttagactatcaataaagtgctgctccagtatgctgcaattgtatcaagtgatttcagttcacattgtgataaggaaaatgtggtaagtaaaaaatgtctctactttcaagtatctctcagttgagatttacttcttcaaagtatgagtaagcaagataaattgttgactttcagttttcacataggataataagaaataaggatcttaagaagctggaaacttctccagggttcttgaactggttttaatacaggatttacaggaaggtagagagtgtctcaatgccagccaacttgtggttttccatgtagataaggaacaagactagaataaatcattgaaaataaacatactcataaaatactggagctgagaaaaacaagggacttaaaaattagatgagtattggcaccaactagtttcattttggcattaatactcaaataagtgtaatttagtctttcagttttcaaataaattgcaaacgttaatatatggaacaatgctgatttctattctgaattattaaaatagcttttttagatgattgagaaaatatttataaaattcaaactagtattgcaacttaatcaaaggcataaagaaaagctagataaaggtatttgaaatatagtaagatttattttatgatggaaggtgaaagctttcttattcaatctgtaatattaggagaaatacattggcagcattgtaaacattttgaaaaacagtagctctgaaaaaaaaaagtgtttaaaaagtgagtatagggtttttttttaaaaaaaagaaaaaccagttttttccccctccaaaaatcagtttcgctatcaggtgaatctaaattattctaaagaaagctactagttttctccctgaaacctcattgacctcttgctgacagctcattaagataagtcagtcctaatggttcttgagaattctataagatgcttcttttccttaaattaatatgctgcccagaaattttattagaactttttgacaactcaaacaattatttcttattgctattgattatactcaaaaagcaagatatttatttattgaaagtatattatttctgattacaagataatacatgtctaaagtgttacattgaaaatcaaaacagtatctgataatttcacaaaaggatcctgtttatactaggacagccaaattgaagattttgaaaggtgaccatgagctcctaaggctaattcctgccattcagaaaggcaaattagtttttaaaagcccctgcagagttccactttatgtattaacattctatattatattttacatttaataaacactgagataaaaatcataacccagtatttattatattattctatgtactctttctgtaggttttatacttggaaaaattaaatctttataaaaagaaacaaaagccctccaaatattacagcaaaggaacttccttttccttccctcagtgcttttcttccataattactaatatcttgaccagccttatacactgttgcttaaatgccaagtatcattttagcttttataaaagaatatcacttggttactaggcttatgttttcattcaaggcaaattgaaatgcttttgtacatttccatgagtatatatagttactattacagatacttatttataattattttaatatcagatttcaatatcaagatcactgaaacttgtacatctttcagtatatctatggcaatatatctatttcatctgcaaattgagctagaaacatctaaagatagacatcatttaagatacgaccataatataggccgggcgcggtggctcacacccataattccagcactttgggcggctgaggtgggcagatcacctgaggtcaggagttcaagaccagcctggccaacatggtgaaaccctgtctctactaaaaatataaaattaaccaggtgtggtggcgtgcacctgtaatccaagctacttgggaggctgaggcaggagaattgcttgaacccgggagatggaggttgcagtgagccaagattgtgccattgcactccagcctggccaaaaaagagtgaaactctgtctcaaaaacatacaaacaaaaaagatatgaccaaaacatttgagttctccgggttcagaattaaagaccagagttaaataaaatatccatgtcagaataatttgttttctactgtaacattttaaattggaaatgggtcaaaatatttttatttatttaatttcacattccaaaatatagcaagacatcacaatctaaattagaattacttttattttaaataatctttaaaatatttttaaactcagaaacactttggccatgtagaagtgttcctagtctgaaactttcatattcactatgtttcagtttcctaactttgttccagattgagataaaattaaaggtattattctatttttagggaaaaaatcaagatataaaaataggaagatataaattgactttaacatagtttgttttatcttactaaactcaaaaagcaatatccctgaattagggtaatgtttcctttgctgtcagtttccttttttcatttactatgaagttgttctttttttcatttactatgaagttgtcgaaagtaaaaactgtttcatgattaaatttaaggtgaatttgtataatctgttcccagtagcagtttgatgaattgattcagtaaaactgcactttgaacatttcaaggtcagggaactcttaatgaaaagggagagtctcaaatttatttttgtttccctccggataactgcatctcctcttttttctctgtagtctaacttggggtcaatagcaatccatgtcaagtgagccaaactgtccatgttcattttgttctcagtagctctttttcatcagaaatcatcatagtaagaagagttggcagttgacctttatttataaagctagtactagggtcctgttacatgtgacaataaagattagcttgaatgttaatatcaaataatctaagaagagtctatcaagctaacttagacatgggaaacaaggtgataataaccactcacttgtgtagtcttcctgtttctcattataagtcattgttttactttgaccttggatttctccctggtaggattgcccagattcacaccaaatcttccctttctgcaattaaaagtaaatgtcaatgaccctacctcctaatgaaaagataggctattggcttagtttgtggattttggttcaagatgctgaatcctctgaaaatgtggccctactcactatggaaaggactaagcccagatcaagtagttctcacttatggctatggatcagaatcatttgtggaacattttgattcagctaattaaaacagaatctttgggggatacatctcagatatctgtgttaaaaaataaagtttttaagtgactggaatcaaggaaacagaaaggaattattaaattgtttgcataaatcaaagtgatgatgtggtcactttaagagtcaagtagaaagtttttcaaaggtcattaatgtggctcaagtaataataaaatctttccactgataagagctaacacctctctgacatcccttgagtcctttgcatgactctggttattgggttatttctcagcaacttggaagatacatccattttccttcctttgtctatttctctttctgtgtctgtttttctctgatatactggctcttaggaatcaatatacagcaaagattaaatgattctataactattatgaattgttttctaattatgaattaatgtttactattctaagttcacatctagacctgtcacaaagctttacatctttgttattattatattatctggctccttggaaacaagtggagaaacattttctaagcatgtattatatgtacaccactgtgcagtagtttgtgagtaagaaaagcagaaagagacacagcagcatgtacaatgtatttaacgttagctggtgagagtgaaaagcaactcaaatgtaaagcaatgtaaaacaaatgccaagtgagtgataagataaaatccaggaaaaaagaacgctctaacctgaatgatggatatgagtcaaataagcaagtaggaaaatgagaagaaaaacacaggttaaagccagaagaaaaacacttcgaataccagcatgtggtctttacctgcagccagaaaatatatttaagtttatttttaaaatgtttttgcatttaaaaaatcacatggtattttcttttctaaaacagtaaaataacagaagaatttaagctaacctttttctaaaagtaaatctataaaaacaaaaagtgtgcttactttctaagtatgaaatgttacaatgttaaagataaaagaaactttagcagcaagtctccaatggtttattgtctgagtatgtttttaaatttcattccccaatgtggcattatgtttctctgtttccattcttaactgttacaaactataatgttgaaatagcagaattagtatatacatctaatataataggaatccaagatagctattttccaccacttataagttaaactcattcaataattttatataaaaagattgctcataatagtctttttttctatatttaaagccctgtatcttgatgaacaatattcaacaattgcgggtccagctggaaaaaatgtttgaatccatgggagggaaggaggtgggtatctttttctcctacatttgctaaaaacctacttagagattattagcagcatatctcttgctatgaaagtgtcttaatcaagtttttacatggttaactaagaacaggaaatgataataatctcaaatgtcattaacaactaaaatgattattatccacaacagaatactttagtaaatacattagaagtgtgaatgggaggcagaagatagtagcctttggtcttctgtgtgtgcgcatgtatgtttgtgtgtgtagtcatatatacacacatatatatttgtatgctaatgacttgtaaaattccacaaattgtgtttttcactgtcttgtacaatgtcagcttgatatcaatgtttattctgcaatatgctttgtggtgctattggtttttgatgtactggagtttatttttcacattgagaaagctctgtcaaaaatgtgttgtgtgatgtgtctgtaatgtgtcatgtctttgtccaacatctttgacttgcaattccatgagcagaagaaggaaggagaaagattcttttatgaggtttgtgatagtaagcatcttatcccttacctggctgttccctccaaccctcactccatacctaaagaccattgcattttctacttattcccatttgcttgtttggaacagacagacagtgaaatactagctatgcacctgcatcttcctgcctgccacagtcttttctttcataaactgacctaagcattcagggattgaggactggagaaggtgctgagagggagggtcatgaagcagggtttctccccatgcccttattccgctggaaacaatctcaagggcagctatgtcaagaatatgtagatatatacttctgtttaagattcctttacattgttccttcccgtgggaaagtttatgagatgtgcgtaatgctaggatgcatttcaaagtaaatatcccttttatttctaaacttatgtgactacaaatgtttcttttaagattggctccttcccatgtgattttgcttttaaccccaaggagatgtttttacacttctccaatgtctgtttctttttcagtattttgaaaaatgaacttgctatttagcattctgcaatggtgaagcactagaatatatgtgtgatgatgcaaaactttaaaaaaatgaacctttatgagctgtgccttcattgcaatctcagttttatttgtataaaataaggcctcattccctaaagtgtgttaatgctttatgtaaagtttgagggcattgatcttattttaaaattattctgctgaattaggtaagcacaaccaattaaggaatataatgtgagatttccttttcaattttactgatgttttatattcagacttgaagtccacttagcatttagaaaagtgatgaagaaattattgatttcatgtgggaaatattatctccttcctataaattttaaagcccacaaatcatttaagaataaagttatatttaaaatgtcatatttccataaatttatccttatgctacttatgctatttcattactattctgtgtttgaactctaatgtgaataacatattgttgaactgaatttaaccagataaatcagacctgtacttaaaggaaactggatgggccaagccacttgctaattaaaaatgttataaagtggcttgttcaccaatcaaaaatgaattccttatttcagatagaattgctggtttgaaatatacaggtttcacgctattcattttatttcaaatagatgactaaaccatagaactcctcctcttattgaagaacataatgaaaacagaaatactgagcttggtaccttcttcctttaaaactcttgcaatgtctacttgctaaactcctcagacacgatttaagaagaaagcgtaaataaatcagtgaaataaaatgaatgcctagcttctaacgatgtaatcttctcctttctttttctaaatattttttttcatttctttccttcctctctttacccttttctgtgattttctgtttctcctgttttctttttctcctctctatgcatagatcttttctcttactgtgttccattttcagctcaaagttttaggtagggccagtcagcatttgcatagagattgatgaaatgtcaggaggaagcaagacttgcattcaagtctgagtgcatcatgtgtcctcccagaaaatagaagcttaattgatacagaattatgatagaatttctgattactctggggtctcaaggcaacagaatttcaaaataataagcagagttcttccaatattgttgtataaacatggcagtatctaaatggtttccttaacttggggcttttataaagatgaaaaaggatttgattgaaaattatagaattcaccctttgatatgagaaaattacagaattcaccctttgatatgcaacacttgatacagacatgttcaggggcctttaaaagttatacaatgtgttctaattcaaattcccagttttttccttacagtggaactggttgtaaaacctttcactggtattataaccaattccactgtaaataagggaaatattccaggctagaccttattcttcatttaagagtttctttttatcttatcccccaccatctgtgctgatatatgtacttcttgctataaaaattaaatagcaaataattgcttgtgcacttgctcaaaatggtttttaatgctatgtgtttattagctggcttctaacaacagcattgctttcctctaatattatactatctgcaaagtgctggctgcttacaggcatgactgcgtgctactgcagctccctgctgctttaaccttatcaccatgtagttgaggcagctgttttttcttcacagaatcagcctcttttccccctggaaataaaaagagtgtttaaaaccctttttcagtggaaaaattcactctctgtatggagttcaaatggaagcattgcttaacaccatgatgatcgtgggattatgttgttgacaatggttccaaaaacagtcacttaagcaatcattgttagacagttgcatgcacaatatcctatgggccatgtcagcacatttactttctaatgccctatttagggaaaaaaaaagtcaaaagagaaaagcaaaccactaattttcttctcctctaaagtgattttccaacacacttctctgcatacaaatcaggggcatgttttggcataacatctctgattcctctagagaatatataaaaaaaaatctcacaaaccacgaagaaaaactaacctttaggaatggagtacagagtctgtttttttaaaaagcacctctggtgattttttatgtggatacagttttgggaatcactatactaaaacaagtaaaatagccaacccgtgttatagatgtactagagctacaagttaatttgcactacaatccccatataatattatctgtccctttataacacaataacaacaaaatgattatcagggtgccatgtaataattttcattcattggtgagtgattacgttaggttacattatgttaatagcttaattatttcatgaatataatttattatctatcaattgcaaataattacttagcttgtattcattttgtaacaaaaacacattgctgcagcccatgaaaaggacttatcattaatttgtaatctaatatatacaggtatatgaaaaaatccaaaatttaatttcttttcaggaagttataagatatgcattttgaaactctaaagaacttgtgttatgatcattgatttagaaggtgcattaatccttcacaatattttattggtgcaatcgttttaaatggtagaatccatagttatccataagcccactaactgttgatgttacttcaaattgtagttagctgttattaagacattcagggaaaaaggagggttcgtttgttcagctaaattattttcatctgttgaccacaggcagctccattaggtataatgataatgctatttgtattgttatgactcaaaaaaggattgactcttctgtgtcataccatggtggtaaaatttcccatgagagtaacttcacataagtccaggcagaatagagccaaggaatctggaccataaccccatcattttaaaaatatggatattgtaatggtcaactaaattatccttttatttcagagatgtatatctatgtcgcttttaatttttaatgacaaatttgatgtgtcaactagaaattgcatctgactgcccaaaagtgtgtgtatgtagctcattgaaattcattgtaatacctattagccacatggactaagtcattagctaagcaaccctagaccaggaaggaaaaacattaatcttcatcatttttcacttgccactagcctctcaactttaaacgtgctgaggcaacaggagatgaaagatcagagcttcaaaggaaataatactccatgccagtagttcttcttgaacttcagcacgcatcagaactacctgatgagtttatgaaaaacacacatcactgaactctacccccagtgtatttgattcagtacgtttggggcagggccaggtgatttgcatttctaacgaatctctgggtgacgctgatgctactggtctggggaccatgcattgagaattactgctatatgctttctgaaaaagaatcaggccaggtgtggtagctcgttcctgtaatcccagcactttgggaggccaaagtgggtggatcacctgaggtcaagagttcgagatcagcctaacatggcaaaatcctgtttctactaaaaataccaaaaattagccaggcatggtggtgggcgcctgtaatcccagctactcaggaggctgaagcgggagaatcacttgaaccctagaggcggaggttgcagtgagcagagatcgcaccacggcactccagcctggaaaacggagtgagatgctgtctcaaaaaaaaaaaaagtatcagataattagaaaataacacagaatacccgtttttcttatttgtacaccagtcctgaccagcctactttctgtgttttgaatcttaagaacacctgagattcaaggtgtttgtatggaaattggaacagcatgcaagagtgcaggcaagtatttgtattaaagaataggatagtcccaaaataaaggtagtcgatttgcaatcatatacaaaattcttgcagttttttaagattctggcctttatgcttgaattttatatgtaatcttataaaaaatggtgttatagttaacagaggccaaattttacattcaggtttctaatctgtctcaccttttcttcttaatatagaaatataagttactagttaataaattaataagaattaatctactgttctcatattttcaggaattacaaaatatagaataaattataaagtatatattagatagtaaaatagacaatttcaaattgtcacattatatctttcagttctaaaactgttttctaaaccaatttgaaaagttcttcgtatttagttagaatatccattgttgcctacttacatgtagtttatctgcaggtgggcagaaattggggtacaaaataaaaacattttttaatgcctggggtctcaaggagcttacaaggtgtaaggaacttggtaaaacataattagactagagatgccttttagcacttactgaaggatattcagaagccagctgttccacgtctttctccaccactgtaagcacctcttcctcttggggctgactgctgtatgaaaaaaaggtctgagcacactgaatatgatgacagaatttactccttcgctaattcattcaacaaatatttatttgctgagcacttgttatgagctgtaaattttactaggaactggagatacattaattactaagatgcagaccccaccctcaaagaacttagaagtttttaggggaatcagagcaattaaagagataaggtttgtgagagaaaaacaacaaggacactcctaaatgtgaagatatccttcagatgaaagttttaattgttataacttatcctgcaacaattcagaaataaactcaaacctcacctcttgttgtataaatagaggtaaaaagggaaatgtaatttggctgacgtcagtaaaagcaaccagttatagcttcatagccccagataataaggagaattgaatatttgaagtgctggccttttattgtggcaacatgcacagactgcctggtttctttctcctcctaatcatctctgcaattagatttaataaattgaacttaatggaaaattaagagaataataagggccaataaagcaaattatattaaagtgatttaataaatatgtttaataatttagcactactaccacataaagtttagctaactgctaagcttgtgaaattaagaaaaggtgctgctgaggaggttgaaaggttttttggttggcgagccatgtcaaaatgaaatacagacccaggcaggtgacgcttgttaacctcatttcccagagcatttaagagagctcacagggttactcatatactgccaagtctctttttaaactcacctctctctgaaccttaagaaaacttaaggagaaaggacacatgccccagcaaggaaggagagggagacggcttcactttaactgccatcttctataataaatctatttcattatcttgttgtgatcaccttcagttgctcatgcctgctttaacaaaccataaaccaatgccattactggtaaaatttaacttctttaacccagtcagttctcttgtttgccctactaagcagaatagtcctcagacaccctgagataatggctcacagagaacactctgtccccagcacttgatggtcaacaggtcctgaattcagttgactgggtggactatattcacatcgctgagcagtggtttataacacatgcaggaatgtgaagaaacagccaaatgggtcagacagagtaggtcaggggaaaagggcagaacaaaattctgaacataaagtgtctcgttgattctattcctaacttatccctacccagtccattttcacaattagccaatagatgcaacatgtaagccctaaattcctttcccattgttataaaacggggattcctgtttttttaatgaacattctcagaagagaatttcttcagaggaaatagcttctaagaatgcagctcttcagtccccatgtggctccaaaagcataacacattatctgtgctttggttttacccatttggaaacaacgaggaagttgaactatgtgatttcagaaattctttttttttctaaatttctgtcattataaggacaatccgcatgttagcaatccatgaagtagaggaatagtgtatgtgttgcaggtgagaagggaaaaaatgtataagagaaaagaatgtcacatcactcatataaagcctgaaggtgtaatttaaagaaaaacagttcatagaaacagaaaaagccaaaattccttatattcactaactcaaaactatattgagtgaattataaaaggtaaggcaatctttttttttccttcagttgtctagactgaagaacctcatttaacatatctcaaaggcattttgttgatttgaagcacagtgacagttggatttactgcatactctctttaattaggatgggagacagctattgatgttcaactttttgaaacccagaagttagaaacatgaatttatacaactgatacctctagcataacattcatgcaaatctgaataggataaagaaaatgccatagtctgtctgaaaattgtcgtgtaagttcttggagtttctccttaagaggcattttaaaacgaaacaaaaaacagggtagtatggttagagctgggcacatttgtttccggtagagaggaccgtgtattcttttacttctgacaacaaaccacagtattcatgctgacaccacaggcttatgaagtgatttagggcatttccaggaaagtaccctacttctagattcactagggaatttttgctgaattctcagtcatatattttaagttgaagtagaccctataagatgaaaagattccggtcaagtggaagatttgaaggaaaatgatgttttaaaaagaaaacataaaaaaagcaagagcccagataagattgtgagaagttgcttgaagcaattccctggtggaaagccagcttgaaggatgatacgccagtgtcatgatcatatttgggtttattacaccagttaggaggatgaaggggggaaacaggaaataggaacacaatgtgtagatgattacagtaggctagaggagaaaaattcagaatctggaagtgaagaggaaaaggcaggtggataaaacatttcagagatatcaccaatcatatttggtatggaagtaaatatggagggaagaaaacagaagtcaaagatgactttcacatttctgccttaaacaattgtaggccattaaccaaatcagaggaaataagaagataaataaattaagaatagtaataagttgtgctttgatatgctacagctgaagcatgtatgagccatcaaagtggaagtttactaggtacttggaaatatagacatgattctcaggcatgctgttaagaatgttgataatagatttggggcccttagcatatgggtgataattgaagccatgggcatgaatttaattgctcaaggggagtacagagtaaaaagaaaagaagactgaaaaaggagaattgaaggacactaatatttcagggatatacagaggaggaaagttaacagaagacagacaaatcacaggcagttagagaagcagggaaggaccttgggaaacagagcaaacaacagtatgaatgaaggctaagataaataaggtccttgaaattaagaaatcattggtgaccatatggaaacacgtcagtggcatatctgtaacagaagcaagccacattgcagagaactaatgaatgtttaggagaaaaggatgtggagtcaacaagtctgacactgttgtaagcagtctgaagatcaaaagaaggaaggatattggctagatgtcaatgagaatgtagttccaaataagtttggcttctctttcattgtctgttgtttattttaacataaatgttacttgagcatatttataggatggggtaataaaattaatggtagagggaatgaaaagggaaagagataattgatggaacaaaatccgaaagaaggaaccaagagtgcaagttaaacagcatttttcttggaaataaggctttttcatggaactagaggtgaaatttttatttattaatgttttaatgcaaaaatattggagagtatgaaacctaccagaataatgattaaattttggcccctggtgagatggccaggaagttaccttccttcctgatttgcacttctttacagaaaataaccgataacactgatgagctgaacacaggaaagatagctttgtagctcgtaggaaatgaaggaaatgagatagtaataaagactgtgaagaagaaataaaattcacactaaagatctttaatttcttccatgcaaagtctatttttcaagagtttatattgagctatctgaagagtttaaatgacttttaaatgactttgcaactcattgcttgtaactctagcaagagcttgagggtcagtttaacaattgctgctgtaagagaatatataacatgtattttctttagacctctagggaaataatcttttctggaaaacaaacaaacatgcagtgtgggtatggtaaccattcttctgaaccaaacaaatagcagggaaacacctgacatggtctggcaatgagatagatatttgaaatcaggattaacttgataactctggaatatatggtttctaaggaatgaaagatttcaagggcaaaatatcctattcatagttaatgcaaggtatcagtccaaggagatgaagatgatataggactgcttctgtgagggaatttttatgcttctgtctatcctcacttccttcctcaacatgtggtgaatgcccatgcatgcaggacactggaacagatacccaggatagaaaagtatgaacaagttctatggaagaggtagatttataagagagcatttagagagaacactgcatacacagttatagtaaagagcatagtcagtgtagaggctagatctactaactgcctagggctagctacacttgagcgaaaatttgcaaaaggagataagtgaattatcttttaaagaaaaaggaaaagtaagccttaaggaaaataacttaagatgaaggaaaataacttaaaagatgtctttctggccaggcgcggtggctcacgcctgtaatcccagcactttgggaggccaaggcaggtggatcacctgaggtcaggagttcaagaccagcctggtcaacatggtgaaaccccatctctactaaaaatacaaaaaaaaaaaaaaagctggacatggtggcaggtgcctgtaatcccagctactctggagggtgaggcaggagaattgcttgaacccaggaggtggaggttgcagtgagccaagatcgggccactgcactccagcctgggcaacagagcgagattctgtctcaaaaacaaaacaaaacaacaacaacaacaacaacaaaaagtcttgcctactagctggctctcccagacaagttatatctattaccacagctcaatggtataaaatacctcaatggtgtaaaactcagttaatacctatgtgggattatagtttattctgatcatctgaaccatactttggcagcctagattttgaaattcccaagcccttcgtagagtggggaattaaatctgtcttgaaaactttattttaaattcagaatttgactcaaaatccttaaattttcattgtgtatattcctcattacatagaaactttatttttttagccagccaaccaattaagttgttcatacacatgctaattgagtttctactttagaatacactgtgacttatgaatattcgaaatttttctgttctttccctcttaatttttgcttttaacaataactctaaataacaatacaaaaagattcaagataattttgatgttatactacttatataactaggataagctttaaacctttgaaaaaatattagattgccttttacctttacaaggtacccaataattttaaaaatatgctattgataattcaggcaatgagctctcagctcccaatctattatttcttaaaattttacaaaatttgtaggagtaagaaaaatgtcctcaatttggacacatagagtaatgcagaagaactcaaaaactggtagttttgctacctaaagagattgttttattattagatgagtatgataattatgtccattatgctcattattgaaaaagatctgcaatttgaagagccatgtacactggcctcagaattgctttgcctgttttaatggtatgattcagatcatgtaaacgttaaatacttaactgaaactaaaacttttccttttgtgggagggactggttacataacagagacattccgtctgcacctgcttagaaacatacctatgtatccagaaattaaaactgtcatccaatgttcaaatcgctgtagtctggcagttttaggttgtcaactaataattatttgatgagaaatatctattcaccaaatacctaaggtggactaaaataattctataagaaaatagcataattttgtgcaagtgacctatgtagccatttctgtatgaccttgaaggccttatctggtgataatcctacctcaatgtgaacaaattacctcagtgtgtatattaaactaatatggaaaccaaaacacattttaaataagaagcaacccccatttcctgaaggaaatactgctttcagagcgattcccttggaggtggtagaggtatgggtggggaactaccacccatgtgagcaggaagtggagagcctgaagaaagccacatggcagaacttatctctcattccctcttccccaacatttttatcaaatgaaatcaaggtaaaattgttattagcacaataacaagaaaatatcatttaaaaaaattcagcctgcatgattccttaggattggagtggaaaatccacatatgttttcttggttaggggttagggagttatagtttgttaggcaaattgtgattaaattcattatccatattttaagtctttttaaaataagtatgtactatctaattgtctttctgaattacttccctgcaactggttttagctgaatagaactctagaaagtatgaagctcacagatatgttaattttctcactcttatagaagtctctatctgttatgatatgttaattttctcactcttatagaagtctctatctgttatggtagcctgtgtgtctggacaagagctgtcaccataactgattactgagacagaagaaaaaagatacaaggaatccagaaaaatcacattgcctctgatagagggcagaagctaaccaatcctgaaagttaggcggacttgagttaaaactgatataaaggattggtttgatataattaataaagtctcaaatgccaaatgcaatatttgattttcattccaatgtttttagtcacatcaggacaacttagagctacccagctgcagagatatgtaaataattcttcttcctaacagttccttagtatcagaaaatagtcttggaggattataggacttatgtccaatgcaccctcatagggatacttcttggttctgtatcggctcccaggagtttaaactgatattaggtcctatatttagttggcattcttagattctcttacttatactaagtcatgctttaatttgttttactccccaaacttggctttatcctgtcctcttcttttcaatagtagatcagcttgggcaagaactaatgatattaatggtaggaaactaaatttctaaaggtagaaagaaagagtcacgttccaatttcagagaatatttcagattgctatttacgtgaatttctctctgcttgatacaatagacctattatcctgaactttcagctgtaaattagcaaccaggaagaaaagtcaggactatcgtctccagaaaaacatgggcgtgcttggataccttgtctatcctattactcttaattccaaagttggggaaatatgaaaacacctttaaataatgcacaacacaatattcaaaagttaatttttaacaacttttattcttaatgtgcctatttatttacagggatattaaagatttaaataaattttgaagcaacacatatattcagctgaagtataacaggttttctaaattacggaattatcatgttctggaggatatttttgtcatgccttgcatctcattgctataaccaacaaaggctttgttatctagctgttacttgtatgcatgccctgcatttcaaacaattttttgtatatgagaaccccttggtttctttaaagtttcctaaatgtttagatttgatttcaaagaccaaaaaaaaaaaaaaagaagagaaaaaagcttacatgttgtttgaagttaccatataataatcaaaatgcttgtaagcaaaacagaggcatgctttctcaaaactccaaagtaatattgtttatggtctctctgcagctagattctgaagctagtactattctaaaagaacttcaggttaagctcagtggggtcctggatgagctcagcgtcacttatggtgaaaggtaagtggcctctgttgtcattatctaaattagataattaggtgtcagttcatgatattcttgccttcaatgctgtttcctctgactgactaaatctacttaacttcaagacccaatctaaatgtcattttctctgaaacatctgttatgaccccacaatctaatagtgctatcttgctatgcactccctagaactctgtgcatccttcggtcggataacacctataacactatcctcagagttttgttttacctgtctatttcccacactcaggacagaaaccatatctcacacctatatgcagttctagtgtttagagctgggtgactggctattgaaagactaaagacagggagggaagaaaagagaaaaacttcacatatataagaagtatgagttgtattcataccatgcatatcagtgtggttgccgtcagtatagctggatcaacaaccctataccaaattgtcaggattcttggttttagggcctagcaatctgaatacaactaccccatgggaaggagtttggaaactattgatatatctatatattttaaatgtttgttaaaactggctttatctgtgatatgaatctaaagaaagataagttcaccctagttaaatttcacttcagttctgtaggaaaaatctatcacctcatcaaaatgttaaaatagctaggaaagaaaatatatttttgaagaggttcattaatatagaatttgctttaaatattagttaaataactgatgtattattttaaactatgtgttcaattttcaaaagagactataaagattgctcttcagggccgggtacggtggcttatgcctgtaatcccagcactttgggaggctgaggcaggtggatcacgaggtcaggagatcgagaccatcctggctaatacagtgaaaccccgtctctactaaaagtataaaacaaacaaacaaaaaagtagccgggcgtggtgacgggcacctgtagtcccagttactcaggaggctgaggcaggagaatggcgtgaaccctggaggtggagcttgcagtgagccgagatcgcaccactgcactccagcctgggcaacagagactccgtctagaaaaaaaaaaaaaaaaaaaaaaaagattgctctcttcaggtagggactatctctggccaccactcatcacctgttgttgtgttttagaaagatccactattaataaacatttatcaattagttatgccattttttaaataagaaagacaaaagactctgaaagcatcatatttttcttcttagatgtaggaataaagcagagtgaagaataatctcccacttagccttctcttcattatcagaggtgtgtctgtaacttccttaagcaaggtggccttgtcttcatggaactcaccttcagggctcagctgctgagccagagcagccttgctgtgttgagccaagggtagtcattctgcctctgcagtgttgttagctgattggatgatcctgcctacttcaccgggatgttagtcagcaatttcaaggttctgtttacctgaagttggagaaacatagattgttccagagatgtagggttcattggctctgacttggggtgacactgagagatgaagaggcctttgctgagccatttcaggtgtgtctctctttgttctagttgcaaattaacatggggttagcagaaagactgttgccttcagtcacagaggcaacattagagactatttagcaaagttagggggaggaaaaaaaagaggtcaggaatagctagagttgttcagaactttatggaaaataagatgactaaacagagtagaaactagaatataagtaaagtatatttaaattattttctgtaaaatatctaaatcattctgatgataagtgctttttgttttgtttggggaggtggaatattcaggttataaaggctagaatatgttttctgattcgaaagatatctggataaaccacagttatgaaagaaggagtagtatccttaggaggacacttgaagagctttatttgtatgaagccagctattttagcctaaacagtaaaacctgcggctacccagaatccatttattattgattttttaaatataggaaagaatttagtactctgttcaattagggtttattaggactattggaataaatgggctacatgtcatgctttcctaataaaaaatataattattatatccttgttgctatgttgctgtggctttattcctcacactaccaatcaggtctatattatactgtcagggtagaaaagtctacagtaatcaatgtgatcatgctgtgaagtcacaatgcacaattttagtctgaacctactcttcttaaggtctaaattggcagtgtagagttttagaattaagtgcataattaattgtaaaaaatccacttgattttatgttattaaaactcataattaaataattctactatatgcagctgttaggatgtctttgctgtaaagtcagagctgagccaaaccacacatttgtggaatcctgacatgctcacagggcacctacctgggaactgagactaagtgatataacctcaacaataacttgaagatggtcttaaaactttcaaaaggtgtgccactagggtttctgcttacacatgttttgcagtttggtttttggtttgctcctttttttttttttttcttattaaccaacacctttagtactagaggctggctagattaagtaaacaaaaaaattcaggaatatttcgtaggcattattttgtgagtgtgtggctccttgggtgctccgaaaatctttaattatttactggcactacttttattcaaaccagttaatacaggctttttttaaaccttttctttttctatttttctttttctagtctattctttttctattttttcacgtaataggagcataaataaatttcacataataggaacataactgtcacaccccttgtccagtctgtccccccaccccaatgctctaatttgaaaattagtgcaaaagaaaatcagtgcaaaatcagtctatctccccaccccaatgcactgattcgaaaatcagtgcaaaagaaagtagtcatttcaaaggtgattttgactacagccagcaggatcatggatgaccccgtggtaaatcaactagttcaaaatattttcagcatgatttgccttcctcttctattgccccaagtatctactacctttactttgattcaatacacactccaccacaaacaacatccccttcatcattttccccaccatctcttgcaacctctacctgacaaaagtgcaaaggcagcttcagccagataaaagtgaaataatcaaggatttagactctcttggatgacagcttggaagagaatgttcctttaaagcagataaatatgcagagagccaagaaatgagacaaattcaaaggggccagctgagatgcaaggatcaaggaaccaaatgtaaatgccaagcccagaggggcaagaatggtgttgtcaacagtaaagaaatccaagaattcaggagccaaaaatggagacagatcaaacctgatggtagaagtggaatcaggccttaaatatgtacacaaaattatgaacaagtgtatgtataaccctgctattaaaggcccagaagcaagaaaaacatccaagttgtgataatttaacatttattaaaatttttccatattaagcatggaaatatgtatatggaaaaccaaatatggaaaaccaaaaactagaaaaatgaaatacttaacaagatgtcaactaaaatatttccataatgtaaatgctaaaatacaagttctcatatttgctctaagaacaaaacactgtgcctgttctgttcattgatatatcttcagcacctagaacagtgattggcacataatagtttagtaaatatgtggagaatgtatgcatgaataaataaatgtgtatactttatttaataaaagcattatatagtgaacattcctaaacttctacttaaaatctgaggaatttatgcacttagatacttctcaaatactaactgtatcatcattgtgtgtggaggaggagaggagtgggaatgacttgactgcaatactaaaatgaattccctccttctcctcattaccattccaatcatttgaccattttccaagctttcattgatcttcattctcctaagtagtttttcttgcctgcccacacatttgttattattactcctattgctggaaacatgagaatagcagacaatatagaggaatggtggtgatgctaacagtctccaagatttgaatatcttactacttgccatgcttacttaggtaagaaccatcaaaactggtgtaggggatatacagaatgaaaaaagcaatacgaaatattgctcttcgtgacatttaaatccttagagtgggtgaggcaatagaggtaggtggaaggagatggtccattgatgcattcaacacatatttcctttttaatagctttattgagctataattaccatgtaaaaattatgtatatttaaggtatacaactttgttttgatatacatatccattataaaatgatggccacattccagataattgacgtatctatcaccttcatggagttgccatttgtgtgtttgtctgtgtgcatgtgtgtgtactgagaacattaagatctgtcctcttagcaaatttcaagtatataatgcagcagttttaactactgtcccaatatttcctgcataacctctttgtgccaagcatggcatcctgtgccatggtatgggcatgcagcactaaacaaaacaaaattcctgctctcatggggcttacattatagggagggaaacaggcaataagcaaataaattaaattatgcagtgcgtcatataatgaagaatgccattgagaaaaaaagaacaataagggaacagagatggataggaatgccatttcagcttgagtgaacaaggaagatttctctgaagtgatatttgatatatgcctgaaattaacgagggaccaagagagccatgagaatttccttccatggcagagggaatataacagtggccatgagataagagtgtcctcagagaattctaagaacaccaggaggtctattgtggctggtgcaatgaaacagaaggaagagtggcaagaaatgagatcagtgagattgccagcgccagattatgctgggctttcagtctgtcaaatacaactagagttttttctaagtggagttggaagctattgaagatttttagcaaaggaggaacatgatctggtttttattttaaaaggctatctgtagagggttgaacagaagcaatttaggaaattattgcacaggttcaagtgggaggatggtaaaggggtctatagtggcattttcggaagtaataataaatcctcagatttaggatacatttcgctgacaggttggatgttgagtatgagaaactcatcagactttgaagtggaaagattgcatgggcagttaaataaaatagtctggagtttgggttagaagtcaggtctgcagatgtgaatttgagaaccaccagtatatagatgctatggaagccatgggactagatgtgattgccaagaaagtgactgctgatggagaagtgaagtggtccaaggatgaagcccagaggatcacagtgtaggatttccaaacaaaatacagaacaccctcagttaaacttgaattttagatacataaggaataatttttagtataattgtgttacagatattacatggccatgtttgtactaaaactattcactgtctgaaattcaaatttaactcagtgtccagtgctttcatttgataaatatggcaaccttactccaatggttagaggtcaggcagttgagaaggagcagcctgtgaggtcagaggaaagccgagaaggtgtggagtcacagaatccaaatgaagaaggtgtatccagatgccaagagtgtttctttttttttttttaacaacaaattttattgaaatataattcacataccataaaattctcccatttcaaatacgcaggtgagtggtttctagcatattcacggaattgtgcaactctcagcaaaatctaactttagaacactgatatcaccacaaaaaagaaaccctatacccattagcaataagtcccattccactctcctttccagccctaggaaaccactaatctcctttctgtctctatggatttgcttattctggatattttatataaattgagtcatacaatatgtggtcttttgtgactggcttctttacttaacacaatgcttttaagcatatggttgatttatatggtggcagtggcagtacttcatttttcttgtaaatttatgttatgttcaggggtatatgtgcaggtttgttacataggtaaacttgtgtcacaggggtttgttatacacattataatacatcatccaggtattaagcctactacccattagttgtttttcctgatcctctccctcttcccaccctctgccctccaatagaccccactgtgagttgttcccctccacgtgtccatgcgttctcatcatttagctccattgtggaagacagtgtggcaattcctcaaagacctaaagacagaaataccatttgacccaggaatcccattactgggtatatactcaaaggaatataaatcattctaccataaagacacatgcatgcatatgctcattgcaacactattcacaatagcaaagtaaggcatcaacctaaatgcccatcaaccctagactggataaagaaactatggtacatatacaccatgaaatactattcagccaaaaaaaggaacaacatcatgtcctttgcagggacatggatggagttggaggccgttatcattagcaaactaacacatgaacagaaaaccaaatactgcaagagtctttttagagcagtcattttcccaaaccgtgctcagaggaacatctcaactgtgactatcagaggtggggactgaatgaacctccactcaaattaattcaacctgaagaacagcacttttatctgccttacttataagtattacacgtaagctttcattggaacaaaaatttttgcagttaaacattgaattcgaaaactcatgagcaggggaattcacaccagttgaaacagatcaaaatcctcagggtgaaattggaacaggctcaggcaaaatgtattcttatattttagaatttatattctttatttttagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacgtaagtttttttgcccagttttctctttacttattgccctaaatttgacctttaaggctttaagaaaaacattgttttcctctgtgtaaggtagcattaaaagtctttctatagaaataaatgaattcaaagataaataaataaattcattaaaaagcaacatacctttaattgattactagataaaaataaattaggaatgactttgtacaagaaaggaaagaaagaggggaaataaattttataactaaggaggttgctgttctgaggcagagaaagatttagaacttcatgttccttggataccatattgttttcaatcctcctggacatagagaaagactgagctgagtccagaatagctgatttcatgtcagaaacctgatgaaaaagagaatagcacaaatatgactagaattaacttagctcagaggcaagcagatagctgcctgacccaaccttcaataacgatttattgagtgctcacctgtatcaaaccatattttacacactggacagtgaagaaaaagaaagccgaagtccctgataccatggagattacagtttaatagtggtgggagtgcatgggaatgcaggccattatgactgactaagacaaattcttaacctgaaagtttggttggttgctctgtttgtttttaaggtttttgttctgttcctactcttagaagttctaatttagtaagtttgaggcagggtcagagcacctacaatttgtaatgtgtccacagttgggattgggaatcattgatctaaagcaaccagaaacatgatttcgtaaacagtgatactcaaaaccagaactgaatgtacaagagaaaagtgaataataattttgaatgcctaccaagggaccagtgtcatatatgttagtttacataatctcatttattattgttgtggcaaactaatatcaaaaggaccaagatttaaataaaagaaaaattacaatgtctttccttaaagacaaggacaacagtcaccccactgtgctgctgctgccaccagcacacgtaaacaccactgcatcgctgccaccagccattgccccagcaaagtgctttggccagcactctccatcagactgttgttaccagaagaccaggaacaccttcgcccctccagtgcagcaggtgcttgtccttgaggagacagaaaacaaagtaatgggcctggtaccaggccccagggttaggacatgcaatccaggaatgccaagttaagccttggccccctgaaatcttccagaaatgaagccagttgactttgactgaacccaatatataccacagtcaaatcctcaaagcctcaaaggcatgaaagaatataaaagcaaaaaaacactattcgaacaacagcaacttaaaagattaaaggaacattagcccatgcagatgagaaagaaccagcatgagaactctggcaactcaaaaagccagagtgtcttactacctccaaacaaccacactagctacccagcaatagttcttaaccaggcagatgtggctgaaatgacagataaagaatttggcatctggataggaaaaaagatgaaaattcaggagaaagtcaaaagccaatccaaggaacccaaggaatctaatgatacaagggctaaaagacaaaatagccattttaagaaagaatcaaagtggtctgatggagctgcaaaactcactataagaatttcctaatataatcagcagtcttagtatccaagctaagttttataagcataggagaaattatatccttttcagacaagcaaatgctaaggaaatttgttaccctagacctgcctctcaagatgtccctaagggagtgctaaacatgaaaatgaaagatcaatacctgccaacacaaaaatacgcttaagtatatcaactataggcactataaagtaactacacaatcaagtctgcataacaaccagctaaagacgcaacaacaggataaaatcgcacatatcaatatcaaccttgaatataaatggactaaatgtcccacttaaaaggcaggaagctgtctttaagagactcatctcacatgcaatgacacccatagtctcaaagtaaagggatggagaaaaatctacctaaaaaatggaaaacaaaaaagagcaggggttgctattgtaacttcagacaaaataggcttttaacaaacaatgatccaaaaaaacccaatatcattatataatgataaagggttcaattcaacaagacttagctatcctacacatatatccacctaacactggagtatctggatttataaagcaatttcttagagacctatgaaaagacatagataaatacacaataatatcaccatcccactgagacagatcactgaggcagaaaactaacaaagatattcaggacctaaactctacacttgaccaaaaggatctaacagacatctacaggatactcaacccaacaaaaacagaatatacattctcctcatctgcacttggcacacactctaaaatcaatcacacaatcagccacaaaacaattgtcaatgaattcaaaaaatttgaaatcataccaaccatactctcaaacaacagtacaataaaattagaaattaatactaagatgatctctcaaaactatacaattacatggaaattaagcattctgctcctgaatgacttttgacaatgaatttaagacagaaatcaagtaatcctttgaaaattgtaaaagaaaaggtataacataccagaatctctgggacatagctaaagcagtgttaagaaaaaagtatatagtgctcaacatccagatcaaaaagttagaaattatcaatttaacaacctagaaaagctaggaaaacaagagtaaatcataaaccaaccgaaaagccagcagaagaaaaatcaccagaatcagttgaactgaatcaaattgagagatgagaaaccatacaaaagatcagtgaaacagagtttgttttttgaaagcataaataagattggtagaccactagctagactaataagggaaaaagtgagaagattcaaataaacacaatcagaaatgacaaagtgagcattaccaccgaccccacagaaatccagataaccctcagagactattacagagacctctatgcacacaaactggaaaacctaaaagaaatgaataaattcccagaaacatacaaactaccaagattgaaccaggaagaaattgaaaccctgaacagaccaataatgagttctgaaatggaatcagtaataataaaagcctaccaaccagaaaaggccctggagcagatggattcacagccaaattttatgagatgcgtaaaaaagagctagtaccaatcctattgaaactattccaaaaattgaggaggaggtactactccacaactcattcaatgaggccagcatcattctgatactaaaagctggcaaagacacaacaaaaaaggaaaacttcaggtcaatatcttgatgaacatagatgcaaaaaccctcaacaaaatactaacagatcaaaccaagcagcatatcaaaaagctatctcaggattatcatgtaggatttattcctaggatgcaaggtggtttaacagatgcaaatcaataaatgtgattcaccatataaacagaactaaatacaaaacccacatgatcatctcaatagatgcagaaaaggctttcaataaaattcaacatcgcctcatgttaaaaaccctcaacaaactaggcattaagggaacacacttcaaaataataagaaccatctatgacaaacccacaaccaacatcatactgaatgggcaaaagctggaagcattccccttgagaaccagaacaagacaaggatgctcactctcactactcctattcaacatagtactagaagtcctaaccaaagcaatcaggcaagagaaataaataaaaggcatccaaataggaagagagaaagtcaatctctgttcacatatgatgtgatcgtatacatacaaaaccctatagtctctgcccaaaagattctagatctgataaacaactttagcaaagtttcaggatacaaaattaatatacaaaaatcagtagtatttctatgcaccaacagcatccaaactgagagccaaatcgagaacacagttccattcacaatagccacatacacacatacaagaaaatccctagaaatacagctaatgagagaggtgaaagatctctagaacaagaattacaaaatattgctgaaagaaatcagagatgacacaaacaaatggaaaaatattccatgctcatggataggaagactcaatattgttaaaatggctatactaccaaagcaacttacagtttgaatcctattcctatcaaactaccagcaatatttttcacagaattagaaaaaaaaaatttcaaaattcatttagaaccaaaaaagagtctgaatagtcaaagtaatcctaagcaaaaagaacaaagccagaggcctcacaggacctgacttcaaactataccataaagctacagtaatcaaaacagcatggtactggtacaaaaacagacacatagaccaatgaaacagattagagaacccagaaataaagccacacacctacaaccatctgatcttcaacaaagtcaacaaaaacaagcaggaagggaaagaacttcctagtcaacaaatggtgttgttagaataactggctagccatatgcagaagattaaaactggaccctttcctttcactgtatacaaaaatcaactcaagatggattaaagatttaaatgtaaaacctaaaactataaaaccctagaagaaacctaggaaaaaccattctggacataggccctggcagtttttatgatgaagattccaaaagcaattgcaacaaaaactaaaaacaaaaaataggactaattaaagagcttctacagagcaaaagaaactattgtcagagtaaacagacatcttacagaataggagaaaatatttgcaaactatgtatctgacaatggtctaatatccagactctataaggagcttaaatacattaacaagcaaaaaaaaaaaaaaaaaaaaaaaaaaaaaaacccattaaaaatgagcaaagcatatgagtagacacttctcaaaagaagacatacaagcagctaacaagcataaagaaaaatgctgaacgtcactaatcattgaagaaatgaaaatcaaagccacaatgagataccatctcacaccaatcaggatgactattagtaaaaagttaaaaaataacagatcctgatgaggttgtgtagaaaagggaatgcttatacactgctggtaggaatgtaagttaattcatccactgtggaaaacagcttggagagttctcaactaacttaaaacagaacctccattcaacccagcaattccattactgggcatatatccaaagaatataaattgttctaccgtaaagacacatgcatgcgtatgttcattgcagcactgttcacaatagcaaagacaaggaatcaacctaaatagcccatcaatggtagactggataaagaaaatgtggtacatatacatcatggaatactacacagccataaaaatgaatgagatcatgacctctgcggcaacatggatggaactggaggccattatcctttgtgaactaacacgggaacaggaaaccaaatactgcatgttctcacttataagtgagagctaaacactgagtacaaataggcacaaagaagggaacaatagacactagagcctacttaagagtggagggcgggaggagggtgagaatcaaaaactacgtattgggtactatacttgttacctgggtgacaaaataatctgtacaccaaacacccacagcatgcaattttcccatgtaacaaatttgcacacgtgccttctgaatttaaataagagttggaaaggaaaaaaaagttggatattcttccaggtaattaaacttatttagtgcatttctttttctttccatctaaattttcccacagtcataattataaaatatttaaataggtaaggataaaaaagaaataactcataggaaaatatcttctgtatactatgacttctgttttaattccatttacctttggttgccttcttactacataagtctaatgttgttatttatttaatgtcaatatttggtaggaaaattaagccttatgttttgttctctgtggggaaatatctagaagataggtatataggtaagtagataataggatgtaggtagggaagtaggtgcagaagaaaagcagaagaaaggagagaggaaagggaagaagtaaagaaagagagaaggagaattacttttcctcatttctttagttagttaatgtagactttcacttttacaacataattttctatacattctctggacatttttatcttagtatacgactcttttctatggacaacacagaaatggatcactataaacaccccaacattggttgtgaatgtgatggtgatgaatagcaggcccaagcgatcccaattcacttcaacctctcactggaatgccttctgttttttagaagtccaatcagtagtttggagaagtattatttattattagcaaaactatttgctttctatgtcctgtggccaaggttgtggaacataacagaaagttttaagtaatcttggtacttccaactattagctgagtgactttgaatccatttcaccatctataaaacggggctaatagataaaatgggttgactcttattttcagtacattttgattcttatttttactcagtcttactaaagtataattagaaaattatgtcaccatatgtgtcatatcttttaattattggtggaaagagataacgtataaagttaggaaataatctatgagctttaagcatttgtaaaagacatttaaaacttttgaaagaaatatgtcatggagaattgcagaaatcctcagggctaattcagaatgcataacttaaaagccactgcataggggagatgcttaaaagccagatattgattctgttttcaaggagctaatagtttaggaggagaaataagaaaggaatacaaataaacgtaagatgtaaagtgataatgagtacaatatttatttctacttcaaagaatgaataaaaatttgatttggattgggtatttaaaggtggataaagtttagatatatgaaaatgagggacaggcattccaaggggagggaaaacaactaggtaaattttcatgaaaatgcgattaattatatgacaggaaatctttattgccaaccaatacacatggcatttgaaaattgtctgattaattagttttgtattcagccaatctagatagctcaggttctaaaatatatgcttttcagcttacattatcaagttgattaattcagactgaattaaagaggcatttgctagtttgccattattttctattatttaaaataaacaatagaggtttgaaagtcttcaaggtggtttgagaaaattcccttagaaatcatgttatattgcgaatgtataagctctttttgtctttgtgcagcctctctaaataaaacatcttccttctttatgttgcactttctccactaagaccttaccccttcacaaattgaggtgtaaactgcatttttaactaaaagaaatcctacgagctgcgcacgtgacaatgattttattcctatttttttagttccggtctaagcagggttagtcagcatgccaagtatgtgagctgaccgtaaacacaagattaattcttagacttggatctttggaaagtggaaattgtacatctgcagcaaaattggcagagttgttgtgtctccaatcataccaggaatttttctgtggatagcctttgttattctgccatgacacatctgctgttttgtaccctatgtccatgccaaatactcaccagcaagctaaaaatggtacccctgaaaaacagttttcaaattacaggagccggagttccacatacatgcctcaggggtccccaaccttcctctttatccagagaaggttgctttcacatatttttatatattgggcttttacatacacagtgttaggataaatactttaacataaaaatgtgtcttgaaaatctctgtatatgcctctcacatgtcacatgcctttcaatgttatccactgtaattatataaatacaattatgtatatctttaaatattaaaaacagccaaatgtgtctgtcatgactagagcccaggttataatttccgagtccaaaagcatacagagtagcattatagggagtcaatgaggctgccctgaaatatatgacccatctttggctctctgtgaaacaggtttaattcacttagagactcaaagaggccagggtcatatgatagtatatttaatagatacttaggcagcactgtgtcttcaaataggctggaacatcctgcataagcacattcatcagaggtagtatgggacattggaagacaggctggatttagaagagtcaaactttgaatctaacttactagcttcacttccgtggacaagtacccaagcctctgtgcctgtttttgagttgtaatatgggtatactagtaaatgagaaatatatacagaagaagtttctaaagaatagcttgtataggtattatacaaatgctagataatgttacatcattatgtcaccatgagaagaatttgtaaggaataccttacacctattaaaataggtaaatttttattcttgattgaaattatatacacctttgccatgttgttatgttggtccagtgcccagtagtgctgaaaatgtatttccttggtgttcctagaccatgaacattggcgtatactaaatacacatcggggtgagggtgaaaatcgtgtgctttgggagactgactccactgtggagaatggtctgccttctgctgctgtaacatgggtgaaaaatatgggttccgttgtccttttctcaactgtcatgccaaacctaggtgaccgatatcagaaattgctctaggtttaataagtcttaaatatgaataaaaagggatcatttgcctttaaagatattttactttgtgtgctttaaaagttatttttcattgttttcaaagaacttatttatttctgccttgatttcgttatttacccaggagtcatttaggagcaggttgttcagcttccatgtagtcatgcggttttgagtgagtttcttaatcctgagttctaatttgattgcactgtggtctgagagactctttgttatgatttctgttcttttgcacttgctgaggagtgttttacttccaattatgtggtcaattttagaataagtgcaatgtggtgctgagaagaatgtatattctgttgatatgtggtggagagttctgtagaagtctattaggtccacttggtccagagctgagttcaagtccggaatatccttgttaattttctgtctcattgatctgtctaatattgacagtagggtgttaaagtctcccactattattgtatgggagactaagtctctttgtaggtctctaagaacttgctttatgaatctgggtgctcctgtattgcgtgcatatatatttatattagttagctcttcttgttgcattgatccctttaccattttgtaatccccttctttgtctttttcgatctttgttggtttaaagtctgttttatcagagactaggtttgcaacccttgctttttttgcttttgatgtgcttggttaatattcctccattcctttattttgagcctatgtgtgtcttagcacatgagatgggtctcctgaatacagcacactgatgggtcttgactctttatccagtttaccagtctgtgtcttttaattggggtatttagtccatttacatttaagattaatattgttatgtgtgaatttggtcctgtcgctatgatgctacctggttattttgcccattagttgatgcagtttcttcatagtgtcaatggtctttagaatttggcatgtttttgcagtggctgataccaggttttcctttccacatttactggttcctttgggagctcttgtaaggcagacctggtggtgacaaaatatctcagcatttgcttgtctgtaaaggattttatgtctccttcactaacgaagacacaacataccagaatctctgggacacagctaaagcagtgttgagagggaaatttatagcactaaatgcccacaggaaaaagagggaaagatctaaaatcaacacactaacatcaaaattaaaagaactagagaagcaagaaaaacaaattcaaaagctaggagaaaagaagtaactaagatcagagcagaactgaaggagatagagaaatgaaaaacccttcaaaaaatcagtgaatctaggagctggttttttgaaaagattaataaaaattgatagactactagcaagactaataaagaaaaaaagagagaagaatcaaatagatacaataaaaaatgataaaggtgatatcaccactgatcccacagaaatacaaactaccttctgagaatactataaacacctgtatgcaaataaactagaaaatctagaacaaatggataaattcctggacacatataccctccccagacaaacccaggaagaagtcaaatccctgaatagaccaataacaagttctgaaactgaggcagtaattaataatgtaccaaccaaaaaaagcccaggaccagatagattcacagccgaattctaccagaggtacaaagaggagctgatactattccttctgaaactattccaaacaatagaaaaagagggactcatccttaactgattttatgaagccagcatcatcctgataacaaaacctggcagagatacaacaaaaaaagagaatttcaggccaatatccctgatgaacatcgatgcaaaaatcctcaataaaatactggaaaaccaaatccagcagcacatcaaaaagcttatctaccatgatcaaatcggattcaccccaggatccaaggctggttcaacatacacaaatcagtaaatgtaatccatcacataaacagaaccagcaacttaaaacacatgattatctcaatggatgcagaaaaggcctttgataaaattcaacagcccttgatgctaaaaaaactctcaataaaataggtattgatggaacgtatctcaaaataataagagctatttatgacaaacccacagccaatatcatactgaatgggcaaaagctggaagcattcccttcgaaaaccagcacaagacaaggatgccctctctcaccactcctgtttaacatagtattggaagttctggccagggcaatgaggcaagagaaagaaataaaggatattcaaataggaaaagaggaagtcaaattgtctctgtttgcagatgacatgattgtatatttggaaaaccccatcgcctcagcccaaaatctcctgaagctgataagaaccttaagcaaagtctcaggatacaaaatcaatgtgcaaaaatcactagcattcctatacaccaataatagaaaaacagagagccaaatcatgagtgaactcccattcacaattgctacaaagagaataaaataccaaggaatacaacttacaagggaagtgaaggacctctccaaggagaactacaaaccactactcaaggaaataagagaggacacaaacaaatggaaataaatttcatgttcatggataggaagaatcaatattgtgaaaatggccatactgcccaaagtaatttatcaattcaatgctatccccatcaagctaccattaactttcttcacataattggaaaaaactactttaactttcatatggaatcaaaaaagagcctgtatagccaagacaatcctaagcaaaaagaacacagctggaggcatcatgctacctgacttcaaactaaactgcaaggctacagtaaccaaaacagcatggtactggtaccagaacagatatatagaccaatggaacagaacagtggactcagaaataacaccacacatccacaaccacctgatattgaacaaacctgacaaaaacaagcaatggggaaacgattccctatttaacaaatgatgttgggaaaactggctagccatatgcagaaaactgaaagtggaccccttccttacaccttatacaaaaattaactcaaggtggactaaagacttaaacctaagacctaaaaccataacatccctagaagaaaacctaggcaataccatttaggacatagacatgggcaaaaacttcatgactaaaacaccaaaaccaatggcaacaaaagccgaaactgacaaatgggatctaattaaactaaagagcttctgcacagcaaaagaaaccatcatcagagtgaacaggcaatctacagaatgggagaaaatgtttgcaatatatccatctgggctaatatcctacaaggaacttaaatcttagtctacttaatctataaggaacttaaacaaatttacaagaaaaaaatatcaaaaagtggacaaggatatgaacagacacttctcaaaagaagacatttatgcggctaacaaacatgaaaaaaagctcattattactggtcattattactggtcatttgcattagaaatgcaaatcaaaaccacagtgagataccatctcacgccagttagagtgatcactaaaaagtcaggaaatcacggatgctggagagaatgtggagaaataggaacacttttaaactgttggtgggagtgtaaattagttcgaccattttgaaagacagtgtggcgattcctcaaggatctagaactagaaataccatttgacccagcaatcccattactgactatatacccaaaggattataaatcattcttctgtaaagacacatgcacacataagtttattgcagcactattgacaatatcaaaacttggaaccaacccaaatgtccatcaatgatagactggataaagaaaatgtggcacatatacaccatggaataccatgcagccatgaaaagggatgagttcatgtcctttgcagggacatggatgaagctggaaaccatcattctcagcaaactaacacaggaacagaaaatgaaacaccgcatgttctcactcataagtgggagttgaacaatgagaacacgtggacacagggaggggaacatcacacaccagggcctgtcgccgggtggagggctgggtgagggatagcattaggagaaatacctaatgtagatgtcggcttgatgggtgcatcaaaccaccatggcatgtgtatacctatgtaacaaacctgcacattctgcacacgtatcccaaaacttaaagtataatgggaaaaaagttatttatctttccaaagcctgttgatttagaaaacaacgtaagaaaagaagtatgctgatttcattttccatcaaatatagagaattatctaatgtacagaatcatgaaatagttttttgagattatacattttgtataataatttagtaaatggaatttagcatttgaaaatcgtaaaggcctaaattgataccttgatctgaaatttaaaagtgaatatatatatatatttttttttcagattaagtctctcagcaaaaatctgtgagaaaacagtcctaaagcgagttttaaaagagttatggaagctagttctcaacaaaatagaaaaacaaattgttcttcctcctctgacagatcaaacagtaagtatataaagtttagttatgctttcattaacccatctgtttttggtttaagtgaatggttttcatccagatgaaatactaattaaatccctttggggaaaaagtgtttggtatccagtttcttaacaatgatcattcaaatgatagtttcctatccaagtcaattttaaataatggcaatagcagtcagacttcacgttgcttgacagtcagaacttaacctcttaaaacatgtatcaaagttctatttatagtgttatctggtttacacatacaatttttatttaattttaccgacctcaagaaaatagaattaagatacaatgtatccctgtgcttctttcttaaattttacagtttaaggagatagttacaccactgctatttggatttttttttcacctttctattatgctttcatctcttacctccccacttggaagttaatagaggaggcatcttttagtgaatctgaaaaatgtgattgtatcacacaaagaaaaaggaaaagaaccagaaagatcaattggctgcaaaattagacactggtcaagtggatacacagagccaggtatctctgttcacatatcctgagccaaacaagggaaaaataacactaacaagcacctgttacggggcaatgtatttttttctccgtgactgaggaagataaattgatgcaaataatgagtaagtataaatggaaataaaatatgcattattatacattagttatacacactcagtccatgtttattcagtgaaagcatatgcctagaaaacactttcttataaagtgttccgagatgcaaatatgcctgtgtttttgttgatttactgccagacagtgagtgataaaatataaattactttgagtttcgcttaatgccatgaatgtgtgctttaatcattttatagcctacatatatataggttctaagtcacatttataaatacacacacacatacacattctacttcaatacataatatatttccataacaccagttagcactcatgtagttgttcaatagaggaatgtcagtataatctggaagttgggttggtttatatataaatttccctaggtcagaggctctcgaatgtaatagaaaaactataacttcagccgaaaaagaaaaagctctcaccttggctacttcacagacctgttttaaaaaggaaaaaagaggagagtaactgtacatcatgggttccctctctggaaaactgaagcttgcatgactgtcacagattgcaggctaccttttcccgtctgctggtagctccacttgcgtgagcattgtctcagcccacttttgaactcttgttttgttgttgttgttttgtttcttttgcttttttttttttttttttttttttttttttggagacagaatctcgctctttcgcccaggctggagtgcagtggcgcgatctcggctcactgcaagctccacctcccaggttcacgccattctcctgcctcagcctcccaagtagctgggactacaggcgcctgccaccatgcccggctaatttttttgtatttttagtagagacggggtttcaccgtgttagccaggatattttgcatttttaatattccttgaggcaaccattagcttcactgagttccctgctagctgtccaagccatatcccaaagtagcagttatggttttgattgttcttcaaagtagcaattatggttttgattgttctttagtaacagaattgcaagggcttggactgttctgcccattgctgtttttcccataagccctattatttttagtgtgcaattttgtagaatgtgaggtttttcaagaatgtatatattatgttacagtagaaatgctatctatgacatttcattttctgtataaggttttccctaggaaagcttaccatcacctaaaatttctctagcattgagatatccaagtatgaatacatatcatttattcattcattaaataaatattctttgagctcctactatgtactaggcactgtgctaggtgacggggcaaaatatgagcaaaattaaccacggtcactattctcaaacttatagtctttaattctccaataaaatacacactccgataaaacatctagataacatttgttcagaatagctaattttccttcctgtgacaatatttcaagctctaatgaacttggccaaatttagtacttttccagtcacatacaccaacagacatgcctctagtttttcattctagtaaagcattggatagtttattccagtgtttttcaaattcatttccccagggccttggggttctagagaaagcctctggctgagggaggggttaagagggtagtcgctaatagactggacagcattttagaaggagcaattccaccttctttagccccgtatcttcagattttgcatacatttatttttgcagggagtagaatgaggaagttgcctctgctaaaaataaatgaataaaagttaaagatcactgatttaatccatatactacattaaactggctacattagtagcaacctagtcattaacctaaacttaagactttgaaaagtgggacacctatgaggactgttatactgccagcggtactagatatatttgacccaatctttataatagaccaattaagggcatctggcataagccataagtcttataagggaaataaagaaattatctgttgactgcatttctattgtgactaatactgaatatcttaagactgagtcttctctcactttttctttgtttctagggaccccagatgattttcattgcagctaaagatcttggacaattatccaaactgaaggtaataaaaataaggaaattacttattcatggaaagtagtgagttaactacagttctgcaagcatcctcctcctagtaatagtatctagcatggcaggattaagaagatgtgtgtgtgatttcacaatctgctttaggaatttttaactttgtattgcagcatttagcattattgcttctggattaaattagagagcatattttctttcatatattaaactggcttgatgtgaacaaagacaaaatggaacactgcatagaaatccagtgaagtctagagaagtcttcaaaccaagaaacacagtacgggaaaatgaaactcatcaaagcaggcactgaacttgtcaacatgttcaataccattacaagtgggagatgttctgactaaatgaccttgtgcttagttataatttgagattcccaaaacactggatttaggcaggaaacttcagtccctgttcctctagcataggaacttgactggctaaaatacatgctatttttattccatttctacctactagaatgtagttaagggatgagttccagacacaggtaaccttgtttcaaattcttcctcaaatgcttcctactatgtgacatgggccaaagtatttaacctccctaatcttcagatgtggctcttgtaaaatgcaaaaaaagaataatatcagttataaggattgttgtgagtgtaaatgagacaagacatacattatctttgcttggtaactgcaaagtgtatgtcacctcccacttgcagttggagctatcttcattcctcccccagctggtagctcaaagttaggtgccattgagtattggattgtttcatatgtacagcacaggggaaaaacaaaatgtataattatttactgaggtaaaatatgtgccttataatttcagtattctattttatcatccacattatcccattcctaacacaaaaattaaaaccagtaatccatctggaagatataactatcacctaaaattgtcacccacacatgttcagtgctgttgatggttggaaggaaagataaaaggtagatgtcactgccaaactattattttgaatcttggatctttatccctttctgtatcccttttattacctccctgggatttctggagcctactttgaaaagtggatttatacactgcggaagtttctcacataaaaccatgaaggtgaaataacataggtcttactacaaaagaaatggccctggccatgcatctaatatctgtgtgatgttagtaagcacactgcatctccccaggcttcagtttcctgagttgagtgttctatcagctagaactatttcattttcaagtgatggaaagccaaacataagcaaacagggaatttactgctacatgaaattttatagtccaggggtaactctggtttctgttactgcttgattagggattcaaacaattttacaggacccagatactcactgcctctcaactctgcccttctccttgtttgatacgttgccataacagaccttcatttctgtgtgtaagttggttgtctctgctctcacatcctttgatgttacatcttttgaacttcaaatcttgtagagaaaaacacccatctcagtgcaaggaatcacagcaaagtctcctggaatatcagtagctctgaggaagtatgatcaccattcccaaaccagtcaccatggtctgagaagtgacatgtgccaattggcttaactgacatactcaccctgaggtttgggtacaacccaatccaaatcctatgaactctgatcgagatagagactggttccctagagggtatatacatgctctgtgggaaaaatcagggtccacagaaaacataacactttagcatgctttgtggtcccattattttctcaattcactgaattcttttttaattctaataacctaaaagcacactataaatacaatgacctaacaggattatttcaacaacactgaaataacatgaaggactaaagatagtctttgtgtctattgatgatgagaaaaataacttcgttctgtatcatattccattattggcttttgagttttttatttttaaattatcagtccatttagttattactatttgaattacagagcaataaatctcctacagtattatgcaaaaacctgaaactccagctggcatgaagaacttcaaattgtataaaactatttcctcttattttattagaatgtcactcccatttaaaaaaaatgttaaactatgggtctttaaatttttaatatattaatttgaaagcagatatgatgtgctgaaaaggtgctatttgaaataattgtactgatagaaaatttcagaactcctatttaggagtattgatagataactgcctaaaggaacacaagatcaagaaaaatgaaacaatgtggggaactaattggttttctgtgtttggctatgatttgggattattccattaaacatgtatttattcaacaatttgacattttctattacttcataatctggaatttcattaggtgtaatatatattatatataattatattatatattacaatatataatataaaattatgtattatatataattatattgtacaatatataatgtaatatataattatatattatatacaattatattatatattacaatgtatattatatattacagcatataatataatatataattatataattatatattacaatatataatataattatatattacaatatataatataattatatattacaatatataatataattatatattatattatatataattatatattatatattatatataataatataattatatattatattgtatataattatatattatatataattatattatattgtacaatatataatatataattatataattatattatatattgtacaatataatataattatataattatattatattgtactatataatataattatataattatatattatatataattatattatattgtacaatatataatataatatatattatatagtacaatatataatatatagtacaatatataatataatatataatatattatatagtacaatataatataatatataattatattatatagtacaatatataatatatattaatatataatatatattgtattctatattactatatatatattaatatataatatatattgtattctatattacattatataatatatattgtattctatattacaatatatattatatattgtattctatattacaatatataatatatattgtattctatattacaatatataatatatattgtattctatattacaatatataatatatattgtattctatattacaatatataatatatattgtattctatattacaatatataatatatagtattctatattacaatatatattatatactgtattctatattacaatatatattatatactgtattctatattacaatatatattatatattgtattctatattacaatatatattatatattgtattctatattacaatatagaatattatatattgtattctatattacaatatagaatattatatataatatataattgaatatattgtaatatataatataatatataattatattatattatgtattagtatattatattatatattgtaatatataatattatatataatatataatataattataatatataatatatattacagaaaacatttataatgtgtattacatataatatatattaaatatatgctatatataacatatatttgcctcaaaatatttcatataatcagatttatttgacataaaaaaatgcataaatcttcaggaactggtgatataatattaaaaccaattgatgaaaatacacctgagactctgagtttactgcatgctttttacttgggcaataactcattgctggcctctttcagagatccccttacttgaatgatctgttgctaaattctaaaaaattatttctagtaagaattatatttctagcaccagcgtatatcacttattagcatctgttagaaaataatgtgaccacattgttaaaccagtcaagattgatgaagccagataaatttatttaatagaaaatatttttaattacttgtctgaaagcattttcccctataattcagcaaacatttctattactctttgagtctcaatgggtatataatattgctatttaaaaactgtgaaatgaactcatatgattaacttgaaatccccgtatcagagaaagattcagtaagatgtataaatatatatcatggatccatgaaacattataccatgttgttagcagtatccaaagacaatgattctattggagcatataaaatctgtgacacacattgaaggaagtacaatccaattaccaaaaatttactgagtgcctagcagataacaactgccaaaatagacacggaaaagctgaaggagtgagcgagacatagatagattattatcttcaggaagtcgtggcaactaccaaataaaacagtaagataaaggccaaaatagaaggacaagccactgggtgtgattgcgtggtttgtgcattatgcaaaaatgcatacctaaaggagcaagtgacagccaaaattgagcccatgttccacttgccaagccgtatgtgttaacttgaagctgtcctcttataaaaaataagacaccttttattatttaccaaaggcactgctttactcttcattccatacctgctcagagctatgttcccccacgtgggacttttcttctaattcacaaagtcacctacataagtttaagctccagaaggacaaacgttttccctgtattaaacaatatatctcattctctgcgaacagtgctggcacaaaataaacactcaataaatatttgttgagtgttgtcgaatagaataatggcagccctgggatgattgtatcagttttgggggatcagacatttttaaatttttcccttagtttttatttcctttattattttctttttctgccatcatttccctaaataagctttgtatgatgggttgaaacagaccacagtgaacaacgaagaaattccattgtaaaataatgaaataagttttaaaatcagttctaaaatacttaaaatgattataaaatatttaaaatattcacagccaaatttagttaattccttggggcttttcccaggaatgagtaagaattgagggcatctaagaagaagaataaagtggaggcattatatttaaaatagactttatcagtaataattgggagaggcttaaatttgctccttaaatccttttcatgattgatagtcctcaacgtgacagacataaaccaaggaagtcaggtgacaaaatttcatcacgcattttccaggtttctctcttttttccctaacattagtttgcaagtgaaaataaagccacacctctatcaaagcacttctttttaagtaaatattgaacatttcttcctttgacagagaggagatttataaaatatatgacaatcattttattttaaatgcattcaggtgcagaagatatttcaaataggaagtttggcatatggggataatacagattatgttttcaagtagttgttgaatacatgaactggttgttttataagcaattcttcacctgttttccaggagcacatgattcgagaggatgccaggggtctgacgccaagacaatgcgctataatggaggtagtcctggctaccatcaaggtgagattataatgctcctatatatacatcgagagaggcccccatttacctccagagataggtagccctgatcttagccatgtatcagtagagctgcgccattcaaagagatagtagatagttgaatagatataggttggtgcaatagtaattgtggtttttgccattaatactattgcaccaacctaatacattcctggaggatgccagatttacccctgtctatctccttatgacatccacaatagactgtccttatacttgcttcttttgtctctctctaaagcataagtgaaacctatgttttaacacatgttctcaaagacatgtaccctaaaacccagataaacagatgctttgagaatattttgggtagacagaatttgtttttatatgttttctatgcatgttgaaattatttttaaaatatcaaccctcccttctcgcttagtaagtacaataatttcatttcattttctgctgaatacccaaagatgtcgtttgtacgcatcagctgttttcatagccaaagattaaaagttattgtagtgtatgctaaatatgtgcagatctcaaaatgtaacctagaagttattttcaaataatttcttttatatttatatccatatatatttatatgtgaaagtttattaaagagtttgaaagatgagtttgtcttctaaattcaaatgatgtccaaagtttttactcttcactgggggaaacatctactatccaagatatgtgaatagcatagctactaactatactgtaactgttagctaccatgacccatttgtagagcatagaacagttctactggatagaaacaatggtattcatttcaacagagttctatctgaataacagtcacatactttcacaaaactgtcacctcgtggcttttgttttgcagtttcagcatttaatatgaggcagtcttttgctgctgcagtggtaaaaactgccacattaaagttgggaggtgagagttttgtgacacctggaggcacctggatcacagaaatggagtttctaaagaggtagccaaaatgttgtctggaaatatggaaaatttgcaaaataatttttaggaaaaaatgaacaacatgaaaaagaaatacaataaaaaactttaaaagtttttttaaattattttcaaaaatttgaggaagaaataactaatctttggagttatagtagcactaatagctttataaaaggacatgctagtagaaaaaaaataagctctagcatgcaccatgaagaggaagaaaagaaaaaaatttggcatctgaattcaactcttcatgcattttattaggtcaatgcatggctttaggaaaggaaggaaaatgtgtcctgtggaaatagggaatggtattcactgtgttcacagatctggcttctgtctctaacttcaacatttctctaatttttattgatggggccagatgatcaccacctgctggctgagttcttctcagagtctaagataatgttgatcctcaagcaaattccttttatcttgacagctcaactatcctatcttcctgtttatatcatctatactaatattttaattcagtctcagacaccagacaccggccttgttctttgtggacaaaactactatttggtgtcctaggtccagtaaatgggtccatgccatttgtcttgtttctccaggactggagtctgactctggtcctcctgagccccaaagcgtgtgtcagttctccagttcccctcttccctaacttctgtgatgccaactctttctctaggcacctccatgctaggcctgctgtgcctgctattagactctcttgaccctgtgccctgcccatctgccaaggtattcacctgatatctgattttcaatgactgtcatcagtttgccaaagctgagactccctttatcttgtctgtctgtgagatttgcaccaacttactgtcctaccaaacattaattgtgagattgactacaaaggaattcaagagaaggaagagtacaacttaaaagagttttaactccaagaactaaagattcaatgtctccccggagcccagccaaaggagcactataatgcaagcagagaccttatgagaaagatgaccttagaccaaaggagcagacgctacccatgctaatttccaacggctgctaaagagataatctttaattcctcttcagctcaatttaattgaataagctagaaatgagaaaacaaagaaggaaaatgctatgaagtttttagaatataggctgaaataatgttttacattttcaaatttctcttatgtacgtgcatcatttcacctgccttgtaaatatcctgggtgttagataggtcaagaatgattaagaaaatgtggcacatatacaccatggaatactatgcagccataaaaaatgatgagttcatgtcctttgtagggacatggatgaaattggaaatcatcattctcagtaaactatcgcaagaacgaaaaaccaaacaccacatattctcactcacaggtgggaattgaataatgagaacacatggacacaagaaggggaacatcacgctctggggactgttgtggggtggggagaggtgggagggatagcattgggagatatacctaatgctagatgacgagttagtgggtgcagcacaccagcatgtcacatgtatacatatgtaactaacctgcacattgtgcacatgtaccctaaaacttaaagtataataataaaaaaagaatgattattcacctttgataatagagaaaattaaaagtgaagagatttcagttgtttttccgaggccatagctctgctagtaattggcagagctgagaaaggactccaaattctaaagccagtgtccttgcttctatgtcacattttttcaatcagtatgtacgaagtttaagtaaaatgtagcaggctaaaagggatacttcttcaaagagattacttcttgctatattaaaataccacgtcaattacttagattattttctaattattttaaaataatgtaaaacctttcagcctctatacaatattgatgaaaatattaacttttctaaatattaaaactttaattggactggaactattttataacaccagtcacatgtagcttctattataagtcaagagtgtcaaatatggcaggagtaacaaaaattatgatcatctgctgcaggtaggatggttgggctttgagacattccatttacccggaaaagcaaccaaatcaacaatgtttgaaagtaaaagtagaaaagtggcagctatgagacagataatcagtcacccaatctatatgtgcaaactaatagggaggccaatagggaaactttaaaggcgttctagctggactttgagttccaaccccatatctcaagaagactcaggactgacatgagattcccctaaatgtagatttctttcaaagagaaatagcagttacactttgacctgaaaaaatgctgaatgatttaatttttaaattcccccagaacccctgttatatgggcctgaacatgacactacattatatgttgcaaatatatttggcttcatgcagtggcaatactgaggtttctccaaaaacaataaacatgtgaatcaggaccctctagaaatctgcatttcttggtataaggaaaggaatttaactataaattcaaatatagctttggaacttattactttcttatttaatcctagataataccatttcttatgttcaggactccaggcaaacataagagcatggtgatgaaccacattttattcctctgtgtttcttaccctcgcagaggttctgccctatcctgctatctccattgtccatggggtgattccaagggctttttctcagcatcttcttttcaccattacaagtatagcttttgccttggttaaaatccagctactcatgagaagaacaaaataacctacctagtttagaggattgcaattcaaatatcattatttgagagcttactgtaggtagaaaatatggtgagcaatgaggaggtggttggagatgagagcacctgcctttgacttgggaacaaaaacatctatagtcagcaaaataattgtgatcaaaggatgggggagggcagagagggtgatgaattttctctgaatttccagggaaaagcttcccagagaaggacatttggggatgtagaggataaagagggaaaaaacaatgggagaaagacattgcaggcctatagaaaacacagcatgagtgaccgaagagaaggcattggccggcatgaaaactttaaatagtctagtgtagaagaactgatcatgactggctgagtatcacagggaatgaaagaggaacattggattggagccagcatgctgcggcttaaacaccaaagtaaagaatctcaactttagtttgtcagcaaaagagaaacactgaaatattttatgggcgggaagaacatattatgatgtgtaaaagaggactccagttgtggtagaaaataattttttaaaatatctgtcaaataatttctaaaaaaagaaaactttagtggctaacctctaaaattataaagttaaggtgggttatgattatatctaagtctgcaaaatgagctgtctgcctggatttgccgaaaatatgatacaggtgttggaaagaacaaagtaatgatggaaaattgctaccaaaatagtatatttaacaaaaaaagggaattcttcttataatcttgtaaggaaacaatagcatgttcccatgagtcagtaaaaatattatattgtgcaagatcttcaatcttgaaaagtttgaagagttagaagaattcagagagttttattgggattataaaaaaatagcttgccaagcatgcaggcaatatttttcctgattttttaaaatttagcagtactattttttttttgcctctcaaatcacaaccaggtctcaagtgctttattttctgaaaagtcatgaagaaaaagaaaatctagttatttttcaagatagagaaaatgatacttcatatatagctccttcctacccccgcggtgataatagtgctccttatcacacatcctgacatttgtgacaccaatgtattaatgtatctagggtggaagcctttacaaatgtcataaggtggctatgaattacaaaagtaaataaaatactggaaactacatgggaaattataccactaacaagtataatatcaggataggaggtgattaagagagagagagagaaagacaccaatgtgcaaattattctcctctcctatggaaataatactactacttaaaagattattgaaagaaaattacatgagtcatcacatacaaagcaattaaagcaggcatatagaaaacgcttcacaaatattaagttgtcacttatattgcctgatgattggttcattttggaggcttctctttctactcttaagcccaagaccccacatactctactgcaaccagtgtgtttcttttttcctcctttcccaataaacccttaattccctctcaaaggagctgactattaaatctgactcttttccccaagcaatagttcaaatccttaaggctttgttctctggccttttggattcctgggcccagcactttttccctataagagcacagccctggttagattctttaacacctgagactcccctttgagaagcagtgctgttcattctctccgggagtttctagtccagattaaaagctgagagaggtacattgaaaatgaaataatgatacatgttaacttataacagtgtaagagatggaacaggtgatccaaatactaattgagggaaacagattaaaaatatcataaagttttagaggatgtgatcaaccagtatggactcgagatcaggaaaagctgcaatggtcttgaaagacagatgggcgtttacaggctggatagaaagtttttttttggaggaagactcatgacatgaacatcaacaggaaaaaggaatttcaccagggaaaggcacaagacaagaaggcttggaggcagtgagtagactactctgtggactggcctggacttaactaggtgtttgcataatgaagcagtgtaaaatgaggttgatgggaaatgtttaggttgaaaatacagaggtccttttgtgccctcagtatatttcataaaagaggattcatcgatgattttaaaaggttatgctaaagtcatttcaccaatagggaatcttaaggaaatgcacaaattagattgcatagttcaagattgtagccagagatttgagttccagttatttagttcataagatgatgagagctatcagcaaggtggtggctttaggaggagaaagggaaagatggatatgagtgacacaagccagggagagttgttggaacttggcaactgaatatggggcaaaaaggaaaaggagcccaaaatgcctcagagatttcagccccagcgactgagaaagcatggttccaccaagaaaaatgggagacagccaggaaggctattttcctagtgccatgttggagttagatgcaatggcaggaatgtggaaatcaatatttaagaacctgcttgagataggggctgatgcttaaaacccaatgctgagttctatttgagttctatgttattctgccaattaaatatatttcttacaattggaaagaactccagcattcacatagctcttccagttagagtaatcaccatttgacaacaccaaaggtagaatggatatttctgctaccattctataaatgaattaactgatagcctaagaggttaaataaattatgcaaaagtctgactgtataggggacagatgaagaattatattttctagcatattataaggatcagagaatcaaagaggttaagaggattctagactctcagaattggaaacatgactgagcatctcccactcttgccacgtcatctacaatgttgtccgcacatggtcttccggccaccacttaatagcagccagtgacgggacctcactaacttacaagtggaagttttgatttttaagatgcattattattggaaatttttgatgaatgtgtcaaagaaaaatctgctctcctgctatgtattggtgctccttctgttctttggaactactataaaattattctgttcccttttctgtgtgatagactttcagatatcgaagaaaactatcatgccatcctatatcatctgaagctgtttattgaataacatgccttgtagaccttatgaaattctggtcatctatttttaaaaggcctccacttttcatatttcttataaatgatgaagcccaagaatgaacttaatataccagatgtgttctaaccaatgaagaatgttcctgccttaccaaacccttatacttgacctgtctacctctgttgatgcatggtcagatttcacttgctttaatagctgccttctcacttatgaaatcatgttgaatttgaaagcaaataaatctttatgacttttaaaaattttctgttgttaagccacatcacccctattctgtactttgtggtaaacatgaatattgatatgtattatgaattctggctttttactttcctctttgccatctcattctagaaatgtagacccagcattccagactaccgggacccttctaaagccaaattttgtcatccaatgtaacaactttaagcttcagctcaattgcatatctgtcaaacatgctttctgcctttgtttttttaagtccatagcaaaaatatcagccatgatagagaggaagagagaatgtcatccagctaatgtctttatccttctttgcactaaatgaccaactcctccatagtccttcaactgagaggttacaaattcttttcttcaataaggaggaaatgacctgtcctaactgttttttgcccattttttcctgctacattaggccagtctaagtaaaacatctgaacaaatcaaactgaagtttcttacattatactgcaggccatagaggaattacaagaaaccaagtcttggtcttttgtttagaatcaatggaaaataatgcacttttcacatatttaatgttttcattttactgggctttaaaccccacatttacaaattcctttctagcatgttatcccccaacaaaatgcccattataatgagtagtaatcaactatactgcactgagctatggatagtgggttttgtctaataattaagatatttacttccatacatcaccctcacatttatatccttcaaacccaagcctcagcaaaatgcagattctactctccagttccttcagagtcatgggcacagagtcaaatttgaatgtaaaatctctgaatgccaaggtccatgtaataactgcagccccctttctcctgattatctgtgccagtaaggtaaccagactggtgctcttatatgctgtcattccaggttttgaacactgtgtgaaaggttttcataaagtagaattctcgtcaagtttgcatttgcataaccatagaaatcaccttcttcactgttgaagtgaggagcctatggcgtatgttatttgtctgtgtccattgaatgggatattttcattcttaccacctggcaatttgttttctcttctgacatagctaccctctgtcctgggtttctgtctcgggacatttcatattgtaaaatgcactcaaaagacaaagacattagtttctgcccttaaaaaacttctgttcagtaaatatcctgctagagactttaacggaataacaagtaaaactctatggctaaaaaagaggaagtcagttgagtatcgtaatctaaaactttagggacctttgggttttcctcatgtacaagcacacaccttatttatgatttcatttcctgattagtccccaaagtcccagagttctacaaaataatgccttaggattaaaaacatgcctttctataaaactattttaaaagattcaagcacaaatacagtttatgctttcatagcttaactctttttaccttctcctatgaagctttctaggccctcaacaatatctcaattatatgaagttcagtgacattcttctgttcttgggtttcccaaatcatatttcatggaacacttgtattcccaaaagtattagcccagtgatataggtgtcctatggcctaataattttagcaacaaggtatattaataaacgatcacacagatctctttaccacagtatgcctcagagcctctaccatgttaataagcgttgggaatttttaggagtgcagtgtcatctcttaacttccataggccctctactacctagaggcagcacaagtttagtgatgggtatagaataacagtggaaaacagtatttttaaaactatgtctgaattatacttggagaactacaaacactttagttctccttagatagtgccgagactcccagggtttgtcttggttacttggtgggattgtcctctgtctctagttcatgagggtgaattacctactggctgctaaagttaaaaacaacagtacttaaaaactcataaccaccaaagatgtcacttctttggaagcctttgctggctccttagataacagaattgcatgcctcccccattatctgtattttcaaatcatttttctaacacctgcaatgtattgttgaagtcatttgtttaaatgttggttacatttcctactagatcataatcccttttggagcaaccactgtgtctcttttgctttataatgttagcatccagcacaaggtctggctcatgatacagatttaataaatatttattaaagaaaagagggagaaaacaggtggcacagcagacactaccacagatgctgtcaagtattaaggtgactgaagaatccacagtgcaatcttacaaattagacagtaaatcctgtggtcatccttataaatgctgtcactcatactactttatatacactgttaaagaacagtttttaaaagagagtataattgtgatatccatgcagttataaaatgtgtcaaaatgttattcatcaattagtgagagaaccaggtaagatgttactactgtctcaaaggagaattccagaaaccaagcatatacaagcaataagaaaagctggaatagaggcaagacagatttatccgcaaagcaatattcagttttattccacccaaaataattaatttgtattactagggacaaaaatcatctatactattattattaattttctacaatttatagagttttaaagtagcccaaggacaatgaaaagtgaaaataacgcaaatgtgtatcatagacagaatatccactaatcttttctgctcctttttccccagaagtggcaaattttcattttatcagttttggttttccttccctctcttcctcctcctcttcctgctcctcctcgtcctcttttattataatcatctatcacttttgctcaggttttataagactggggcttacctgagaaatattaagagagaaagtgccttcctttccagagttccccccctactcttggctcagtttctagcattgctctttactctcaggcacagttatttctttggatggctccttgattcattatgtaaacagtcctccagagagcaccccaccacccttctaggtgatacagagtcaagaccaatctatatttatgtgtatccccctcaatacatccatgaaatcttttttccatccttaaatactgtgtttctcaaagaaaggaattgtcatattttttcatccattaaggcacctgaaacagttctggactaatagtcctctaaatactttcttcatgtgaaaatgttttaacattctttataagatccaggtgtagaacaatttaaaacttatgttttgtcttttactaaagagaagacattttttctgtgcctccttttcatagcatatgtagtttttgccaaagcctgtgttttcacagagcacctagctagaatcagtaaatggaatttcaaaggaccataggtttctttctgcctggggagggtatctataattgtaccagtgtttcttaagtttaaatcccatttgcctaatttctctggcctacaccctgaatctcctctacagtatactctcggaaagtacaaccagatgctagctaatacccataaaatttttctgcatctccccttgaatagggaaaaaaaaactgagaaaatcagctcattgaaatgtcttgcctgagaaattcttaaggagtgggaaagaagaatgacacatacccatttaggagagcgtctctgaataatttcttgagcttctttgacatatttcgttctgtgctaattatagatcacagtgagccacagttactagtgagtgctttgtttcctctagcattgttggtacgggaagagagaaagagaaccgtttatctaaacttaatagaatgttataaatctattatcatttataaacaggtagaaaaaaacatccttagttctatcatatatctctagacagtctgcatttccaagagatgtctgtctgtgcataacacttgtagtatgaaaaatgctaacatccctcagtgaccatatttattgtcaattaccatatatcttctctattatcttatttataaatattggaaaattttgagtttggttgaataaaaatagcaaaaaaaagtattattatatttatcagacacaaagttcaaggggtgttggatttccaaggaccactctgcttcgtcaggttggcctatatctgcaccactgtgtgattagaggatggggcagatggagtggcagacacctgacctagaatctcaaactggtatctggaaaatatgtggccggaagctaccttccctgtgaaattttgacaacccttggtatttttctcatattcaagaaacagaagtcaataaccaggttgataattgttacctaaacctgtcattctataaggattctgactgctacatcagcatgatctcatttgtttaaaatcttgcataagagataaaggcttaggccttctgggatatgaggtctgtgatgttgagtgtcatttcagagatgtctagggacctgaattagacgttaataacttagcaatgggaaaatgatggaaccatttttttgtatcttgcattgatcaaattgtattattccatttgagcttctctattagagtaataaattctgtcttccaatacttctctctaaatgcctcggcttatttttttttctttgtagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtaagtaacacataggacctgagaataaggtaaactgaatactaaaataaaatttaacatcagaattattatacatagtcccaataattttttgctgttgtgaattgaagtatcattaaaaatggagagttatggttaatagagaataccaatttttttagtgttcatgaattataattttataaataattttaataacactaagatgtatttaatactaaagctctatggaatggctgacttgttggtgattttaacttccataaaactactttaagtaaaatctactttttaatatttatgaccaagatattttcttcaattcagtataaaagactcagtggatttctggtcttggtatcttccaaaaaatgataataattccctaaatcctaatttcgaatgtaaaatccctgtgctctggggtttccataagggaaatctcattttatgctcatttcatatgaaaaaaattacaagatttctttgaaacaggccaagaggcaggcttgtttcatgtgtttcatatctttgaaactcagatatgtttcatgtgtcaaagtttccacctcataagcttctaggatattactgttcaaaaatttttctttcaagttgctttgtgatttattatattttggtgattatatgcatttaagatctggcatttctaagagattattgaaaatgtcagtacgagtcaaaagagccaaatgcaggctcaaacttcagaacctaataaaagttatactacagaaataataaaagtaagtaagaagacactaacttcattcatgaaagatccttggaaaagggaacatacagataagtttttaactgtgatgaaaataccctggactcatcattgtttcctcttggatacattaatttttctacctatatcaaagataaagctaaatgtgctaggtaggtagtctgcctataacactctgtgctttttgatactgtccaattaaaaactacaattatcccttttcatatatcccaggttatactgtgggatatttccagaaagggaaaagtcgagctcatgagagattgtcaagagatgcagaaatattcaaaacattattccctgaatgcatgctcatgctccctcaaggttttctaaactttataaatacgaatacaattctaatatatcaaataaatagtgttgtagctttactccaagaaagaaatgagtatataaaacttttgcttcatctttataggtttacatttatgtgtacacccccccctccaacacacactcatatacatatacagacagtcatccctcggtatccctgggtaattggttccaggacgtcccacggataacaaaatttatggatgctcaagtcccggatataaaaatgtataggagttgcatataacatatgcacatcctcccatatattttaaatcatctctagagtatgtagaatatgaaaaatgtaaatgattgttatatagtattgtttatggaataataacaagaaaaaaagcctatacatgttcagtacagatgcaatttttaaaaatattttccatccgcagttggttgaatctatggatgcagaatccatggatatcaagggccgactgtgtgtgtgtgtgtgcatacatctatgtatgtttgtttgtgtgtgtgtgtgtgtgtataatcaactatggtatatggaatttggcataattacctttttattacatgtattatatgaaaacattaaaaacatatgggaagaggagaggattcttaattctaataactcactgacaatataattggttttactcttagtttatttcctgttccctcattttctgttttttttctgagtattcaatttttttttcagataactgaaattggtaggatatagatacgaaatggtttttaattttctccgttagctacctgtaaatatgccttgtggaaacttatttccacctcctccagccctcctatccaccctcgcccagctgccctcaccagacatgttcaggcccaaaggacttagtgtataaaagggagcctgatgtgccacttactcctccttccccatccacttacaggtccctctattcctcagtgttttggggaatggaaactaaaggggaagaagaagaggccctcaatgcttcctatatggttgcatccaaacgctggtctctcgtgtgtgtttctggggaccctcctatctgtacatttccttgaggagtgaaatctatttcatatcaattcctgtcagtgtctcctgtgactgcctactgcagcatatgccatagattcttgctacttgaaaatccattccttgtggctagccctctggaatgggattccagcaagtaagctaaagcccaccttcctcttgtgaggttcacttgagccatacaaaactcatacatttttttcaaattgttggtggtaatggagacttctccactactacccactttctccaccctgccatttctctaaaattctcttctctacctgtacataagcatttatacttccacattaggggagggacaatgctatggcttgttgtaacatgaccatgttcaataaaaaatggaggcaagctaaaaagtcttctcagttagtgaatccaggatttctgagtaatattcattccctctctttttttgattctatcacaatcccatctcaatattcatgaccatagactgagtaataaagttagccaacaatacaccctttggaaaattgtgatgggcaagagagatcgatgaaaattagctgcattttagaattatttataaaaccataaaaatgaaaatatagtagaagatacaatacttatttctgtaacaaatcctaaagttatagtttgtacttatgacttccaaattcttctgtccagtccatgttctctttggcgccaaaggaaactcagcttccaagatcccttaagtgacagagaaatatagaaaagtttaattattggagtcttatttatataaagtgctatacaattctttgaacatttgacactggacatgctgaaatagaggcatttgggttccaccctttgtattccattggtgctcttcctgcagatgatcatttccaatcaatggtaggatccattatcctgtacctgttttattctggtggcatggtgtcaaaaatgaccaaatgaagtctcagtttccagtgtatattagtccattctcatgctgctaataaagacatatccaagagtgggtaatttataaaggaaagaggtttaatggactcacagttcagcatggctgtggaggcctcacaatcatggcagaagacaaaggaggggcaaaggcatgtcttacatggtggcaggcaagagagtgtgtgcaggggaactgccgtttataaaaccatcagatctcatgagacttaatcactagcatgatagcaacacaggaaaaacccacccctgtgattcaattacctctcaccaggtccatcccatgacgtgtgggaattatgggagctacaattccagatgagatttgggtggggcacagccaaaccatgtcacggtgtaaatattgttgcaattatccaaataactgtctaggacttagcacaataccaaatacccatgaatagtcattgtatttcatttttgttattttaacttagattttgttatatgatttaggaagatcatactggtgttatagtatcagtcaaatataaagtagtaatagctgacactgcttactgcaaacacctgccactctgcctgaggagccacaggcacaggctcggtcctatgcaggaccagctggagtgccagagggttaatgcctcagggagcagccccctaccagtgaaatacaggaagttggtgggtaagaaaggaagaagagaaaatctctatcttcctcatttgtgaccaactctgatgtgtattctacatatacagcactccagagtttccctatgagatgggatccagtttccctcagaaggctggcttgacacacacttacttactttttacttacttatttttttagcttatttacttttttttcttttctcacctcctggctcctttcccagtgtttcctgggatccctccccaggcagaccacttaccttttgatgcttgtctcaggtttacttctgggagaacccaaacctaatgtcaggtggctaaaaagcagggtgccagatcccgggtcaacatgtatctaaactctgtgccctgacctctatgtacacctctccttgaggacaagtaaaaaggctcactaccttgaatgaatgtttccctattacttgggctttttctctcatgtgttcttaatttagaaatacagaactaattaatgaaatacaacttttaaatgagtattatctgggaaaaaaatttgtatttttttccaaataataagcataatcatttaccttatgatcataaaacccaaagtgatttttttgtctctttaatttttttttttttttttttgagatggagtcttgctctgtcacccaagctagagtgcagtggcacgatctcggctcactgcggcctctgcctcctgggttccagcgattcttctgcctcagcctcctgggtagctgggattataggtgcacgccaccatgcccggcatttttgtattttttttagtagagatggatttcaccatgttggccaggctggtctcaaactcctgaccccaggtgatctgcccacgtcagcctcccaaagtgctgggattacaggtgtgagctaccgtgcccggcctgtctctttaatttttaattcatgttctgtgggggaaattactgtttcaaactgcattgaatcattatttaagtgttatttaatcaaaatgtgtgttgtataaaaagtcttgtgattctttagaaatctaagtgcacttttaaaagcatttgtgttttacttttcttattctcatataatttccccttactccattttcttcttttcctttctcatctccttctcttttttctgtttttctcccttgcttgtgttagaaaagtaactattgcatttaatataaggaaaaagccaataacttataatcaatttttttcactattttcaggctttaagacatacttccctttaaaaatatgtttaattgaattcaactttttaataaatgggtttataataaatggtttaataaatgggtttctaagtatggaaatgcctcttgtatcttgctcgtttattcttttttccttcttcacctctttcttgctcttttctctcctatttttgtactcctttcctccttcattattctcttttggaagagatttggatgtcatctttctgtagtagttagacaaaaagaaaaaaatacaaggaattgaatcccattagaaatttatgagccaaataattcaaatatgatctatcatattggaaaaacagtcttctctctctgttccaaacatggaaaataaacaaatccaaaatggatgtagaagtattcttaagtttttaagtggaactgagaatttaatatataagagtcacatgtttattattctagaaatgtactgcaatattaaaacaccatcttattctgcatccatttaacaaacatttactgagtgtcccctctgggctaagtttcatacagtgagaaatatgttcaaaggtggatatgatgttatgtatgcaagttgctctaatatggtgcttctcaagtaggggtggttttccccctcaggagacatatggcaatatctgcagagctttggttgtcacatcctggagtggtggtcatgttactggcatctagtacagaggccaggaatgctgctaaacatcctacagtgcacaggacagccttccctgtaataaaaattcatctggctctaaatagtaatagtgctcagtctaggacaccctaatctaacacaggctgaaaagtgagaagtgaaattttggtctgaggagacagaaaaggcagagaggtaggtgagtatattgggtcatgagaaggtagaagaagaaatgtattctggataaagaaactctccaggaaagtacgtacttgcgctcttattttaaaatcccaatatagcaagcatgtccacagtatatttttactggtgaagaaacataattttttttaaaacaaaattcaccacataaccccctattttaatcaatagatattattaaaagtatcttaaatttccttgcaccattaaaatatgtagaaatactgtggtaggtttaatgtaacattagcagaaattttaatatatgttggaattacgacatgttatttctccaaaatttgactcagtggtttaaaattgatagttagcttgaaatattacatttcttattgctgttttttctcaagaatgcattacttacagttttagaagctggtagaaaattcatttcttgcatcttgattacaatgttactaaaaaaaaggtttttctctaacaactatttcatgataccaagggctctttgaatatttcatgcaggagcagacagtgaaaaatgaataaaacttgaacatattaaatacagttttttcaatgaataacacaatttgaaacaaggcacaggatgattaattgctgagccatcctctgtttccttctctgagttttattgcagcttgagtgacctgaatcacaaaagctttacacagaaaagggatattttatatagaagttacaacagttccataaaaatattaatagttaatgcctatgtgaattaaaatacaagagctgaagtgtttgtactctatgatctgtcctattttttcatttttaatgagtgaagtctttgagtctctgcttattttaagtttcttaacattaaattagatcattttgatcattttaataacctgtatcctgctgaagtagagtataatgtattttaatttgagatggaaagcagatagttactgattcccatcctggaatctattaatatacttcagtatgcctagtatattgcattaatgtcatgtggagatttctcactcttctttttattggtcatttttataatttaagtggaagaaatatgtcatttatttatttgtttatttattttgagatggagtctgtctctgtcacccaagcttgagtgcagtggcataatctcgactcactgcaacctccacctcctgggttcaagtgattctcctgcctgagcctcctgaatagctgggattacaggtgcccgccaccacacccagctaatttttgtaattttagtagagacggtgtttcaccatgttggccaggctggcctcgaactcctgacctcaggtgatctgcccaccttgtatccagaatataggatgaaaagtttaaataccagattatatatccaagcacacttttattgtcaggtgtaaaatttggaagcatctcacacatagttatttgggatcataccacctaatgaaagcattatctctaattatattcctcaaactatattccagaagtagaaaataaacccttttctgaaatggttcactgtggaaagagtgaaccattttcttatcagtaatgcagaagaacttaatatttcattggcagaaaaactgttctcaaattaaaaaaaaaaaaaaatgagctttttggccaagggccaccgctgaaatttcaactggatagccacctctggaaaaaatgctgagaaatgtcttcagttcctatgcttggccattttcaacttaatactgattttaaaacatagaagttatttctcatattggctaagcttgtcagagataatcagagatctggaatcctatccagcaggtctatgtcactctctgccccttaggcaccattggactatctagaatttccttctaagacaagaggttagcatttctctagagtcttaagtgtaaaactgaggagaatctgtgaaatatggctcttcaaacattgcagtctttctgatgacattcacttcaccaaggtggatgagggtcttcagagcagtcaaagagctatgcacaaatacctttaataagaggggtactgtgatatgattctaaggatgttgactccaaaagtagaaatggcaaatattaaataaggttacagtgaagataagcaaacatcttgtgcactaaccaagttgtctacctctgtgctgttcctccctcaaatcctgcaagaccagtaacattctccacacttctcacattaagacacgatgtgtaaagattttactcacaaatagatttttaaaacttgctaaggtagttggtcaagtaggtaagtgacagggacaatgcccctcccactgtctcacactcgttttcatccgaaagaaatcagtctatcattattccttcccacagcctatgctttcttctccctagctttaaataattgggtgtagttccttctccgtactctacatgttagtatcactgaatctctcttctgttcaggagatgatctttaagctgatacttagttttcatgttggcaataaatccccgccgcaaacttctaacttcttcctctgctccccagtttcacttcattctggctgcagttactgggtaagctcagtagccaggacaccttttaagtaataaacagaggaactgacgttgtagaaatccaagctaaatgtaagaaaatacatcctgcttccaggacactctttctaatatagcctggagtctactatacacctgtaggacattgctgcattgctctgtcctccctgtctccctcttctcccctcttgtcccccaccagcacatggattcatcttgtgacagttccctagcacagtgagtcattttgtgattgataattggcaaccctctcttcttacaatgtaagccctagtaggacaggcagtttgcgtattcatctttgaaatctaagtgcccagtagagtactggatgcaaagcaggtgcttagtgagttatagaacaaatgaatgctataaaattcaatgcagaaaatctcaaattgtgtaatataacatagttctcatatttgaatgtatgtgattacagacttttattgtagcaactatgtttgtggtcctgttctagacactggaacatccaaagtgtgtatgagtatgtgtgcatccttagaaaaaagcttgtaattttacaactgatactattcactaattatcatacaagataaaagtaagtgccattggagaaatacaaaggggcatataaaattagaaagagagaaaaagactacttttttttggcaaactcttgaaatcatgatgttttattcagtctgttacatgaaactcaaaaaccgaccaggaaaaaatgaagtatgccactgtgcacagtttaggtcactgaaagatccatttatcctttcatgtgacttagttttaggagcatttgtcatatgccaggctttgtgctaggtaaattaccatgaaagtctatgccaaatatctccatttgcccctcctaatctactttcccccactccgcaggaggctgagctgtgtgggtcacagtcttgagcaggcttactccctgtttcccaagtggttcagagagcagggagcccctcctaaaagggaagactacgttcagatattccttctccaggctccctctggacaaggtcctctcagcctggctctgtcctttgactgtaagcttctcaatgtctttcctagaaaactctctctttccaggttccagtaactccttcctcccctcatggtttaccgatgagggcagttagcagttccactttcccttgtcatttccctagagcccagcgaaaccctcataaaaagtctcttctcaaaccatcctaaaattcctcaaattctggtttccatctgttcactatttatactctgatacttgaaaaatctttagagttttgccaggttttcttccatggcaactccttcatatgggtcaaagattaacatgttgaaataagcatttcaagtatcagaataatcctctttggagtgagagaaaacatcaaattttgatgactcctttgtccagaatgaacaaaagagctttccacagaaatatttccattatagtctgggcaggacatcaaaatcccgaatcccactttctcagaatacagtttatttggcccagcattttatcttttctggaaatctgaaatcagattaagacaactgggaatcatttgtaaagtcacttgtaaagtttaagagttctcacagcatagaataagcacatgtttattgcatgtgatgctgtggggaaattatcacttttaatgtactggcagactaaaatgtacatatttttagctcggaataggtgtacttctagtgtttctttcattttttgtcatgaatacttgaaagattacatttttttatcgcactcacatttttaatcaacaactgtatatatgatgcatttctttatttctcaatttggtgagagccagatcttattccaaggttatgctgaatatcagtgattagaatccctgtttcctgacttcaagtgttccctgttacttgcctctcaaatactaagattggtttaaataattatgaaggtaacatacatatattttcaaaagaaacaaaagcacttgacatttgtttacatctaaagttacgtataaagtttacctataaataaccactcacactgcagtttactaccatttataagcaccttcatgtattttcgtcacttgagtctcagaacagccctctaaagtcagacagagggccagcaccatggctcacgcctgtaatcctaacactttgggagaccaaggtgaaaactgcttgagcagggagaactgcttgaggtcagcagttcgagaccagcctggccaacgtggtgaaactccgtctctactaaaattacaagaattagccgagcatggtgaagctgggactacatgcctggctcctgggtgcccgtttgtgacagtcatctcacccaagagcaatggatgtcactgaagtgatttaagcaagagtgcaacatgggtaatagactgaagggagacaagacaggagcagacagacaagttccagcctccagtaaaaatccaggtgagacatggcatggggcttggatggtggaatagtgacaaagaaatatgggcagactcatgatgtagttcggcagtaaaataggcaagtgttagtgaaataaatcttaagttaataaaagttaggatataaaatttcttctacaggattccaaaataaagcaacaattacttctgtgtgatgaaagtgtggttgattttttttctctgcctgcttatggttttctgtactttcaaatgatcccaacatgtctagatatttatttttgaattataattttatttaaaaatataaaaaatatactttcttatgcaaagtacaatagtttaattgattgccaaggtgcagtttattcaaagtggtagattttgaagtcttttaaggccttggatttaaatctgagctggaataaacagcccagttaaactttctcttggccgggcatggtggctcatgcctgtaatcccagcactgtaggaggccgaggcaggcagatcacgaggtcaggagatcgagaccttccagctaacacagtgaaacctcgtctctactaaaaatacaaaaaaaattagccaggcatggtggcacgcacctgcagtcccagctacttgggatgctaaggcagaagaatggcttgaacctggaaggcagaggttgcagtgagccgagatcacgccactgcactccagcctgggcgacagagcaagactctgtctcaaaaaagaaaaaaacaagaaaaactttaggatttaaagaatcttataattgctttgtgagtagcacaatcgcctggagtgggacccacatgttattgtataatgcaccgattaaaattaagtgccgagttaatgataaagcaggtattttgaaaattgtgtaatacctttttgttaggggtagctatgatactttttaatatttttgttactgctgtttgttttgttttaggtctggttagaaagtaaaacagaggttagaataagttgtctgggaatcttgtggaaatactgacatgtcagaaaattactcttcaaatcactgagtcaagaaagcaaaatgcaatacaatttctctggacccactgagccaccacgcctgtttttgttcactgagaacaggtttggtgaccaatggggtcagtggcgttaattggaaactgcagactactgcctcacaacctgcacgtgtccttcacagctgatttctgagcgaagatgggacattttctcctacagttatcctttggcactggaagttaagccttgttattacgtgtttaatctatcttagaataaggaatataaggtatgttaaatggcataaaaatagtaaacctaaatctttaaaggttggaagccaaccttgtacaaacctctggtgtaaaactctctgcttatttatggaagaaaggcaagaaatgcgaaaacaggtgaatggagagctatacaggcatggcccaagcatgtgctctggttctgcctggctgcaagacctgggataagtcacttatcctctctaagcctcaattttgtcatctgtaaaaatggaaagcataataattcataccgtgtggagttgctgggagaactacaagtgataatacccatgaaacactttgcacatagaaatccccataaatgttcatcattcttatggcatcctcatcatcattagatgtgctctgtctcagaggtgactctttcgtttacaaaacattaagagagacccctcaggatgcagctccctaagcaagtaagccagtaatcacgtgttcctctgtgagctgtacctccacattcctaagaggctcttggagtgactgagagatctgtgacacctgaatgattcacacctgcagtttctaggaaccccttctccatacactccatggttgtcaaataatcatatatttattgaacctgtactgtgcacaaagcactgtgctaggtatgtgacaccagggatagattctttgctccaagaagctcatgatgaagataaaacaactgtatgaagagaaaaaagaatcatccagggtagtttatgctagatgccagatgaatctaaagataaagagtagaggctttcagaaggggagagatgactgtgatgggagagttgggagccttcggggaagatgtatggttcaaagtgggttttcaagaagatgtgggtctcaagtaaagaaaggagaaaagtaggcatgtcagaaagacacagagatcaaagcgacaagaagaccaatcagagtggagtagaaaggtgctctcaaagtatagtcccagaacagcagcctcaggattacctgctcaggctgtcataacaaaatacaaagactgagtggcttaaacacaaaaacttattttccagttctgaaggctgggaagtccaagatcaatgtgccaccaattccatttctgatgagggctctcctcctggcttgcagacagccttctacttgctgtgtcttcacatggctgagagagagatcctaagttctctggtgtctcattttataaggacactaatcccatcaggccagggccccaccctattacctcatttaaccttagttatttccttagaggcttcatctctaaatacagccacactggggattaggacttcaacaaacgaatttgggggagataccaacattctatctatagcacatggaaacttttcagaagtgctaaattttgggctttaccctgaaactactgagtcagaaactctaggagtcgggctcaaatatctcttttaatcagcctttttggtgctgctgagtttgagaaccactaaagagtcaatagggcaagtgaatggaggggagatgaaagaagtagattgtcatcagaacttggagaattttgaggctcaagaatgtggaggctggtcttagtcagtgggagacctagaaggagaggaggtcatacaggttagtgtaaaccatttattttgccatctgtttgtgggagaaaggggaggaaggaaaggaggagagaaggaaagaaggaaggaattaagagaaagggaaggaaggagagagggagggaatgaggacgggaaagaagaaggccttttggaaaacagtttcatagttcaggtgttcacattctaagtatagtaatagcaggaatggagaaaagggatgaagatgataaatattattaaaatctacaggtcatgccagggtcaagcaagcaaaggagaaaggggaattaggtaacttgtagatctgtgcaacctaccactgacgaaagtgtggaagcttagacagggagctgatttgaggcacaaattcagttttatttatttgtgctgatattaacaggaggacatctaagtgactatgtctactaagatatgagatatagttaagagagtagtcagttctgcagctaaattcaggaggtgattcttgaatcctgtgcagcctttgcaagttctgaggaagggcgcacagtgagagaggataaacgaagtcacagagaaagccactatttcaaggaaagcaaaggcccagaatgagggtgaagatgagggcagagtaaatatcaatgatatttaaacatttttgctggttagctcctcaaaaggcctctcagtctgagctctgcagaagggacgtgtttgcaagtcactgtgagtcccctgggtaaatcagtgtgcctatgaactgggccaactagccaaaactgtgaattatgacgaccaccactactgttagcctgactccttgttaaacaggataatggttttcagtaccagctgaaacaattttaaaatgttgaccatttatattacttaagtaatgtgctaccatttataagtaatataaatgttggccatttatattacttaagtaatgtgctactgaaactctaagggggtttctgtaacggtaaactgacagttctctaatgcagttcagcatcacctgtcgggcttgtttgaccacagattgctcggttacactcagagtttcttattcagtgggtctgggtggggtctgagaatttgcatttataataagctctcaggcacaactgatggtgctggtttaggaaccacaatttgagaaccgttgttaagcctcacgccacaccattcctatcatgagagccacctgtagctaattcagggtaacttgttgactgcaaactataaccataggcagtttctttagcaatataaacctctagataaaagaaacactcaaaaatcagaataggaacatatagagtcaatgaaaactattttttttccaaatgagagcatgtgttttacagcctcaaaagaatattttcatgtagactgcactaaaataacaagataaacctgaaactaaagcttaaaaaggcctttatgaaacaaaaacagtttcacacctgaggtaaagggctacatatgtccctcgattttttctcatatcttagctttcatttaaatgacattgccattttacatataatagaagaacctagaaatttgattcctgcttattagggcaaaccaaaggggttatttccaattattttcagttcagtttttcttcacgtataatagaaatgatttaaaagccaggttttgttggaaactgccataaatgtggttaatagttgctgcctcagcatccattttcaggcctgacctaagttgtctgaagcccagtctcactgtatcacctctggtctgggtaacacttcccctccctgagtggttgtttgtaatgcggcccatttgctcttcatcgcactgacccagaacccacacatcacacagctgctgaccatgatcaaacctaacggccaacaccagagtcctgtgaataagtcctgcttcctacttgttctcttaaatcagcctaagccacacccccacgggaaagccccaggacaaagctccaggccctaactgtgctctctggctccccgtggcctccagacttcccctcgggctcctgccgctctctggacctctctgggatgtgtaagtaagagatttcttctgttcctgcgttttggtttcacctcctccttgtgcctcacctgactgacaccctagaacctacctttccccttggccagggctctcctggagattggctggtttctggccccctccaaagagagacctgaagaccaaattaggaacctaaatatataaatcgcaacagaaagtttggttgtttactgacaatatatatttatactgtaaaatgtgtttatgatttagaacacactagacctattctagctctaaattgcattgctatcttgtagtatgcagttatgcctcgtttcatttcattttccaactgaagtcattttattccctcagtttataaatacctcgaattctttagccgaaaaggcaaggtaacttgatagagcatccccctttgtgaccataacctccagtgcagaacaaattaaacgtgcaaaactgtgagtgccatgtcctacattgttaaagaaaatgatgttgaaaggcagtgaaagtccttatgaagaaattcaaaagagtaaaagaatagacagatgaactggaaatggaagaagtcagtttttctttcctttaggagtaagccaatttggaaactagctggtaagtgttacagtccatttacatgacaggcattcttcgtattcactaagaaaacattatggtacaaatgttcactgtgcagagcacacctgtaatatttcatctggtcctctcagtgaccctataaggaaaatgaaacattttcagatgagaccgggcttcagggtgaaattaggtgacgggtgagacttatatagagagtaagtggtggaactggattcaaatccaaattcttccaactgtaagcacagggcattttccactaatcagcccactaaccaaagaaacctaatttttccaaacatttaaagtgatgctatggccatttgagtaaaaccaattttggcctatacttttgattccccatcaccagactaccattggttatccgatatgggcagcagaattaagaggtaatgaagtctaatagaacctctcattatttgtgtggatgcagtagtaacagagatggtgatatagtttgaacgtttggcccctccaaatctcatgttgaaatgtgatcctcagtgttggaggtagggcctgctggcaggtgtttgggtcacggggcagatccttcatgaatggcttggtaccctcctcatggtaatggctgagttcttgatgtattcattcactgagatctggttgttaaagagtgtggtactgcccccgtgtctctcttgcttcctctctcaccatgttaggtgccagctccccctttgctttctgccatgattgtaatctaccttaggcctcaaaagaagcagatgctggtgctgtgcttcttgggcagtctgcacaactatgagtcaaataaccctcttttctttataaattacccagcctcaggtattcgtttatagcaatccaaaatggactaatacagatggggacatgtaggtattaatttaacagatgcttatatattgcctgtattctcactgggactgggaagtgttagagaaatataaatgaaaacataatctcctcctaacccggaaaacttctccacaaaggtagaagagaaagaacacagttttattgagtaagcattaaaccagagtgagatgcacgtctcaggaaatcagctaagaaattgcaaagacagaaaaaaatctcacctcttaatataacaagcagatataaccttttatatacaaattctcaaggtaaacaataacttgtcctcaaggggactttacagcaccatttgtcaaacaactttcatcctaaattcccttagtaattggggtaaccgtctgtgttagacaattggctttatccaaagcaaaaataaatttctcatatctttataaaagggggttgtcttgcaacttggagtaagatacctgctgaaattaccctcctagcctcctacagaacctgataaatagagctgttatcttccttgataattttcaaagtgatgattccctggtctttgagaacagtatccttgggtcttaaaactagcaaaagactaagttagcttttaaaaatttttgtatatgtttcaaaatgacaaagaggtacaagctttctaaagtaaataccctaagaaaaggatgtttctttccttacttttaacatggagaacatattagtcatatattccttataggcttcttaacaaaatactacagattgggtaacttaaacaagagatatttattccctcacagttttcaaggctgaaagcccaagatgaaggtgccagtgggcttggtttttggtgagattgctcttcctatcttgcagacagttaccttttcattctgttctcatggccttttccccgtgcacagggaaagagatctctggtatctcttcctcctcttaaaaggacaccagttctatcatattggagccccatccttgtcacctcatctaaccttaattaactttttaaaggccctttcttccaataaagtcacattggagggtggggcttttacaaacaaatttagggggagacaaaattcagtccataacaaagagttgagcttcttatttttagttggcatttgcccttacaggaataacaagccaggctaagtccttgtcatcatgcagatgcaagtaatgcaagttgcaagtaataatcaaggaaataaacagtgatgagtgaaggcccttggcttaaggataagaagaaaccagccagctcctggttagccagggagtaaatcgttgcattcctgataatttggaaaggaaagagctagaaaagtaaatttatggaagcaggatcatccagataatcaatgatataactaagctgtacagactgttaggccatcaatcaatatttaccaaattccacttacacattcatttattcatatactcaacatttaatcacccctagattcattttatgtaccaatatggctgaaaactacccagataatgtttttccttccatcacttactaccaccatagattttatgaaattattaattaggtttcaacttagatttcaatttcaaactgttgtgtcatgttgattttacacaaatacttataaggtgaaatgacagaattttatgaaattattaggtttcaacttagatttcaatttcaaactgttgtgtcatgttgattttacacaaatacgaggtgaaatgacagaattctcctcctaccaggacagttcacaaaacccgtgaaacatttatatgactgaagcttcttcatatgtgctcagagtctattgtaaggaaacagttatctgcatgtcttcccagtttttaaaaaccaccaccaactaattcatataatagaactcactcaaaataactcaaagacagtctggacaaaatagagatatgatagtttaaaagataatgtagtcgtataacttccacatatagatagtaaactcacaactaaggagtttgggaccagccttcaggacctcagtactccactcttctaatgtatggtcattctgttggtagagtggattttcatcactggaggcagatgttacactgctcctcccctctggcaatcagacttggaggaaggcaagtgaaggccaggtgagaatgagcctccacccacctccccatgcccagccaactctctgattctctaccttgtgcatctcctctctacacaaacagcaaacatctttttactttattcagtcaaataaaaggtagacctcttcatgtaagatactgacatgttcaataataaaatatttgaagttaagttagatacattttaatgactaattgagtcatatttttaagaaataattattcactgtgcatttgttatgccaagtttcagatgagactaacattggccctgggcacaatgcatgggtgaatcattttagtctcaggaagatgggttttgtatggtgttctgtattaggcataatcacaaggtagattggagagtcctagataagatgatagagaatgggtaggacacccttcccctgaccagcagactgctggttgcatggtgaagctctttgttaaccttggcttctgcctctctagcttcccatatggttcattaatagcaatggggcacaacccattatctgctgaaatgcaacagaaatgctgatacattttcaatttatttcctgaagtaaattgaactttccccttaaatatggtcacattattaattactttaaatctcagctctgccacttactacgtgtaacattaagtaatttaacttatctatgtctcattccctcatctgtaaaatgaggttgacagtagtgtcccctaaatgtggttggtgagaagattaaataaatcaatatatgtaaacctcctagaacaatgcctagtgcataacaaatacttcatagtaaattcttttttttccataagttattggtatacaggtggtatttggttacatgagtaaattctttagtgatttgtgagtgtatactcacccaaggagtatacactgcgccatatttcttgtcttttatccctacccccttcccctcttcctcccaagttcccgaagtccattgtacattcttatgcatttgcatccttatagcttagctcccatatatcattgagaacatgcaatgtttgattttccattcctgagttgcttcacttagaataatagtcaccaatctcatctaggtcattgcaaacgctgttaattcattcctttttatggctcagtagtattccattgtatatatatacgagtttctttatccactcgttgattgatgggcatttgggttggttccacagttttgcaattgtgaattgtgttgctataaacatgcatgtgcaagtatctttttcaaataatgacttctttgcctttgggtagatacccagtagtgagattgctggatcaaatggtaattctacttttagttctttcaggaatctccacactattttccatagcagctgtactagtttacattcccaccaacagtgtagaagtgttccctgatcaccgcaatgacaccaacatctactgtttttttatttgattatggccattcttgcaagagtaaggtggtatcgcattgtggttttgatttgcatttcgttgatcattagtaatgttgagcattttgtcatatgcttgttagccatttgtatatcttcttcttcttctttttttttttttttttttttttttttgagactgagtctcactctgtcacccaggctggagtgcagtggcacaatcttggctgactgcagcctccgcctcctgggttcaagtgattctcctgcctcagcctcccgaatagctgggattacaggcacatgccaccatgcccagttaatttttgtatttttagtagagacaggatttcaccatgttgaccaggctggtcttgaactcctgacctagcaatccacctgcctcagcctcccaaagtgctgggattacaggcatgagccaccgcgcccagccagccatttgtgtatcttcttttgagaattgtctagttatgtctttagcccactttttcatcagattttttttttcttactgatttgagtttgttgtagattctggatattagtcctttgtcagaagtatagattgtgaacattttctcccactctgtggattgactgctgactgttctttttgccatgcagaagctctttattttagttaggtcccagctatttatctttgttttcattgtaattgcttttgagtttttagtcatgaaatcctatatataggagggtttttccaatgttatcgtctagaatttttatagtttcaggtcttaggtttaagtccttaatccatcttgagttgatttttgtataagatgagagatgaggatccagtttcattctcctacatgtggctagccaattatcccagcaccatttcttgcaaacggtgtccttttcccactttatgtttttgtttgctttgttgaagatcaattggctgtaagtatttgggtttatttctgggttctctattctgttccattggtatatgtgcctatttttataccagtaccactctgttttggtgactatggccttatagtatagtttaaaatcaggaagtgggatgcctccagatttgttctttttccttagtcttgctttggctatgtgggctcttatttagttccatatgaattttagaattcttttttctagctctgaagaatgatggtggtattttcatgggaattgcattgtatttgtagatggcttttggcagtatgctcattttcacaaaattgattctaacatccaggagcatgggatgtgtttccatttgtttgtgtcatctgtgttttctttcaccggtgttaagtagttttccttgcagaggtcttctgactcttttgttaggtatattcctaagggtttgtttgtttgtttgtttgcagcaattgtaaaaggggttgagttcttgatttgattctctattttgttgctgttggcgtatagaagagctactgatttgtgtacattaatcacatatccacaaactttgctgaattcctttaccagttgtatgcgctttctggaggagtccttagggtttttaaggtagacgatcatatcatcagcaaacaaggacaggttgacttcctctttaactatttagatgtcctttatttctttctcttgtctgattgctctggctaggatttccagtactgtgttgaagaggagtgctgagagtggccatccctgtcttgttctagttctcagagggaatactttcaacttttccccattcagaattatgctggctgtgggtttgtcatagatggcttttattacattaaggtatttcccttgtataccaattttgtgagggttttaatcataaagggatgctggattttgttgaatgctttttctgcatctattgagatgatcatgtgatttgtgtctttaattctgtttatgtcatgtatcacattttttgacttgtgtatgttacactatccctgcatccctggtatgaaacccacttggatcatggtggattatctttttgataggttgttggattcggttagcaagtattttgttaaggattttagcatgtatattcatcaaggatataggtctgtagttttcttttttgtgtcctttcctggttttggtattagggtgatgctggcttcacagaatgaattaaggagggtgccttctttctctgtcttgtggaatagtgtcaaaaggattggtaccaattcttccttgaatgtctggtagaattctgctgtgaatccatctggtcctggactttttttgttggtaacgttctaattatcatttcaatctcactacttgttattagtctgttcagggtatctaatttttcctgatttaggctaggagggttgtattttgccaggaatttatccatctcttctagattttctagtttatgtacataaagttgttcatagtagccttgaatgatcttttgtacttcagtcatgtcagttgtaatatttcctgttttgtatctcagtgaggttatttggattttctctttttttcttggttaatcttgctaatagtccatcaattttatttatctttccaaataaccagctttttttttcatttatcttttgtatttttgtttgtatatttgtttcaattgcatttagtactgctctgatgttggttatttcctttcttctgctgggtttgggtttggtttgttcttgttttttagttccttgatgcctgaccttagattgtctgtgtgtgctctttcaatgtttttgttacaggtgtttagggttatgaactttcctgttaacaccaccttagctgtatcccagaggttttgataggttgtataattattattgtcattgagtttgatgaatttcttaatttttatctcaatttcatttttgacccaatgctcattcaggagcaggttatttaatttccatgtatttgtgtggttttgaaagttccttttggagtttagttccagttttattccactgtggtctgagagtgcttgatataatttcagttttcttaaatgtattgaggctcattttatggcctatcatatggtctatcttggagaaagttccatgcactgctgaatagaacgtgtattctgtggttgttggatgaaatcttctgtatgtatctgttaagtccattagttccaaggtacagtttaaatccattgtttctttgtcgactttctgtcttgatgacctgtctagtgctgtcagtggagtattgaagtcccccactattattgtgttgctgtctacctcatttcctaggtcaattagtaattgacttataaaattgggagctccagtgttagctgtatatatgtttaggattgtgatattttcctgttggacaaggccttttaccattctatactgtccctttttgtctcttttaaccgctgttgctttaaagtttgttttgtcggatataagaatagctacccctgcttgcttttggtgtctttttgcatgaaatgcctttttctacccctttaagtttatgtgagcccttatgtgttaggtgagcctcctgaaggcagcagatagttggtttgtgagttcttatccgttctgtggttctgtatcttttaaacttagcatttaggccatttacatttaatgttagtattgaaatgtgaggtactattgcattcatcatgctcgttgttgcctgtgtactttgttttttgttttttttttttttttacttgtatttttgttgtataggtcttgtgtaatttatgctttaaagagatttggttttgatgtgtttccaggatttgtttcaagagttagagctccttttagcagttcttgtagtgatggcttggtaatggtgaactctctcagcatttgtttgtctgaaaataactatctctccttcatatatgatgcttggtttcactggatacaaaattcttggctaataattgttttatttgaggaggctgaagataagggcccaatcccttttagcttgtagggtttctgttgctaaatctcctgttaatctgataggttttcttttataggttacctggtgcttctgtctcatagctcttaagattctttcctttgtcttaacattggataacttgatggccatgtgcctaggcaaagatcttcttgtgatgaatttcccaggtgttctttgtgcttcttgtatttgcatctgtccaggtttctatcaaggccagagaagttttcctcgattatttctccaaatatgttttccaagcttttagaattgaattattcctcaagaacaccaattatttttaggtttggtcatttaacataatcccaggatttgttcatattttcttacttgtagaggctttgttcacattttcttattctttttgtctttgtctttgttggattgggtttattcaaagaccttatctttgagctctgaatttctttcttctacttgttcaattctattgctgagacttttcagggcatttcatgcttctaaaagtgtgtctaaagtttcctgaatttcttattgttttttctttgagatgtctatttcctttaatatttttcccttcacttcttatatcattttttggatttccttgcaccaggctttgcctttctctggtccctccctgagtagcttaactaacctcctgaattctttttcaggtgaatcagggatttcttcttggtttagatccattgctggtgaactaggtgattttgggggcatgttgaccagtcttgttttgtcatattaccagggttggttttctggttccttctcattggcataggctctatcagagggaaggtctagggctgaaggctgttctgatttttttgtgccacagggttttcccttgatgtagtactctccccattttcctgtggatgtggcttcctgtgagccatactgcagggattgttgtctctcttctgggtctagccacccagtgagtctaccctgttatgggctggtactgggggttgtctgcacagagtcttgtggtgtgaaccatctatgggtctctcagccatggataccagcgcctgttccagtggaggtgccagagggtgcagtggactccatgggggctcttagctttggtggctgaaagctctttttttgtgcgggttgacctcctgccaggaggtggcgctttccagaaagcatcagctgtagtagtgtggagaaggaccattggtgggcgatgccttagaactcccaagattgtactccctttggcttcctgctaccagggtgggtagggaaggatcatcaggtgggggcagggctaggtgtgtctgagctcaagactctccttgggcaggtcttgctgtggctgctgtgggggatgggggtgagagtcccaggtcactgaagttgtatacctaggaggattatagctgcctctgctgagtcatgcaggttgtcagggaagtgggggaaagtcgaccgtcacaggcctcacccagctcccgcacaaactgtagggccggtctcacttccatcatgccccctgcaacatccccaagtctatttctaggcagagggcaagttgggcttgaaaacttgcctgaggctttccatcttccaggttcagcttccacagtagggatgtgtgttcgggaaaggatgttggggaaaccagccccacaccacccagtgggtaccccgagtccagaagagacaaaggagttagagacagaataagtatccaaaaggcgggtccaggggaccggagcatcggaggcttgctcacggcccagagctcttgggctctgcccaatttattggtttacaagctctttgttcttagggcagatggaaggaggaggaagggatgaggaaaaggattaaacagtgaaggagaatttgtgagtcattcgataagatgtatagcagtggtggtttctgtgaatttccttgagcaaaggcatgtgtctaaactacttaagatctttaacttatcgggactgatacaggtgggagtgggtttcaggaggagcctagatgtttgattatactccactgcttcaagggagtgttatctccctgagcaacctgtggaatgccgttatgctctcggggcctaaggacatgaaggcaataaggagacttttctcctcagaggccacccatggcttcccatgggtgtctcacacagggaagaccaactcaactggcaccccagaaactctctttcccacaaaggagggtctcctttttctactcccaaagatgcagcactcaaagtatttggggtgtcgcccggtccctgcagccgccttccttcagggggtctgtggttcctctcaggattgctggtttgttcttgcagttcatctggagctaaaattcacagtgcaagcctccacaggctgctgtgtctgtggctgcaatctagtcctgcctctcgtttgtcttgatccataagtagattcttaattatggaatttgtgattattttgtttaagttatctaaggcaattgtgttcagatcttattttgccactaaaactacattggaaacacattccctaccacttgtgctaagagtggttttagtgatgcaattgcatgaaagtttctccagaaataattcagaattcttggacagcttctatttgtttaattctttggcttatctggacagattcgattttccaatgaattagacttgatcttttatagaaatgtagccaaataattgaaaagtaattttccattcattatactagttactcaatctcttaaatgattacatgaagtagataacatatttcttcaaagcataagaaatattacatatgaaaatgcctttaagaatttgaagaaaaaaaaaagtcttcaataggagttttggttgtctgcttgggcttggtttgaatgttttaacgaagcttattggtatttttggtccaaaacccagcatgactgagtcaagttgaattggacagggtttgagctactgaatctggaggttcaaaccagaaatgtgttaagttccatctcagaggttatctttatcagaaagttgtatttttttcatggcatataaatacgcttatcccaactgtgggtgttttttctaccaaaagtgctacattaaaaagaatattttctatatcacatgccaaacatgcctccctgtgaattttagataactaatttcccgcaaggaaggtgactatggaggccagctttgttgtttttacttttgtgggattttcatctaggaattggaatataaagagtatagccatgatgcaaattgaaatgactgtaagtcccaggcttgctttgaggagttaccctctgataagcatatgcacacacacgtacaacaataactcaagaggccaaatgagagcaccactagggtcaaataagaccataatgggaggcattgcacaggcaggaggactggggatatcatttgaatattttgtcttttccaactcgcatgttgacacgtgatcccccagtgttggaggtgggatctagtgggaggtgtttgggttatgggggcagatctctcatgaatggtttgctgccctccccatggaaatgagtgatttattgctctattagttcacatcagagctggttaagagcatgggacctcccttttcttttgcaatgtgacacagctacttcccctttgccttctaccatgaataaaaactcccagaggtctcaccagtagctgagcagctagtggtgccatgcttgtatagcctgcagaactgtgagccaaataaacctcttttcttaacaagttacccagtatcaggtattcctttacagcaatacaaaatggactaacacaactgggaagtcccatcttcaggaagagctgttcccaatctttttggcgccagagactggtttcatcttgggcagtttcatcccaaaactcataaggagtgcacaacccagatccctcacatgcgcaattcacaatagggttcatgttcctgtgagaatctaatgctggctgttgtgacaggaggtggagctcaggtggtaatgctcacttgcctgccgcttatctcctgctgtgcagcccagttcctaacaggccacagaccggtatcattccacagcctgggggttagggaccactgctcaggaaggtaagagccaagggcaatagcagcgtgccagcgaagaatcctaccaggtacgttaggagatagcttaacacctttggaatccagggtcctctggtaggaagatattccaccgaacctacaggccaaagtttctgtgcatgtaaggggtttattttacttagcccagggtctgtggtcctctgcttatgaactccagatacgtctggggtaagacatggaaggagagggaagaatgttgggcatggagaatcatccctgagacaccgcaaaaggggcaagagagtacccgctgtgtaaaacataataattacataagaattaaattttgatctttttcatagactggtaacctacacgacacatactaagaacttaaaatatttgagtaaataaattagtgaataatgtattaacacatagtatcagagatcagaggagactactaacattaatgatgatttcaggtgttaaagcaatcacattatgtacaatttttattgagtgtctaaaaatacatcatatccagctaataatataaacaattttccagttatacctaatactcatggagcacagtaatgactttttcaaaattgaggcattaaatgtattccagggatacaaactttgtcttaatattttatgagcaaaataattattggagctacctagcaaaggaatatgatgcctattttagatgtttacatgatagaaagcagtcaagctttaagactggtaaaaactttccaggcatattgtagaagactcctacaatgagtgaaagattttaacctctaaggtcctttattttgtttttgagatggagtctcgctttgtcgcccacgctggaataccatcttggctcactgcaaccttcacctccctagttgaaacaattcccctgcctcagcctcccgagtagctgggattacaggtgcatgccaccacacccggctaatttttgtgtatttttagtagacacagggtttcaccatgttggccagactggcctccaactgctgacctcaggcaatctgcccacctcggcctcccaaagtgctgggattaccggcatgagccaccgcgcccagcctgaaggtcctttttttaattctaaaattccatgacactgctttgggatttaaaaaattgagtgaaaacctgtccatatacagagatagttcgatgctctccagaggcacatccaggcacagcacataggatctgggtggaataaacttctgttgaatcaacctgaaggaagcagcactggcatgtgttgaggtttcctaaaagaatgcaatttgtattgatttagttcaagcactgtaaagtttaagttgtaaaattggagtcaatttctattaatttgatgatataacttttactaagcattctcaattttccctctttttaaaagaaaaattggctgtttccatgtcagaaaatacttgaagcaaaaagattaagctctgagagtttatataaaaacattcatgcacttgtcatttagcagacactcagaaaatgttagctgtattgtactgaggcacaaatacgtatttgacaagagtttgttttccttcaataacagtaggagtatttgttttgtttatttctgtaaccttggcatctgatgctcaacaaatattaaatgaaaaatcaattgtgctatggtaaaataatataataaaaagctattctaatcatattctacttttccctacttaatttctcataataatcaaacatttcagtaatagctcattttattttagtaaatatatccatattcatgatattatctggtcacacatatataggtagagaaatatcatcattcccatctggtcacacatatataggtagagaaatattatcattcccatcttaccaatgaagagaaacagaggttcagagaggttaaataatcacattagtaactagaatacaaatccctgcttcaagattccacgttcaggacattttctaataaacatgagggtttatgccagcttcagaggtacagatcaagaaaagagaaagcctgaacaatttcttctgcatttgatgcctttttgctttcttttcctttgagtttgtgtcttgtacaagcctgcagtgtaatctctatttcttcagtatctgcttgcaatcattgttacatttttatgctatttgtggataaaaatggtaagatctatttctttcactccagtaagactatccaagtttccgaaagtaagatttttccaacgatatttgttcattatggatctagggcactggaggagcctcaagagagccattgttcctgtagtagtgaaatgttccaactacccgaaacacatggttgtctagactgtttttaggaatttcctttaagtagcctacttcagtggttagttgtacagtgaaaaattcctccccacatacagacaaattttctctgggtctgtgtgaagcctattatgtttctgtcttctatggaaatgaaggacatctgcttcttttcttcttgagtagtacttataacataaaatagttaatggtctcctcactcttctttctctcgcacctcttcctaaccattgaaagtaaacttgaagagaatgataattacctaggcacttaagttagaggcattggaaagattaacttcttctcttgcttttgtagtaattgttttgaatacttttgtttttttaggaagaaatttcctaggtctaatatagcaggcatatgaccatttattaacctcttatatgaccaggtaatttggaacagagagaataatgaacaccattcctactctccagagtagtttatgatctaatttgtcagggcataataaataagtatgggacagtgagagagtgatttcatggtagcacatatttgtgtcagaacgtggtaggccctggactgtgccttgatcttatcaaagtgagacctctctaaattcctcaagagtagtgttatctagggaacactgtgtagaaaagggctatctagggagggattttaatggaggcatatgatttcgggatgagagcatttttccatgaacagaaaatggtatcaccaaaggcaaagatgtaggaatgagcaagctgtattcagagtataggggagcaggccagataagctggagcagaaggtccaatttgagaacaagatgagctcagctagattaagttagattatagggggccttttagattcctttgtccctatggtactgacctattgctaaatgcacaataattgtcagatgtgaatacacattataattcacttttttggtaccttatttttcaggtatttattgatcaataacgtgtctgaattatggattattctcaccaatcagtgtttgttttttatctttcttatacaaaataaatattttatctttgaaaacaaagctttcataccttaagaaaaccccatacatagatcatttattcattcataggactaatgttaactgagtgtccatcatggaccaagcaccaatctagatgtggatgatatagcattggatacgtaagcccatactctcaggtaatctatagtctaatgcatgggtgtccaatcttttgacttccctgggccacattggaagaataagaattgtcttaggtcacacatgaaatacactaacactaatgatagctgatgagccaaaaaaattgcaaaaaaaaaatcattgttttaagaaagtttacaaatttgagttaggctgtattcaaagccatcctgtgccacatgcagcctgtggcttgagggttggacaagcttgatctaatgggttaagctagagtaaacccctacattctcacaattctttagttccaaagaacattcaacatggcatgcaatgaatatgagtaaaataagctaaataagcaacaaacatgttttggtgacctatataccaggaactctttgggatgccgcagggaatccagagggtaatagggtctttaatgtcaatgagaagataatctcctggtgcaagaggccacaaacaaaatgacttaaaacctaagccagacctacaagaatattacaggaaagtgctgtggtttagaggagaaggagagcacttgatggtaggactgagaagaccctaggggaacaggttagggagctttggtaggatctgaatagttaccaatacacagaagaaaagacagacacaaaatgtgggcaaagtggtgtagaaattgtcttacttgaatcagaatcttgcataggctaataaaaattaactttgactctgtcagcaggaaaaagtatgcaagttctgatgatcacagagagtacaagactttctctgttccttatccatatgcttttttccctttggggacctggttgactggttcggacatccatctccctttccctgtcccccattccaaaggagttttttcactaaatttagcaacaggaagaaagaagtaaaatcatccaggtgccatccttagggtgactgccattcacttaagaacatgtttctcctcaaagtggaaatgcagaagcaggcaaaggtaaggaagtactggggaagagcatggcctggtctctgcaatctgtcgtagtgatttccagtctctcccacccactgccccatctgagaacaatgggaggattgacttgcactcccctcttacttccctccctctgtgagcccacagccagcaacccagtcctcctgtcttgccctcgctagctcctcccttggccattttattctggcatagactgaacaggcaaatatttcttcatcaattagcagctgttgaaaaggaatgagctcctgaagggcctctgaggaccaagaaagcatccaaagaaagcaaacctgtagtggtttccatggagttgtgcagcctggaggtagaaggggataactttatttcggaaacaatttaattaccctagtagcttgtttacacactacgcagagtaactaacacaattgtttctaattcttggagaacaatagatgaatttcactgggctgacagtgggacagagtgagaacaagaataggaagaaaatcctctctcacacatacctgtgccctccttactttcatggaagtgagaaacagcctttcagtggccaccatagttctaacatcaaggagctagaatattttaatatttagagatgatcagtagattatatgcttttaaatattctattttcattttaaaagcatgagcatattttagaggatgctctaagttttctttttattttgagattattaatagatcttatgtttaagtattttaacctttattgtaacatatagcacagaacaaagagccacatagaacaagtgtaaggaccacaaaagtcatcaaagaaaactttgccagtcaccccagaagttcctccatacgtctcatcagtcacagcccccaccctccctccaaagtgacttttcattgtaatcaattctttgcatttcttgatagtttttcatgcccaagattggatccttggacatcagtttcacttgttcattttcttttaaacgtgatgtcttttaaagtccctttcagtgtgattccacatatccttctgtgttcctgcaagttggcctctgtgtctggagactggactcaggtttcatccttgaggcaagataataggtaggatcagtggggagatttcacaaaggctctggtgcatctgtttagtccttcctccattcccatgtgcctcttccacatagacaccagtcacacaaagaactcttagctgtttgtggcatctctggcataatcctgttttgggaatcaaggagttaccttgacacctgtctcatggtaaatgttttccttgggtttctggcctcaataagtaattgctttgtttgtctctgtgtggatttgggaggatccaaaaattaggctgccatctctcacacatcttcctagaattctgtgaagtatgactctcttttaatcatattgaatgcattttgaaggtattgattcctcaattattgatgagaaaaacacttgacacaaatcactttactggcagcttttgaagaacacaccctgtatagtgaaagatgcttatctggttgttcattattccacagttaaattgctgccagaactgttggtagcactgcattcattcttagatatatatagaaaatcacttgtttaatactccagtgtggatctataagcactcccacccctgaaaccattcacatgtggataggaaaaatatgaagaactggccaggcacagtggctcacacctgtaatcccaacactttaggaggccaaggcaggcagatcacttgaggccaggagtttgagactatcctgggcaacatggtgaaacccccatctctacagaaaaatacaaaaattagccaggtgtagtggcaggtacctggaatgccagctacttgggaggctgaggcaggagaatcacttgaaacgggaggcagatattgcagtgagctgaggtcgcagcactgcactccagtctgggagacagagggagactccaaaaaacaaaacttctgtctagatagactttattgaaagcttacacctgagcacggcttttctttttttttcctcctacctgactgagtgcagccttcccactctttgttaccaatatctaaatgttctttcccacttattcagagcctgtgatatcctctggtttcacatgcctggtacacggttttccaggccttgatctgcctctgacgctttcaccctcagcttgttgatgtgagagctgaactcatgcccatttctttttggaggtggccttttcttcaccctacagtggactggttggtttctgttgtcatccatgtcctagcattgtgtatatcacaatgtggtctgatgacactgtcacatgtcatctaaaatttccaaaagtatgagttaaagaatgtataatttcccaccacatagatgaactaaaatatgtttagttgtgcatctaatacctgtagtttactttcagtttttccgttaagaaacacaacgaagtttgaaattacttttttccttaaaccaggaaagaaagaaagaaaacaaaagaaaaacagctgtaacacctctgagtttaggtgcataatttattgtaaacactttattttgagaggggcagttgcagttttgggggatcactgatacctctttcctcaaggggctaactttcctggggaactccctgcttccagtaaaagctccaattctaaatattgattccagaaaataagaggccacctctgtgaggccagaatccccactggtcttgtcacctttacagtcagcaattcctctaagacctctttatttctggtgggataatatttccacttgaacacctctttccagtgccagcacagggcaatactgtgtcagcagtgttctggaggactctgagttgttcagatgttgttactctgacagggcattgaaaaggaatgctgtcataatagagagcatgagaaatcaaacaaaatggagttctcctcatgcttaaaatgtagagtctaaaacctaatgaatggtctggacccagacctacctaattaacaaatctgcacttccggcacatgtaccctgcaacttaaaaaataaagtacaactgggggaaaaaaacagctctgttctgtgttgagatgggtaatttcctcatctccaaaggatgctgcatcagcaggggaactcactgggagtttattcccagcttggagttaggattcactgcctgagacgagaaacaagacctgctgggtagtaaagctggagggagaagtgatcagtgggaagctcacaaactggtaaacagtggccccaggggagggtcaaacaatcagcaaccaatttgtctgaatggcccgttaatcagtcctagctggatcagacagctgagttctaagaggggccacagtgccatgtagaatcactgaaactgcttttaagcttagcactctgagccaatccccagtcttaatgaggtgctcttcctgtgtgcttccagtgccccttatatttcctatcatagcacagatgccactggattttgtttacttatccttccacaagcttagaagctctcaaaaatactcttttgtcttgctttggagcccccatacttgtaggtcttaaccttggctgcatatcaaaactacctacagcccttttttaaaaaaaatgtagctgctggagctccacttccaaaattctaatgtaattgtcctggcatggagcccacccttgttttaaagttcctcaggtgtttccagtatacagagagggtgaggaatcatcctaaccaagttttaatgcttgaaatgcaggtgcccagtgaatgtttgatggatgatgactgagtcagtcctggattcagtcaaccaggatgcagctagaagacagcaggatctggtcaaacctgtattgctcgatcgcttaaatgctttgcgagcaatatgccatgaaggcaaacttcataacattttctctccgtataaacatcattcatggacattaggccagtgctacttgcaactatggatgacaagcctttgcaaacagggaaaataaactagagccaagtgttataccctgggcagagcactgtctgcctctgccttctttaagaagccaaaggcatccgtgtgtaaaaccattatatgacattgctaggctactcctgtttcccacttctggtgagaaagactttgcaaaatacaacaaatctgtctttggctattggtttgttattgttattaaagtataaaagaaaagtacaattagtgagcaaacattctattacttgtcgttgtagcaagtcatcttagattctatattacatttctctgaagttgaatcaatattttgcttttcagcacagatttctagcaagggcctaagacttggaatcttattgaaaatgacagaatatgatatgacaaactttgcaaagctttgcaagatttcacaaaacaaatttataacttgaaggaatttattttaaaacaaatttaagatgcatgtgttccatatttaatcagtagataacttcaaaggtcatgatgatcctataaatcatttgtgggtttcttaggggaacctagggagtcaaacttactttgtcatttagttagccttaatttttaaaaagaaagaaacttgagctatgcaagtgcattacacaaacccagagtttcagagcaagtacgcattagagatgttaaccaccagtgtttgacgatttgcgtgcggtgaactaagtgctttacattgttcaatcctcgtagtaccataaaaggaaaaaactatttcatttttccaatgaggaactaagagttaaagagattaaggaattgctcaaagtcatgctgagttaggagctaaatctcagtcttgagcatctgaccctacagcctgtggtgtcaaaccctctgctgtgctctctttctactgggaccaaattgagttgaaggtgctgcgttagccataggaattacatggatgaatgtggcacatactctgtccttagagagcttacaatttaccgaattggaaatatatgtattttgtatgcaaatgactataatcaaaatagaaaatactaagctttaaatgaattatacacagtcatggtttataaagagactatttcctgtggagaaatcagggaaggttttgtgggaaaaaaaattggcattttcatcagcttcaaatcttaaatttagttttttaaaactttttaaaaaattatgtaataaatttgacttaaatgagttggtatctagttctatgtcaaatcctgtgttatgaatgcaagtaatggttggtagtgacagatgtatgataccaaatagttgaagagtagaatgaattttaagaatgcgagagaatcttggtttgccagtgagaaccaagccacagatcacagggatatactaggccacagaaattactagaagccagtattttaacttcagaacactgtttcttatctctgtttctccatgcttgtttgtcctttttcagagtcagttcaatacattctttagaaagaaaaaatattattaatcctatcttctacctgggagttcctcagcacagtttgaatttaggagattgttagagtgaccgttcttgtagagaatacagtctttggaaattgagatctattttttattttttaaatgtttcagacaaggtattagtccattctcacactgctataaagaactacctgagaccatgaggtaatttatgaagaaaagagggttaattgactcagttatgcaggctgtacatgaagcatggctgggagacctcaggaaacttagaattatggcaaaaggcagaggggaagcaagagcatctttccatggcagacaggagagacaaagggaagggggaggtgctacacacttttaaacaagcagatctcttgagaacccattcactgtcacaagaaaggcaagggggaaatttgctcccatgatccaatcacctcccacccgttccctcccccaacactggggattacaattcaacataagatttgggtggggacacagaaccaaaccatatcagacaaacagtagtttttatttttgtgtgtttatttcataacttctcctcaaaaggaacatgctctccttgcatttatttgaaaaaacaaaaagccagtttctctccactaaacagatgaagttcaagatttttagaagacaatagcattacgggataagtcagaaaactgaaatcatgtctatgtattccaggtctttttccaaaaaaaaacacttatatttaagtttactataaacattaaatgagttgttaaaactaatgtaacagaaattaaatagatcatcttactcaaataaaaacaaaaagacgtaaaggaattaacatttataagcaccaaatatgtgttagactgtaatttcaaccagtgtcacctcattttgtcctcatgatcttgtgaagggagtgtgactatttccaaagataataaaacatgaatctcaggaatgctaaaatgattgcccagagcacaggtatgtggtacagccagaattcaaatgcaaatctttcagatcacaaaaatatcttccagtagagttatttatgtatatattttattcacttctctgaaggtacaggatgtgatgcactcatttttatttttgctttctcgtttatatttctcatcacctagcaaagtggcaggtttaatgtgttaacaaacaaatgaagaaatcatgtttgtttttagtctatattttttatatatttcagattccagattcttattcagcactgtgtcacgataaaaaacaaaatacactaaggaagaaaaggaaacactgagggtttattgcattataccctctgtttattgtatctgctgggaaatgaaaccatatatattctctatttctcttctgacaaatgttattcattctgttcattacagttccttatcttgctatactgtccttgctgaattatgttagattagaccaattattgatttaaaagatcagagcagtacattaccaccctcttgccttttctgtaggatagttaaatttgtgtatgcctgcttcttgcagagtggctgcttcaaagtgatggtgagagttacattttactatttcaacattagcttctaatgtttctgaagtctctggtattaaatgagttctcagccaaatgttctgaaccctgggaactactgctgttaattgtggtcatctcttggatgtgtttgcattgttgtccataactaagctgatttcttttcatttcattttttaatggctttttactgctgctgcttgagtattttcctgggtgagcattcttgattgattactggaatgaagtcagttctgtcttctgctgtcacccaggtaccaattattggatcactgtggacactgctccatctacccattgatgtgcattaccaattttcctctcaacactgttcagtgactcactcacatgctcacaaattcagcaatttgttcatgatagctgcttggcggggtggataatatcctggtcaaaatgactgagccacatcagtgatgtatgtattctccagacagggaaaccacagggttttaaatcaatgaactgaacttgtcatctatattttcctgctctagttttctggttctttttttatatgtttaaacattttaattaagtgctagatgtttgttaaacaattcagataatatgagagtgtatgatagcaaagctaatacactcagccaacaccatctgtgtgtattgtttattctcccagaccttcaatcatacatgtacaaatacttctttcttccccctaaaattgagtaatatgcatgtaattgtccagtctcatgctgctaataaagacatatccaagactgggtaatttctaaagaaaaaaggtttaattgacttacagttcagcatggctggggaggcctcaggaaacttacaatcatggcagaaagggaagaaaacgtgcttcttcacatggtgacaggaaagagaaatgctgagcaaaggggaaaaagctccttataaaaccatcagatctcatgataactcactcactgtcatgagaagagcatgggggaagtgccccatgattcaattacttcctaccaggtccctccaatgacatggggagattatgggaaccgcaattcaagatgagatttgggtggggacacagccaaaccatatcagtgcatattgtagtttttttttaaatagatcttatcttatatacaaaagagttccttcactgtttagtgtgcattcacagtatgtcatatgatatatgatgatgtactcactagtttactacttatagacatatcggttgtctttagctttttttttgagatggagtcttgctctgtcgcccaggcaggagcacagtggcgcgatctcggctcacttcagcctccgccttccgggttcagcaattctcctgtctccgcctccctagtatctggaattacaggcacacaccaacatgcctagctaattttttgtatttttagtagaggcagggtttcacgatgttgtccaggctggtctcaaactgatgacctcaagtgatccacccacctctaaaaatgttagtcatatgtgtctttgtgtatttgtgcaagtgtttctgtaaggcaggtttatagaaattgctaggtaaacagggatgaataatattttaataaccaccaaaataatagctagcaactagactttacatatgccaggtattttaagttcttttcaagtggtaactcatttaatctttacaacaattgaaataggtaagaactattactcctattttacagatgtgagatttgagattaagtaacttactcaaggtcatctagctgatacttagcgaagcctggattcaaacccaggcagtatggcccagagaccatcacgtaccttttacatacactgcatcactattaggtttcatctccaaaatttgtgtttcaatgaccagtttttgtttttgtatcagttattccatcaatctgaccaatagtagtaagtattaaaaaaattttagacaactatacttttttaaatttagcattaaaactgttttaatcttggcataacttcgtgatgtaataggtttgatctgtagaaaatcacagggatacacgatgaggtggcatattaagtgacaaaatggatggtatggggagaatacagtagctacaagtggccatcagtagtgttggtcagagtgattggggaagctatgtggaggtggcagagctgggaagtggagtagtatttgcatatgtgcaaggaaggattgtaaaaagggatattgctgagtgtgataagaggtaaatttgtttacaattgatagaacaatttctaaagcttaggattgaatttaaaatttccactcaaatcagcaagagcccttgggtttagaaggggttaacaggatgcaattggttaacaggatgcaatctgaaaaaacacatatagctggctaaaaaaaaggtcactggagactcccaattttcagcaaaattatgcttgaagagaaaagtaagcagagatggacagtatattcaagaaatctgattaagataacacctaaagaagagaaggtccatccataggttggctgagttcttatttctgaaataatctctggaggaacttttaagaatcctgaaagattcaactattttaaactcttctggaaaagtatatgcatatactcctttgaaaccgctatgattgtaagtaagtaagttataaatccctctttcttgataactgttatgctttagccagtattaaatcaagctctcttaatacacgttttgaaatgttccaactacatttattttatttttatttaaaaagtaacatggaattggaaaacaatagaaaatacagagtataaagatattactcaaaaaattaagcttgtgttatattttttgtaatttaatcttattttaaatgcttcatcaggcttacacacaattatgtatccatttacatgaccttgcaacataagtattttacatgatattaactctgaactgtcaagtttacaactgttgcactgatcacatggatatctcatttaatgatttactcagcaattacaaaataagtttatttctcattttcaaccagaattttataaaacaccatctgtcacatatattttgaatagtttcataattgaaattactaaactcaaatatgcagaaagcatgtaatacccaagttgctttccacctggaatcattgttttaatttctcttcccatcatcaatagtggactcgagtagttatatttttcacaaaatctctagcattaggtggttgtatttgtttaaaatatatgctaatgtgataagcaatgctagataccttaaaggtgtggaaaggttacacattttccacatgaaccagttaaatttctttttgtgaattgtctatttctttcttcatttagagtttatttatttatatgacttctttatacattagggatagtaaccgtctctctgtaacatctgttacaaaacattttcccagttgacagatggatttacaaatgttttttgtttttaagtttgtgatttgatttcaagttccaaaagattttccacatacagatatcaaatgattcctgtttaactttttccccaatagtaaaaactcctcctagaacattcaattgaataatcgtgctctttctcattgactccattcatttactctaatttcgcacagtcttattttgtttgctttaaaaggcaatttttaatgacttacatgtgttattgttgcaaacgaagtggatatttttgaaaaatcacattttaaagctaccctccaaatatgaatgaggtttgaataggaatgagcattgaattttatcacaccttattagactttgagatatttattagggtaatagttgaaaccaatcttttcttgttactataagttttaataagctttatttggtcaaaggcttgcattttgtcagtatttcacttagaatttttatacttatatgaattaattcagtggggtcctaattttgtgcttgccatgtcactattatttagaggttatattcacataaaattaggagattattatttgtctctcaagaacaagagacttctaaacaattttagaagcagacaacataattacctacatagaaagcataaatagatctatataaaaacaattagaagatttactcactacaaaatcaatagcttttttacataatagccaattagtatataaaattaaaatatcctgtttaaaataataaaacagtatacatacaaatgtagcaaaatatgtataaaacctccaaaagattttgaaattcagagcaagcaatctataaatacaatgatcaaaatcccaatagttgacatattaaaaaatgtctattaaaattgtgttgctattatttactaaatattaataggagaatgcatgaatcataaaatattcatgaatggtatactatacagtagtttaaaataagtgaattacaatgctgtctatttaacatggataaacctcaaacaatacctagtgaaataaaactgtacaatgatactcataatagtgttttcaaatattaacgaataaatatttatggatccataaaccgagtataaagacattcaaatgtaagtttctgaattcatgataatggagaaagagaccagggaggagaactcatggggccttaactatttgtgtaatatcttcttttttaaaaagctaaaaatcaaaatagagatataaatcatgataaaatgccaggcttataacctcggtttatcatgtttaatttacaatttatcttttaaataatattctcaacttttctaattgtgtcactgtgtatttggcaaatatttatctagtacgtactaggaactgttttaggtagtaattaagcatttgtgaccagggcaaagatctttccgttatggagcttatattttggtgggagaaactattatacattgcaacatcagaagtgcttgaagaaaaataaaacagggtaagaactccagccccatttcctgttgccccagctactttaattaatagcacaagtagttccccagagggacttggtggagagaggttgctgattgtcatactgctttcctttttaactcttaatcagatacaataatgttcgtgttcttctctttccttttatgaaactcaggtcaattgacttatttttttagactctggctataattgaaaagctttctttctagtgttaatatttttctctcattattgctagtgtcttattctgttttaacaccatattgcatagaacttgggtcgttgctaatacccacatccccaaactcccaagactttcataattaaagggttgtcatgagcatctctgagctggcacaaagcaaattttcgactctataggcatctattcaaagaatttgaatctctttgaatctttttgaatccataatttccctgaaaatatgtaactttcccctgtagctgttatattacaagaaagaatacttttgtgtggtagtcaggtagtcaataccaacactcactacaacccaacagctccggtcttaggctctattggctgaaatatgtattaatttttctgggcttttgaagttttgaaaattactttttatttacacatgaggaaaaactggctggattaaaattctaggatcatatactgtctccctcataactaggtattgtgtaattttttcctgaattttaggaggaaaaatacagggctgccagaatcttcttccttttcttcttggatatttattatatacttagacattttgccctttatctgtaaacatttcatccagatatatgctggtatagtttatacttttctaatttttctgaaatgcaattcttctaaaaattaaacttttagctcaagaaattttgttgtgactaattttaaaaatcctgatttatttaggaatactgttttcagagagaagctatctccagtgagttctgaagatagtatctttttcttgttctatagaatttttgtttcagatgccctttattgggttttatatgttcactcatcatcaaatgagatgtatttagacatagatttttcaatgtgtatgtgacctggattaaccttagccactttttaaatttttcgtgggtacatgagatgttttgatacaggcatgcaatgtgaaataagcacatcctggggaaggggacatctatctcctcaagcatttatccttttacttacaatccagttatactcttcaagttatttaaaaatgtaccattcagttgttattgactatagtcaccctattgtactaccaaaaagagggtctgtcttcttaacttcctttggttactgatagatgcagtggtctgaagccagggctgtggggatgcatagtcccatgactgactgacttcatctgaactaacttggctcccattactatatttatttacctcagtgatcaccaagaagaagacatcctgatgctctcatccttcaagatgtattattccctagtctcttcctgcttataatgcctggtgggaatacacactgccatatggagaatctttttttacctccacctctctctgctcgatagtcatgtttgctagtaattgtggtgcatgaatagatttgagagatgctgataggtcaagtcaaatagataatgactgtctacatctgaaacagttatcaggcattagttggggttgaaagttgttttgtttatttttccccaactgctgtgtgtttccaggtggaaacaagtaatggtgactggccaaatccacatgctacctactgcccaagttcttctcttgtttgacaatctaaccaattctgtggattccaaaagacaagctagtttgtcagtggaaagaatccagaactgaaaaataagacctaccactaatattgccccctttattgaaatgtgttcaaaatactaagcctcaacttctttatgtctaaaacaaaaagactggaccaaatgatttccaaggctccctttagccctaaaattcttccatctaaatatgtttcaatcctaaaatatttaaagttaggatacctaaattcccaaggcaattctaaaagataattaaccaacatggtgacttacctcatggatttcttactaacctctcatcaatttctcagcaacacacttcagcaaactgtagccatggagactcacttaatataaagtagtagatataagctttttcaatcaatcagcagtaagtttaaagtccagaaagccatgaaaatagggagtcctaggaaacaaagttaatttaagtatgtctacataattcctgtggagtttgtgacatataccaatgttacagtcagtgatacactgcatttcaacagtggtcccataagattataataacataacaccacacatgtttgtggtaatgatggtgtaaataagcctgctgtactcccagtcataaaaagtatagcaatataattatgtacagttagaaaagactcaagttaaaaattttaaaaaatgatgttgaggattctgaccctgtgtaggcctgggctaatagtttattaacaacaacagcaacaaaagcttttaagtaaaaaaaagtctttaaaatagaaaaaattttacagaataaggttataaagaaagatgatgtttttatacagcttgagctatgtgttactatgaaagagtcaaaaggttaaaaaatagtttacaaagtaaaaggttacagaaagtttactttattattgaagaaaatcttttataatgtagcctaagtgtttagagagtctgcagggggtacaataatgtcttaggccttcatattcactcatcactcacgcattgactcagccagggcaactttcaatcccacaagctccattcatggtaagggcccaatataggtgtcttgtttttatgttttatactatatcttctctatgtttagctatgtttagatacacaaatacaggtgttacaactgcttacactattcagtacagtaacatactgtaaaggtttgtagcctaggaacaataaactataccctaccacttagaagtgtcataggctataccacctaggtttgtgtaagtacacttgatgatgttcgcacaatgaagaaatcacctaacacatttttcagaatttatgcccgtcattaagtgacatgtgactgtagagtttagtgaagtgaaaatgcaaaataaatgtcagaaaatcttaagatagctaggtcctatataaaagtaattttttaatcttttgtttcatatcctgtcttttagtgtagccatattttaaatgccattaaaactaaaccaggtcaaaatttgctttttcctctttgatgtaaaaaagaaaaaagtggaggggcagggaggagggatatggggagaagctgttcaatgagcatcagagcacagtatatactatatcttataagttagagatctgaagtcaaatctcagctttgctctttattgacttaaacaggcaactaacatctgaatcccagtcttaccatctgtaaaatgtaaacaataccttacaagatcttatacctgaagcacttagcacaatgcctggcatacataggtaataaaaaattgtagccattattgttatcactgccatgaattcttccaaatatatattaaataacatggaaataatgagcaaagaccagggaagaaagcactggaatggatgagagagtaaaaaaagcttaagtcattgtccatttattcatcatctaccatcttggatgatgcctaatgacttacagaactgaatgtggaggtaggtcattccaatccagagtcctggacctgaagatggaggagctatggggcagatgagcttgatatttaatggtgatattgccagagtggttgaccttcataaataatctacctccttgttttgtggggcccagcaaaggtgcatggggccagattcaaatttgtcagaaacctaagcaattggttaacttataggggtcatttgagaagctgtaatgtgttttctatatcatgtttcatataggtcattaccaattaaaagcattatatgagtagtcattattaaatgtgtgagactgttcattccctcacatagcatactaaaattatggtaggtgagagattccagtaaggtgcttattaatcccgtgttataacgacagtaagcaggaatttttaatcctcaaaagctgctcttctgaagagaagttcaaataaagcagacaatgagctctttgagcttcctgccctctgtcagtgtatgctcacaagggcactactcattcttgaagtattcatgacccaataatgttagtgacaaagggcatgttgtagacacacagatggtgatttcacatgtaggctaatccctatggatttacaataagcaagactatataacaggcaaagcctctcattaaatttttctgaattgctcactaaaactttgttgaataaagaatatgatgttagattatttccatattcaaatccataggaaatggaaatataggctgcctttttgagcaaataactagtcaattgagatatcctgtgttcaaagtgctttggttcaatttcatttttaccctgggatagacaattgacaaatttcactgtacacatcatattcaaggacatagtaaagcaaatcttccgaatgtgaggtaaaatatgtggcacaatataacacacatgtaactcacatgtgactgaattaagcagcttttagagtttcagtaccaaaagcattaaatgaatcaacggaagtatatgtatagttcttttcacagtaatacaggactatgaaaataacgggagccaaactgtgcaaagtaatctggataacttacggaaaaagttaaaattccactgtgacttttaaagacattttgtcaaaaaacaaaacaaaaaacctcttactgtcaattataaacatacagggaaatttaaaatacagtaaaaatatttgtctaatgagttttaatgtaaaagtctttttaagagtagtttgaacagtgtttgcctctttcttctcatggtatagtaaggggcaagcagcttttctatgccttggaaatggatccaaacttaggactacgacaatccaccagcattgtaatcctttcagctttttatgtcatcacctacctgagagttccttaaatgtgagcctttctccatgtaaattttgctaagatatctgtatctttctcctcacttacgttaataagcccaacttcagtaacctccttggatgcttatctagaatctctccaatggcagcagtgtcaacaatccaagggtcagtaattgcttagattaactcatttgcactctacgcatgtttcactctagcattatcccttatcctttctttgctgcactttgatctttcctggccaagtccatcttttgattatccaggtttgtaaaataatcacatgggtttgtaactgcgaaacaaagtggccacactttgttgtctgtgtgtgaacaggaacacagtgaccattcacctgctttgaaagaagagactggtcactaatgacatgtatctgctatccacacagtgattactggactacagaattagcttgtgaagtttgcccttcatgcaattacacacatttaatataccatggtaactgaaatttgaaatggtcagaggacactaatgttgtttaaactgtggaagcaactactgtcagcctatttaatcaacaaatatttaattgtccacgtaatgcacatcaaagcattgtattgtatgaatgagaagtatggattactaataataaaggcattctgttaaggagaaaaatctgcataattaactgtaatactagctatagcatgagtactagagagtggtataaacatagggccatgaaagcagaatcattcagtttcaaagtgaaaattctaaatagcatgactattaagcaataacagcaatgataatcaatactttctagcccattgtttctaacccacaattgtcagaaaatttatgttcctcattgcactttagggttgtactaccttacacagccagttctcaagactatgtttgacctaattgaagagtaaattttgtcttagaaaaggaaatatgtattttgagagtctagtaaatgtttccacccaggaggtttcagaaaagtgttcaggcactgctgagtacataagcaagatttttaaagcctctgcccctgacgtcaatataaccctcaataactgattgaaaaacacacacacaggtagggtgtataaatggaagaccgccgacaagcaatttgagaaaggaaaaacttacattgtatacgtttagagtcccttcttaaaggttttaggcacatttccttagacgttacttgttttaaaacagcataagtcttccttcataactaaggacatcaaaactcacatattgccctacttagaatgttatggccaggtgcagtactttgggatctcccaatccaggttcatactgtattagttactcgtgctgcgagaaaattactcatttcttaaagtttcattctgctcacattaaagctttggctctattctcggctgggcatggcagctcacacccataattccagcactttgggaggcccaggcatggcggtccatacttctagtcccaggtacttgggaagctgaggtgggagaatcacctgagccctacaagtcgagcctagagtgagctgtgattgcaccactgcactccagcttgagcaacagagcaagaccctgtctcaaaaaaaaaaaaaaaacctctctcccaaaagcaggctataatcatgccttcagtagtacaaagagtaaaagataaaggtatgacctcctctcatgacttctttctcctggtggtagtctccctggtgttggggggaggaaggaaagaaaaaagatgactccatctgtacttcagtggtgaggggtcattgtctatttcgttagtgtgaagggttgttctaaaattcttatgtccaaagtgaccactttctgtcttccagtccttttatcatcaaatggctgtgccaaggagagaggcccttgtggtgaattgcctcatctcagcaggttctcttgaaaggttttggcccaaatcttgatgattctctcaagatagaaactgaaagtctttcagaatcttttgttccgggctttcagcatttgccttcatttttatgaaaataagatctttattaatctaatacattgcaaatgagattgcaaaagttacagtctctgtggtagaaattaaaacgccacataactttgacaaaaatactatgcttttaaaaactatactgtaaacttttgtagcataataattcattatagtttataatagcaaggaattaaacaattgaaatatggttaaattatatattcatataatggattaaatgtcaaacattaatgttttattttccaagcctgtagtcgttgatgtagtgacagctttatctacactgaactggaatgacctccatgatacatttttaggtgaaaagataaaggcctggtaacaaatagctagagcatgtgcttcagtttggggaaaaatgtgtatgttcataaaagatatgttaatgtgaatatagtaagaggttggtgttatcctcatttcacaaataagaaaacagaagcttaagaaaatagaatcatagaatcagtggtgacatactgtgatttgaattcatgtttatctgaaccgaaatcacaggccctttccaacacaataagtttaacccctgactaatcttttccaggagacagttgactttttaaaatgctatcggtacaccttataaataaattgttgtaatatatttgcatgtggggctcccctggccaactatgagtttcatgaaggcagggaccctaacaaagctacctttctgttcccagtgctccggtatggcacattgtggaaaagctcttaaagtaataaaaagcaatggtgcatccttgtgtgcaagaaatgaatataacttcattaagtggctagtaaatcaaccctagttctttaaactatcataatagtaacagaatgtcttaggatttctgcaggcccaatgacattttagttcaatggggtaattattacatccaagcttcaaacttgcatttcatacttaagtgaatatttatcatcacctattacgcactattaatggaaagaactattcatttccaataatacattttatgttttttatgcatagaatgaaattgtccattattaatgagtctgaaagctcaggccagtaagcctctgcttattttcaggtcgttcctccaaagatgccgtgggtcagatatctgttcatgtggacatcactgccaccccaggaacgggagatcataaagtcactgtaaaaggtatacttctggtctagataaatcaaaacagccttctaaacttctgcagcagtactgatatcagcaatgtaacttttcttgcatttaaaaaaactgcacaattattttagggcatgcacaaaatttcctaatgaaacccaaacttttgattaaaaatagaaaaatatcaatggcactaatgtttagcatgcattattcaaaatatataaatacactgattaaatatccaaacttactttatcagatatttattttgtggttggtgccatgatattcattgaacacttgcactttaaatattaagtcagtatgttcttactattcacaaaacctactgctttttctatatgatttccaacaactggcttagagttctttacaatgagtggctcaatttgttggttttacattgtaaaaacagcctgaatgcaggggtaatttcaaagatgaaattaaaggattagcattttgttaacaatacgctcgttctatttttatattagtcacttcaatacccactttgagcaaaactagggctgcccaatatatttcagaattacattacatattgtatctttacatcataaaagtaaaatagctatattttagaatagattatatacagtagtatatactgtcaatttccttaaatatttttgaaaaatgttgccaacgtgtgaaagtttaatgaatattttgcagtagtgattttaattataagacacttcgcttgaggatgagcaaagatatttacacatgagaatcttcatttagtattttttttatgacgactgaaatttaaaaacagctataatatctaacaagtgactggctaaatataggatgaaatagccacagagcaaaatattattagcagttgacaaaatatataatgaattagaaaattagccatgatagacttaaaaaaataaagctatttataagattgcaacacattataatatcattttgtatataaagtaactaaatattgaaagcatacaatccaaaatattgtcattgactggtaaatttatagattttatctatttcctgatgagcatatcttcatgttcaatacgaacaacaccatgtttttaccaagaggaggagagtgctaacttttcattagtaacagatatcattttaattgcagctaactaacttttcaccaaagctacacagcttaaagctgaaagctccatcaggtgtgccttccagaaagaaaattgtattttattgtcttggagtacagtgtcttgtcagtggagttagggcactattattaagttttggcttcataaatcacttttaaaatttcactctaaatttccacacatctgtttgctaaaatgtgatatttccttttttttagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttgtaagtcataaacccaccttacttattctaccaggcaatagttactgtacagctgaccttactgagggatttggagtgtgaagggctaaggaaaatgaagaaggctctgtttttagttcccttccattcattcaatatctgttcagtgcctgccatgtatcagccaatgttatagtcattaggtgtatatatcataggaggtgtctgaatcaatcttttgcagtgcactcatataagttactttctacagatgaggagtgtatgataaagtcacaaatatttgtcatatggcattaaatacaatatgcagaactatgtggtaagtgctatgactagctgctttgcctgggaggtcagggaagcctctctgagcatgtgacttttaaactgaaacctgtccaaataaaaagccaggcatggaagagcagaacatttcagacaaagtgaaataaatagctagtacaaggactctaaggcgagagcaagtctgggatatttaagaagcagcacatcatagataaaggagtgagatccaagtgaggccaaggtacagatagtgtgtcacatagggcttttcaattctaagttcaataggtggtccactgaagggttttcaaatgaacagatgagatttacatctttattttgtttgctgtgtacagaaataattatacggtggcaagaccaaatatgtaaagatcagttagaaggctattgcaatagtccaggcaatagctattagtgactaaccggatcctagtagggagatagatggagaagattctgtatcatgtgtggaaagtagattcttgccataggctggaggtagaacatgaaagagtaattcccgaaaacactcagtttagagtaattcaaaatgagcttacttacaaaggaatttacaaagtggttaagagtagagaaatttgagtaatcatgggaactggggctaatagtaaccaggctattaccatacttatgcctgaaaagaggagagaaagagtcattactaaaattaggaaagtgaaaacttgatgtatgcttgaaatgtattattgaaatacactattaatggaaagaactattcatttcttttcagtttgatgtatacatttcaagtatacatcaagtttgaaatgtatacttgaatgtatacttacttgccttgaaagcagcagtgacattccatgaagggcaacagcctactggaggcagccccacaggcaaagagccagggaaataaagactctgacctcactctcctcactgccaacctcttgatggggttcccttttggccaaaatctaccggaagcaagaagaaaccctactgagatatagtcccaacagatgagttttctattgcaaacagcattctattgcaaacagcaaaaaggagggtggatccacagggggaaactgggcgatacctggcactgaataaaatcaaagatgatccctaagtttttggcatgaggagttgggaagatagcaatttaccaagatggaagaagaaatgataaaaatgttttaaatctattaatttggtgatgcctgtcagactctcaagagatgtcatttaattcaacaaatataaataatctaacctaggaatggatacatggagaggttaagaggcctaggacaaagccctaaggatttacacgccaatacactctcttacaggttttttgttcatgatttcctatagtcgtttcagcactctgctctgaatatttcaccctcttatcacgtattaaaactgaagtatcctactctatcaaaagggtcctaatagatcacattccctgccaataaaccagcttacaacatttcactatctacttcaacttactcaaaaacctggacccaactaaagtttcttgttagatataacacagtgagctacttaaaggcagcatttttaattcatgagatctgattcccatcatattttgctcttctactcttatcccctagacttccattttctttcacattatttcagattctccctaaagtacaaagtttagttaccagtgtttcctggaaatcaaaatgtttcatcagaaaaaaatcacctgtaaaaggaaggaatttggaagctggtactgctgagggctagatgtacattcattagaaaatcaagaatatgagaatgaacaaaaataaggggtggaggaagacagactgtatctaccatatcaccacttggccttctttattatgttgacactaacaagctgtcttaggtggttgttaggagaggccacacacttgacaggtctaactgttaccataggaaagaatcggcattgaatcaccaggctctgctggaattgatttactctggatggagatttgtatccaatttagcatattgtgaatagtgcttgatgggctgtgcagtgtattcccctgagaaaagactcctagatataatagcttattcaagatttggaggtaaagtgcgaggagtagtaactgatattgaaatggggaggtaaagtgcgagtagtaactgatattgaaatggcatataaattctaccaagaggtacccattaccctggcctagcccccatgacccctttccaactccaccgcacccgcaatcaggagattctgcctcgactgattaagtgtaacatagtatcttaattcccatttttttctgtcttttctatctagggaaaaagtcattttaacattcgctttctaagccaaatttaaagggttaaaatacactgatatcctatttgccaacataataatcagatccaatgtatacagttttcagcagtatttgagaaccataatgatgcctagtggaagtaaagtttttgctcaaaatttgtatttttaatccacacagcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagca

SEQ ID NO: 207 - DNA, 230403 bp, Homo sapiens
cttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaaggtactgctcttttctgtagtctccggcttggagcagaaccccttggccgctggcttcagactctcccccccttgccttcccctgtcctcacaagccgaaaggcttttccctctcagacctccactccgtgggctccacatcgggctccttcagatttgctcgttctgtcgccccttctctctttcctaagggggactttttctgctgaagttcccagtcccccggtagactgacacccacaggggtttttccttcaagacatttctgtctcttggtaacagtcgcgtttcctcagcagatctgtgggatctggtgtttttaaaattaagagttttaggtcgctagctttccccggttgtggaagttgggagcgttaaaatgagccagtgtctgctggataaggggtggcttagcccgagtgacatctgtcaagcagtccactgcgtggttaaaagagcataattaccagcttgaagtcaaagtatagactagatcgtccaatagaaatatgtgagccaaaaaggtgaaattaatattttagtaatatatcttatttaatccagaatagccaaagtattatcacttcacatgtaatcaatatacagaatattgacaagattttttgttacttttttcactaaatcttcgaaatccagtattttacacttaaagcacatatctcggacttgccaaatttaagtgctcagtagtcacatatggctaataaccatcatattggacaactctatttagaccgagaactagttataggaatgtagtgtcaatgtactctagagacaaactgtaaaaaaattactgacttttataggtctcctatgtgttaggaacgtactgagatgttttacatgttgtttcatttgtttcttgaaaaaaaaaccttatatagtggacacccatggtaaagatttaagaaacaggtccagggaatctaaacagcctaaaattcattttgattaaagtcagtgttgaaatttaatccactatccttttgaatttgctattttttcaaagctgtttattctttaaaaggcacttctgtatttttttaaactgattttgcctacaggatttgaatccagaaaaaaagcaaatgaaaacaaatatttcacacagtaaatggattgtctcatggaaatgtaaggagtaatatctcaggtgtgatcctagacattctaagtaatcttagttgatatcagtcataaatcactagtgaatgctttctatttcttttgttttttctttttttgagacgagttttgctttgttgccaggctggagtgcagtggcccgatctcggctcactgcaatctccacctcctggggttcgagccattctcctgcctcagcctcccgagtagctggggttacaggcatgcgccaccacacccagctaatttttgtatttttagtagagactgggtttcactatgttggccaggatggttttgatctcctgacttcgttatccgcctgcctcggcctcccggagtgccaggattacaggcgtgagccacccggcccggccaaatgcttcctatttctatcaaattttactctttgagcagtccaagagagtttcctagaaaatttgacatctgggtttttgaggtgtttggtctcctatggggatgaggcctatatctcttctgcaggctaagaagagacaacagcacatgtgtaggtaatgctttagaatctccaaacattgggggctacttctcctctctaggtggacgacattttgattcatttgttttgttaggagataaaacagcaggatacccagggaagagtttgcctgaaaactctcttattttatttttattttgagatggaattttgcttttgttgcccaggctggagtgcaatggtgtgatctccgctctctacaacctccgcctcccgggttcaggtgattctcctgtctcagcctcctgtgtagctgagattacaggtgtccaccaccacgcctgactaatttttttatttttagtagcgacagggtttcaccatgttggccaggctagtcttgaactcctgatagctgatctgcccaccttggcctcccaaagtgctgggattacaggtgtgagccactgcatccggctttactttattttaaatacattgctgaataataatatccaggatacttgaagttttcaagtggctctgtgttgtggagtggcatggctctcttggtgttgggagtaggcaacagaagatttgcaggtgcctggcagcacactgattagtctgaggaacgaagggatatgcctttgattgttttacatagggctgaaaccgtgggctcaggatgacattcagttccaatctttattgaactcttttttttttttttttttgagacggagtctcgttctgttgccagactggagtgcagtggcgccatctcggctcactacaacctccacctcccgggtttaagtgattctcctgcctcagcctcccgagtagctgggactgcaggcatgcactgcagcgcccagctaatttttgtaatttttggagagatggggtttcaccatgttggccgggatggttttgatctcttgacctcatgatctgcctgcctcagcctcccaaagtgctgggattacaggcgtgagccactgcacccagcctttatttaacttaaaagcaacactgagggttaaatttctctaattattattttttgagacgagtctcgctttgttgcccaggccagagtgcagtggcgtgatctcagctcactgcaacctctgcctcccggattcaaacaattctctgcctcagcctcccgagtggctgggattacaggcaccagccaccacgcccggctaatttttttgtttttttgtttttcagtagagacggggtttcaccatcttggccaggctggtcttgaactcctgacctcgtgagccacctgcctccacctcccaaagtgctgggattacaggcgtgagccactgagccctgccaaatttctctaattcttatggaaacataaaaaacaaacatgattttaatttatttttgttttaatattattttttgagacggagtatcgctcttgttgcccaggctggagtgtaagtaatggtgcaatctcggctctccgcaacctctgcctcccaggttcaagcaattgtcctgcctcagcctcctgagtagctgggattacaagcatgcaccaccacaccaggctaattttgtatttttagtagcgatggggtttctccacgttggtcaggctggtcccgagctcccgacctcagatgatctgcccgcctcggcctcccaaagtgctgattacaggcatgagccaccgcgcctggcacaaacatgatttttacactgaaaggttttgcagatagaacctctatctgcagtaagagggaacatacacaaataagcatgatgcaaggatgtgattgtatttgtaaatagaattgtgagtaagcacctgaagatagattaagagatatcagttctttctggcaggcttcttagatatgccatttttgctgcccttgaagaaagtatagcatattttagactgagatgaagggtagccgtatacaggattctgagttaagaacatagcatgggtggggtaggaaaaaagcaggttcaggaaatggtgaatagtccagtttgatcacaatatgggggtaaccaatgtggagtattggtggaggaggcaagaaaaaaatgaaacaaccttttattcttataatcttgctaacttctattgctgctcttaagcaggatgtacatttttcatataaatgacaacagagttcatactttcagttatctatgtaatatcatggtctgtgaagaaagtgaaaatgaagggtgacaagagggtagaagcaaaggaaggaaggaggggacatgtacttcccagcaggggatacagcggacacacgtgttaacagcctccttattgccaactgcctggaaatatatttcacaggccatgttttcaggttcaggtgctccctgagctgtagcccttccctctgactttcatgttgtgtgccaaggtgttatgtagtgattcctggcttttgtactggttctgttttctgtttagaatggagccctcctatcctacttgactgggacattgaccctctctagctttgcctgttaatcacaaaaggacaaacctttcacctgcttgtagatatgcgaagctggccattcacttgctctagtttttatttttgggtagaccctaaggaacaatgaagtcaatgaattgggaatggtgtgtttatttaaggagataacatcctatagataaatactcttgtatttatatataaaatatataaaaggcagttgctaaacactgcccccccctttttttttaagacggagtctcactctcttgcccaggctggagtgcggtggctcgatcttggctcactgcaacctctacctcctgggttcaagcaattctgcctcaacctcctgagtagctgggattacagacacccgccaccacacccagctaatttttgtattttagtagagatggggtttcaccacgttggccaagctggtcccgaactcctaacttcaagcagtccaccctccttggcgtcccatagtgttgggattacaggtgtgagccactgcgtccggcccaacactgctattttaatctactttttttgctcacattataattcaacttcttataggtatgagtttgcgtgatctttattgctattgctgttaaccttgtggatatgctcaattccagtaaatcccagtttactgaaagagcataatctaactatgaagatcaatcaccttttgtataccttagtctgtattcactactgccctctggtgatgattttgtatttcctcattggaattttaaacaaaaaattttaggccgggcgccacggctcacgcctgtcatcccagcactttgggaggccgggtcaggtggatcacctgaagtccctggttcaagatcagcctgaccaacgtggagaaaccccgtctctactaaaaatacaaaattagccagacatggtggttcatgcctgcaatcccagctactcgagaggctggggtgggagaatcacttgaacccgggaggcggaggtcgtggtgagccgagatcgcgccattgcactccagcctgggcaacaagagcgaaaccccatctaaaaaaaaaaaaaatttttttttttaatgaaaattctccttttgtgttgtctattactaattcatatactctagtactcatttatatcaatcaaatgttaatttatccaggctgggctcagtggctcacgcctgtaatcccagcactttggggaggccagggtgggcggatcacctgaggtcaggagtttgagaccagcctggccaacatggtgaaaccccgtctctattaaaaatacaaaaaattagctggttgtagcagcaggtgcttataatcccagctacttgtgaggctgaggcaggagaatggcttgaacctgggaggtggaggttgcagtgagccgggatggcaccattgcactccagcctgggcaatgagcaaaactctgttatttatttatttatttagagacagggactcactctgtcacgcaggctggagcgcagtggtgcagtcataattcactgtagccctgaactgaccacgagtgatcctcctgcctcagtctcccaaagtgctgagattacaggcatgagccatcctgcctagatcctattttagaagtctagaaatacttgcaacagcatatagtggccttcctgttccactcctgccctctacagtctgtcctctgcataggtaccagtgatcctttaaaaaagtgcgttatacctctttactctcctgctctcaactatttcatgttcctggcttcacatcaaacttagaataaaattcagtccttctgccctaggccacaggtccttacatgatcttacccttactcacttctctgatctcattttctcatttccagcactctaatcttgtccttatttaatcatgtgaagtgtttttcctgtagatattcatgtggcttgttcatttgtttaattcattctctacctgaacgtcatttcctatgagctcttccctgacttatattataaagaccctcattcttccttcctcttactttttacctggctttactttttcttcatacttagtattacctgaaattatattatgtatttatcagcttatttatttgttaactattctactagaatgtaagcattaggagggcaggactttattattattattgtttcttctttattccttatacctaatattgtgtctggcatgtagtaggcacttagtaaaagtttgtagaataagtgaatgaattgagagtgtttaaatgtggagattgctattaaaaagattggcatagagagaaaacatataccacttaccatatgaggaaagctaggaaatgtagtactctaaaccaggggtcagcaaactatgtcctttgggactaatctggcctgttgcctgtctttagaaataaagttttattttaggccaggtgcggtggctcatgcctgtaatcccagcactttgggaggccaaggcgggcagatcacgagatcaagagatggagaccatcctagccaacatggtgaaattccatctctactaaaaatacaaaaattagctgggtgtggtggcatgtgcttgtagtcccagctactcaggaggctgaggcaggagaattgcttgaacctgggaggtggaggttgcagtgagccgagatcgtgccactgcactccagcctggcgacagagcaagactccatctcaaaaaaaaaaaaaaaacagttttattgtaacatgactacatgctcatttacttatatcttgtctgtagtagctttagccactctaataacagaattgaatggctgtgatagaggtcatgtgaccttcaaagccaaaaatatttaccatctgaacgtttacagaaaaagtttgctgacctgcgtggtggcacaggcctgcagtagcagctactcaggaggctggagtgagaagattgcttgagcccaagaactcaaggctgtagggcagcatggttttgcttgtgcatagccactgcactccagtctaggcaacagagggagactccatctctaaaaatttaaaagaaaaaagtggccaggtgcagtggctcatgcctgtaatcccagcactttggtaggccaaggtgggtggattgtgaggccaggagttcgaggccaccctggccaacataataaaaccccatctctactaaaaatacaaaaattagctgggcatggtggtgtgcacctgtagtcccagctactcgggaagctgaggcaggagaatcccttgaacctgggaggcggaggttgtggtgagccaagatcgcaccactgcactccagcctgggcaacagagtgagactccatctcaaaaaaaaaaaaaaaaaaaagagaaaagtggccgggcatggtggctcatgcctgtaatcccagcactttgggaggccgaggcagatggatcatgaggtcaggagatcgagaccatcctggctaaaatggtgaaaatacaaaaaattagctctactaaaagttggctctactaaattagctctactaaaaaattagctctactaaaaattggctctactaaaaattagctctactaaaaattggctctactaaaaattggctctactaaaaatacaaaaaattagctgggcatggtggcgggcttctatagtcccagctactcaggaggctggggcaggagaatggcatgaacccgggaggcagagcgtacagtgagccaagattgcaccactgcactccagcctgggcaacagagcgagactccatctccaaaaaaaaaaaaaaaaaaaaagaaaagtgtgttaacctctgttccaaacatctgttctcaaactcataatgtttattataatatttggaacccccctgggtgcggtggctcacgcctgtaatcccagcactttgggaggctgaagtgggcggatcatgaggtcaggagatcaagaccatcctggccaacatggggaaaccccgtctgtactaaaaatacaaaaaaattagccacgtgtggtggtgggagcctgtagtcccagctacttgggaggctgaggcaggagactggcgtgaacccaggaggcggagcttgcagtgagcggagattgcgccactgcactccagcctggtcaacagagggagactccatctcaaataaataaataaataaaattggaaacaatataatatataaattatgttttgaagttggttacttgataaatatctacaaattggaaatggggactatttgctctttgaggaatttcactagcttgttctttagactcctgagatctgtagtaaattaaaaatgacctctagcctggccagcatagtgaaaccttgtctctactaaaaatacaaaaattagccatgaaaccttgtctctactaaaaatacaaaaattaggcatggtggcgtgtacctgtagtcccagctatttgggaggctgaggcaggagaattgcttgaaccccagaggtggaggttgcagtgagccaaaattgcactactgcactccagcctgggcgacagacgggactctgtctcaaaacaaaaaatagtaataagatgttaagaatgataataggaaaagattataagaaataattgtggttgggcgaggtggctcatgcctgtatttcagcactttgatttgttttctggggttttttgttttgttttttgaaacagagtctcactctgttgcccaggctggagtgcggtggtgcaaacttggctcactgcaacctccgcatcctgggttcaagcgattctcgtgtctcagccacccgagtggctgggattacaggtgtgtgccaccacgcctggctaaattttgtgcttttgttgagacagggtttcaccatgttggtcaggctggtctcaaattcctggcctcaagtgatccacccacctgggcctcatgtttgggattacaggcatgagccactgtacctggccaaattcctttcttttctttcctttttttttttttttgagatggacttttgctcttgttgcctatgctggagtgcaatggcatgatctcggctcactgcaacctctgccccaccaggttcaagcaattctcttacttcatccacccaagtagctgggattacaggtgtgcaccaccatgtctggctaatttttgtatttttagtagagatggggtttcgtcatgttggtcaggttggtctccaactcctgagctcaagtgaaccgcctgccttggccccactaagtgctaggattacatgcgtgagccactgcacccagcccggattattttatctctttttttctattctctttcttgcactctgatttttcaaatgttagacctcctagactgattattctaattttctcttattttctaccccatttttcatgtgtttttttcccactttttgattgacttccttaactttatcttctagccttcaaacacatttaaaaattgattaaaaatttcttaagagacatagtctcactctgtcacccaggctggagtgcagtggcatgatcatgtctcacttgcagccttgacctcttgggctccaatgatcctcccacctcagccttttgagtagctgaaactgtaaatgctcaccaccatgcctgcctaatttttttatttttatctttttttagagacagaatctccccatatcgtccagggtggtctcaaattcctgggcttaagcaaccctctctctttagcctcccaattgctgggattacaggtatgagccaccacgcttggccttttatagcctttatttaacttatttattttatttagtttttttgattattaaaaataaaatagagatggggtcttatgttgtccaggctggttttcaactcctgggctcaagtgatcctcctgcctcagcctcctaaagtgctgggattacaggcatgagccactgcgcccagcctatttatttatttatttgagacaaggtctcactatgttgcccaggctggagtgcagtggtgtgcacatggtttactgcagtcttgacctgtcgggctcaagtgattctcccacctgaacctcgatctacaggtgtgtggcaccactcctggctaaattttttgtatttctttgtagagatgggtttcaccatgttgcccaggccggtctcaaactcctggactcaagtgatcttcctgccttggcatcccaaagtgctgggattacaagcctgaaccaccacacctggtctcttctggccttttaattgaatttttcatttaatcatgttttaaatttccaagagttatcttctcttaagaacaatatactactatgtttagccaacagccttttctttctttcagacacaaggtggagtatactgtacataactttctgcattttgctttttaaattttatttattaaagatgaggtcaagctctgttgaccaggctggagtgcaatggcgtgatcatagctcactgcagccttgacttctggggctcaagcgatcttcctacttcagccccctgagtggctgggactacaggtgtgtgccaacatgcccggctaatttaaaaaaaaaattttttttagcgacagggtctccctatgttgtccaggctggttttgaactcctgggctcaagtgatctatccacctcggcctcccaaagtgctgggattacaggcataagccaccatgtctgacctgtatttagctttttaaaaatttaatcgtctcaactgtgattttaaaatgcagtatttggaatgtagtattaggaatttagtccatttgtacccagcactcgaagttctttttagaggattttgacaaacattttattgctaagacattttggggtatgatgtaaattgtgaagaagttaaatgccttcatttaacctctttatattttaaatattccagtagtttggtgttttgcatattgtagtattattttaaaagcataatttgatcctgcttgctaaatacctgggaaatttttatggaaagcaattgcagtaaaaacagaagcttagaagtgcatttggggccggacacaaaggctcatgcctgtaatcccagcacttttggaggccgaggtgggtggatcacttgaggtcaggagtttgagaccagcctggccaacatgatgaaaccccgtctctgctaagactacaaaaaaaattagccgggtatggtagcgtgcacctgtaatcccagttactggggaggctgaggcaggagaatcgcttgaacccgggaggcggaggttgcagtgagccgagattgtgccactgtactccagcctgggagacagagccagactccagtttaaaaaaaaaaaaaaagtgcatttggtatcaagtttacaaaatggctgaagtttactatgcgttagtgatgagttttttaaaatcaaagaatggcattattaatgaatggtattaatattatcatgtattacctttttgatattttagagtgaatttaagaagaaacttcgctcatacttttttttttttgagacggagtctcgctgtgtctcccaggttggactgcagtgccgtgatctcggctcactgcaagctctgcctccctggttcacgctattcttccgcctcagcctccggagtagctgggactacaggctcccaccatcacgcccggctaattttgtttttgcatttttagtagagacggggtttcaccgtgttagccaggatggtcttgatttccactcctcgtgatccgcccgccttggcttcccaaagtgctgggattacaggcgtgagccactgcgcccggcctcgcttacacattttggataacatatgttaataagaagttaacttgagtataaaataatggatgtagaatatatagtcttaaagtgtttatattaggaaacagaagagactggtaacttttgacttcttaggtcatacttttaggtttcatttgtattctgtctacatccttaactataagcagtaattctgtttttctactgtaggtggcagtggaatattggcttgccaatgcactgataaagtatgctagaagcaacatcatgttgaaatgttctttctctggaatgtttctagttcagaaaatgctcaaaagttggctactcaacaataaaaatttattatccaaaaagatgtctaaatatttgacttgatatttttaatttagaaataccattttctggaaaatttaaagttctataaatatattccttttagttctctagtttttaagcgactaagttttgctaatttcactgaacatttttgagactttagatggtaatacatgagacatattattcattctctgaagaatagacaaatgactgatgttacttttttataacactggacgtcatatgataaagcagcaattgcagattacccacctgggatttgtagagtattttaatagactcaggtgacctgtaatgaggccaaatgtcctgtaaatcttttttcttagtttagggcaaaacccattcaattaatctatttttggttttccttttctcaaagcagctattctgggcctggaaacttgacttgggttaaaggagtggctgggtaaggagattttaaaggaaatgtttatctttgatttacctattaaatacatactaaacccctaatatgctgaaccttgctctatacacaaggtaaatgtcactgtccctatcttatatatgataaatgccatgagaaaggtataaatgatgcagtctggtggagtggatccttaaactgcagaaatatgaaaaaaaatcatgatttttttgtcttaataaaacacccacatttttagctctatcttaatgtagaatgcagtttttataaatttggacttctgttatgtggttcatctttgacaaaaatttatgtttcaagtaaatgtttaaaacaataattttagaaatttggagatggtttctgttacctgtgctttatttgtaagattaacttttttttttcttttgagatggagttttgctcttgttgcccaggctggagtgcaatggtgtgatctcggctcaccgaagactctgcctctcaggtttaagcgattctcctgcctcagcctcccgtgtagctgggattacaggcatgcgccaccatgcccagctaattttggatttttagtagagacagggtttctccatgttgcttcaggctggtctcgaactcccaagctcaggtgatgtgcccgcctcggcctcccaaagtgctgggattacaggcgggagccaccgtgcctgggctcggcctcttttttttgtttttgaggcagcgtcttgttcagtctcccagactggagtgcagtggtgccatcgcagctcactgcagcctctgccgcccgggctcaagcgatcctcccacctcagcctctcaagtagctgagactacaggcatgcactactacacctaactaatttttgtattttttttttttgtagagacagggttttgccatgtcgatcaggcttcatcgcgtttttttttttttttcattgagtagagaaccagtttttatctattcacagacaggttgatttgacaagttttatatagtttaatttggctcagctttgtctttacaaatagattgtgaggtaggaactggtgccctgagttttgcttcttttaaatgcctttataacagagaattgttttgctttaaagctgcatagcacataactaaataaatttgaatattttcctccctaagttgtatacctctactattgtctcgtcttttacagcttctccaatagttctttaaaggtctagtacagactgggtgcaatgacgcatgcctataatcccagcactttgggaggctgaggtgggaggattgcttgaggccaggagttcgagaccagcctgggcaacatagggagcccctgtctctacaaaaaaataaaaaaaatcagccaggcatactagcccatgtctgtggtcccagctactcaggaggcaggaggccaaggatcacttgagccccagaggttgaggatgtgcaggaggatcacttgaaaaagatctagtacagctagtgcagtatttttctgtcttttctctttttctttattattatgtcatttaaatttccacaggctcaggaatattctcctgtttagacctatgaatttcagctggtagtagggctatggttataagagatgacctctaagcaattctgattcttgagcagtaatttttttttacacaaaaatgttaatttttacaatgaagttggatactatgctaatcaagtactctttcccaggagaaggttcaatggaccatcaacagtactgcagagagagttctaaaaataaagagggaaagaaagaacatacttttttttttttttaaactttgtaattgcttctggagactctcccacacttacatttctgagttggccaaaagtgttcctctaaaaaaggctaaattctttccccatgaagttaaaggctgaggtgttgcttggagtgtttaataggaagaaatatatgtggtgcttcattatgggtaatttttaccccttgttgatgaagaaaggagtcctattcaaaaatgacaactgagatggtaagttagttactgggtaaaagtaacctggcagaataaaagccagtaacaatgagcttctagtactaaagggtgtaatttagaagcatcttgaacatttagtgctctgcttgtgtcataaatagccacttgacagtggatccaaatctgttttgattttccagtgagtgcagaaggaatcctaacccttaaagatttttactagagaaaatcctggaggtatatatgtttatatatatatataaatgtgtgtgtgtgtatatatatgtatgtgtatatgtatacatatacgtgtgtttgtgtatatatatatgtgtgtatatatatatatatattttttttttttttgagacagagccttactctgtcactgaggctggagtacagaggtgggatctcggctcactgcaaccttcacctcccgggttcaaatgattctcctgcctcagcttcctgagtagctggttctacaggtgcgtgcctggccaagttttgtatttttagtagagacaaggttttaccatattggccaggctaatctcgaactcctgacctcaagagatccacccaccttggcttcccaaaatgctgggattgcaggtgtgagctaacatgcctggcctaaaaaatatattttttatcttcaatcataatacaatagaagtaaacatttgtaaccatttaaaatgtgttaaattcttggctttagtcatttacagaaatattgaatattgaatctgaatatatactgttggtcattgtttctgagaactagaccaacccagtattattttgtttttgtttttgtttttttgagacagagtcttgctctgtttcccaggctggagtgcagtggcacgatttctgctcactgcaagctcagcctccctggttcatcccattctcctgcctcagcctcccgagtagctgggactataggggcctgccaccacacccagctaattttttgtatttttagtagagacggggtttcaccgtgttagccaggatggtctcgacctcctaatcttgtgatccacccgccttggcctcccaaagtgctgggattacaggcgtgagccaccgtgcccagcccaacccagtattattttgggggaatggtgattgatagtttgctttcacctttctttaactgcctgtttgcatgattcaacaaaaaacaaccttgatctctaagaaacagccattgtgtttcttagaggtgcaaactggaagattggttttttaaactattatttaactttacagttattcttgttctttatttaaattttttttccaggaccactagtaagaagactgttttcctgtcgatgtattctgtagaatattttggatttgaatatatttgttaccattttattatagtaacagactatacaagaaaaattgtagaaaatgatcagttttatagcccttttaatacagaaaatgagtaggtcttcgttttataatgttttgtgttatgatattagaaaacttggtgatttttggcatttaactgtgatgtggaattatgttttggagaaatctgggccaatgcagggaagattctaaagatttacgctaaaagcggacttttaccttgttaatctggttttgaagattgtgcttccatcctatttttataggattgtggcagtttttttgtttgtttgtttgttttgagatggagtttcacttttgttgcccaggctggaatgcaatggcacgatattggctcactgcaacctctgccttctgggttcaagcaattctcctgcctcagcctcccaagtagctgggattataggcgtgagctactatgcctggctaattttgtatttttagtagagatgggtttcaccatgttggccaggctggtctcaaactcctgacctcaggtgatccacccgcctcggcctcttaaagtgctgggattacaggtgtgagccaccatgcccggcctaggattgtggtagttttattataaaaatttgcgaggtttatttctttccccttatgtaactttatgcaacttgaaattgattaaaacagacaaatgtgaagtaatttcacagatgctattagttgtaattactttaaaagaccccatacaggcttctggccaaagattgtatatccagtatttaggagaaagataagaaagggggacacacatctgtttggaggaagacagttaagttgattatccatagaaccaccattgactttgctttacatggtttctgggttagcatgtaaatttgttctggagtgactaaaattgtagatctttttgttgaataacagtgtaatttaatataatcctgatgtaatattctgtaattagacttgggtaatgtggaaggcagcaaattgcttttcaagatatctagcctcaagagattttgctgaagcagatactaagctgttctttcaggcatttggagtatgaagattttgaagcttacttgattagtggactcaaaaacagaaactgctactttttatgggatatctatcaagatttttaaattattaaattataaaccttcaatatttcattagattaggtgtagtcattaattttcttctgtctaggtgggtaaactaaatgatggatgatgcagaattgtaatccttttagtcaggtgataaatagtgcttaattcattcctatatacattaaactatgtgcaaagtattgtgctaagtattgaggggaatatacagatgaggaaaacactgtgtatttctcaacatctagctaaatgatgagaattgaaagcaaaataaaagcctaatgaatgagttgtaataggatataacagttactagaatataacagcttttaagttaggagtaggaaatatttccacaagcagaataaggggttctatataggaagaacaacattaagacatgtaagtatagaaatgtgtgttgagtccaaggataccaaggtcactgtgaaccatgtgagataagatgataaaggggacctgatagtcaagaatgctgacacatatgggctttattttgtggtgagcagggagccagtgaaaaagttttaattgggcaagtgacataagctcagatttatatttagaaagagtttttttgtttgtttgttttttgttttgaggcaaggtctggctctattgcccaggctggagtgcagtgtggtgtgatctgggctcattgcaacttcctcctcccaggctgaagccatcctcccacctcagcctcctgagtagttgagaatacagatgtgcaccagcacacccagtgaatttttgtattttttgtagagatggggtttcgccatgttgcccaggctgatcttgaactcatgtgctcaagccatccacccgccatggccttccaaagtgctgggattacaggtgtgagccacaacgcccagtctagaaagagaatttctttaatagtgtgaagcatgaactgtttcagtgtagctgccaaaccatgtcactctgcagtgtttcaggtgggtttacttacaggtgaggagaccatatggagccacccactcttacctctggtaaggtttgattaaatttctgatttccttagccaactatacagaatctctctctgagggagaagtggacaggagaaaaataggaggaagcaagggagtgggctgctgggcgtgttgggcttgagaacgagtaaggggtggtggtagggaggactcagagtcggaggggggatggttggagaggggggaagagagaggtagagtggagcagaggcatatggtggggggtcatgctgttcggtggaggattaggatgttgtcgaggaggggagaaatcagccagatcaaaggaggagaagtcgtcggctagggctgttggggtgagggaagcaggaggtgagtctggtttggagcgggtgaggagaatttggaaagtagaaccagactgacagagggaagggcagttacagtgagtgaagaaagcctgaacataaggaatctcagaccatttcctattgcgatggcaaaagttgtaaagtcccgtttcaggctattgggagccattgtccagttggtattggggccatgcagtattgcagtgaaagataagcctcttaaaacagatctctgaacggaggccgagagcattgagatcacggaatggaggagcagtgggtagaggaagaagagactgtcggtgacgaagactacaggagagggcgtcccctttcccgtggaacttgtctggaatagaggaggtaactgctgtatcaggcgtccctgaagcagaggaaccagaggcctggaggccggaggaagcccttggccgagtgctgggtctttcagaaatggagagacagacggtcaagggttccgggggcaaggcaacagtctcttcactcaccctggtggaggctttgatgcattgatggtggatgaagtcgccagcaatgggagagtctaggagattctctgggtctttggcaggtttggggaaagggagattggcagggagaggggtgttaggggagggagagagtgggggagagagagagtgagagtgagtcccggccagagtctgtctgcttcctgggttttggcaccataatgtaaggttagcagagagaaaggacgagagggagacctgaggtcaggcgaggaagtttactaacctgccggctgctccatcacagacagaggaggcagcaccaagcttatggaatgaggggtttatattggggaggggagtttgagggagttctttggtatggctgcatcccggggttgtttgctggttaattttgccacatatcaccttgtgacgtttattacaggagggtgtaggtaaagtttgtttatgcttcctacgacctccccctgtggggtctggatggtttgtaattggggtttgcttatcgcagcaaggtctgataagtgaagtctgctggcttcaccgtggagcctagacaagggcttagaaatgtaaagaggtttgggggaagggtgggcagcaccaagaagctttcttggggcagtttgtccttaacagtaggacttgcctgctgtctcattttaatgtctctctgggcctcataatttaaaaggactcacattcctcaaagttattttcttttctcagtattactattttaaaatcttgctgtgtggtaaagtgttagttacattattctttcaggaaaactatttacattagggatgtgtatttagatccactgacaatatattacaagagtcctggatagcttaaaggcaatgccaattgcagagttagtgttttttttttgttttttgttttttgtttttgtttttgtttttgagacggactcttgctcttttgcccaggctggagtgctgtggcatgatctcagctcactgcaacctctgcctcctgggttcacgccattctcctgcctcagcctcccgagtagctgggactacaggtccctaccaccacgcctggctaattttttgtattttttagtagagacggggtttcactgtgttagccagaatggtctccatctcctgaccttgtgatctgcctgcctcggcctcctgaattgttgggattacaggtgtgagccactgcgtctggcgagttagtgttttttaaattaaacatattaatttgcgtaaatagtgtacaagtaagattgtcccctttgtgaggttagattttagttatttgtctttgagagccatatccagctacagtggaatatactttcagacatagtgatgataatctgtcaaaagacaaaattacaactaatttggtttaaagatcttaagaaagaaaaatagaatcctggaaccccaaactcactgtgcaaaggggaaagttaaacttgggatctgaggcatcatacagttttccttttgttgccaaatcaatagctataatatcataaccccatgtcatagcctcatttcttcgactctcttttcatgtttactttatcttacgtaaaatgtcgacttactgagcttgagacaatacaaagttggctttttcctttacttcctcttttctcatgtaaaatatagatttttctgaggctaattggagcttcacaagaacgtaaccatctgcctcactgcctacctgttcttccttttattcccccctcctgcttgctctttcctctttaaataccaaagttcacaaaacctcctttggaagaagtataggccacaggtgcctctgtgatttgtttttcccttgggcacatcctcaaccttggctaaataaacctctaatctattgagacgtgcctcagtcacttttggcttaacaatctcaattgtgtatttgcaactctaaaattgggcaacacttcattcaataaaatagaataaatgttcccatgaattgagcagaggtggttggttttataggcagaaagggctgaataaagcagaaacaaagaataaaatgcagattggtcatttcaaaaagttactttccttgtaaggcagcgatggggagatagaacaatagaaaaataactgactacttaacatcaggttacttcaggctaccttttttgtgtaaggattgaagcaaaggaaacctcattctcatgctaattgaagactgtaactggccttttgggaaaattggctgttatggctctgtcctcattctttggaaggtcagataacaacttagttttagtagtggtgatgtgaactttagcatgggtgactccattttttgtttgtttgtttgttttttagatggagtctcactgtgcagcccaggctggagtgcagtggcgcgatgtcagctcactgcacactccacctcccgggttcatgccattctcctgcctcagccttgcgagtagctgggactacagatgcccgcccgccaccatgcccggctaattttttttgtatttttagtagaggcgggatttcaccatgttagccaggatggtctcgatctcctgacctcgtgatccacctgcctcggcctcccaaagtgctgggattacaggcgtgagccaccgcgcctggctgggtgactccattttgatttgtagcgttgtctgttgagacctagtggagtagcttagtccaaaacagtggccttctgaaggttttgttttgttttgagactgagtttcactcttgttgcccaggctggagtgcaatggctcactgcaacttctgcctcctgggttcaagtgatttacctgtctccgcctctcgagtagctgggattacaggcgcatgccaccacgcctggctaatttttatttttttagtagagatggggtttcatcatattggtcaggctggtttcaaactcctgacctcaggtgatctgccctcctcagcctcctgaagtgcttggattacaggtgttagccactgtgcctggccagttttttttttcttaaagaccagtgtgatagtaaccttttgtaatttttaattaacaaattatataaaaagtaagcaatataaagcagggagctatttatttatttatttattttgagacagagtttccctctgttgcctagcctggagtgcagtggtacaatctcggcacattacgacctccgcctcctaagttcacaattctcgtgcctcagccatctgagtaactgggattacaggcatgtgctaccatgcctggctaatttttgtatttttagtagagacagggtttcacttcattgcccaggctgttctcaaactcctggactcaagtgatccgcccaccttagcctcctaaagtgctgggattacaggtgtgaaccaccatgcccggcccagggagctatttaatatctattttcagtatcctaaagagctaagcgtacatttttcagtttcggaaaaggaatttgtcacatattgacattctcaggaatacaacctttataggacatgctaccccaaaatgttgtaccttgacatattttttttatttttaagggtggtcaagtgaagcagtgggaatggagaaggaacaaataaatttgtaactggttgtgataagctataaaccagccttgaatattttttaggctaaaggcatttgagaaaatagccaaagcagtaaggtctctcacaccttttcctgccctagtcccctgaaacaggtcataaaaacctttcaaggattttctgacctcttgaagcaggtcccaagatcctcatctgaaatgtcaatcttaaaaaaaggatactagagaaaactatgtctatacatgttgtgtttactcaggaatagaaataaggattataacctggaatgcaaggaatggcaagccaccagtgcattccatgagggaagggtaagggaagcttttattagcaaaagagatttacataagctgcttaggagcggagttcattggttccagaggttcaaagccagagttattatcagttcattggtggagatgcccttactgggcaagtgttcttctgaaaacattttatctgaattacatgtccgagataactgtttccagttcaataattatttgaattactgcagtcctaaagaatgtctagtgataaaccttatcaaagcaggagatgtgtgaaggacacagaatgactttcagaaagtccttggaaactgttcttatctcacaagcatgggcctcctcttctttgggcgttcccggctctattttgtcggggtctagcaaaagttaatttcatcttgctatctgcaactttcacagagaggtgcccttcttatacctagaagaaaggaacatctctcactctgaagacacatagacaccaagaagagtctcagcaaatgggccttaatacatttcccctagtttattaccattatatcatactcttttgccctatcatatttctccacgactctcctctctccatcaaacctagcataacaatattcaggttcaactgtttcttcaggtctacacttccttatgaaagctcttgtgtcatatacaacttaaatttgtaaggccaggtgcactggctcacacctgtaatcccagcactttgggagcccaaggcaggaggatcacttgagcccaggagttcaagaccagcctaaacaacataatgagacctggtctttacaaaaaattagttgggtatggtggtgcatgtctgtagtcccagcttttctggaggctaaggtgggaggatcacctgagcctgggaggacaaggctgtagtgagctagtgagctgtgattgtaccactggactccagcctgggtgacagagccagaccctgtctcaaaaaaaaaaaaagtatgcttttcttttgttcacctgttttttatcataagggactcagccataaacctaagatggggggagggaaagatatttttcctcccctacaaccttttctgtgtaattatgcccagatttatgaaaagtccaggtgactgctattgaggttcagtaaaaggagaaattctctgagagggggaagccagctgactgccaggacagtcagtctttggttggcagaacttgtaaagtgatcaggattctgcattgatactttataaacctcttttgctctggcatccagaactgattagtctctaagagagtgatccaaagagacttctaaggccggtcatggtggctcatgcctgtaataccagcactttgggaggccgaggcaggcggatcatgaggtcaggagttcaagaccagcctggccaacatggtgaaaccccatctctactaaaaatacaaaaattagccaggcgtggtggcacgtgcctgtaatctcagctactcaggtggctgaggcagtagaatttcttgaacctgtgaggcggaggttgcagtgagccgagataatgccattgcactctatcctgggtgacagagcaagactccgtctcggaaagaaaataataaaaaataatgagacttctaagagactattggataaaccacagggttttgtgtgtgtgtgtgtgtgtgtgtgtgtgtgtgtgtgtgtgagtgagtgtttgagctcacctatccaccagaattatttgtatccatcatttaagataccttttttagatgttatgtcacctggaatactaagataatagttggaaggttgcttgataggcatggaattgaagctgaggcaactgaggtagtgtgtgtctttggggctcttggtggaagaaacaagtttcagatatgataagtgttagattaattaggttcacactgcctaggtatgctaactcagactgaagctgtgaggtttctcagtggctccatagccaattatatatgctcgaactcatggcttattgtgactgtcaaatatgtaattaacattcagcttatacacaggcagtaattaaagaaggataggctgggtatgggggctcgtgcctgtaatcctcgcactttgggaggctgatgcaggaggatcacttgtggttaggagttcgagaccagcctggccaacttgatgaaaccccatctctacaaaaaatagaaaaattagccgggtgtggtggtgcgtgcctgtagtcctagctactcaggaggctgaagtgagagggtcacttgaacccaggaggtagaggttgcagtgagccaagatcatgccactgcactccaacctgggtaacagagtgagaccttgtctcaaaaaaataaataaaaataaaataagggagggtaatggaccacagagatggcttgggaaaccaatatgctgatagacaagttgaatgggtctggaagtcctttggatgctgatcacatagtagcgttgctgctgctttttggcaaagccttcagtggcagccgccaaagttggaagaagacctcaaagttctcatgggcagagcctctaaaggtgtcttggactagccttattcttgctgcttttatgatcctcctcagattggtctattcttcattatctcagccttgtttcactttttatgagttcatttcaggtgttggatggtaatgggcaacagcaggtgctatattattaccttagtccattacctatatgtttatggctttgagggggtgaacagctttactgtgggctcactgctacttgacataagtgacttcattttgagacattagaatcacaaattatggtatatcagtaaggatattggagacttggttgacaattgggtaaaattccagaaggcttagtgaaaaatgttagtttccgttaggaaagacagctttgaggaatgagaattttgagaagatacgtaccaaaggaactttgcatttgaggatggtagttgcaggatttctatcccagttgtgtgcctctgagactttgaaagactccatggtctttgttgttgttttttctgagacagggtcttgctctctcaccaaggctggagtgcagtggcgtgatctcagctcactgcagcctcgatctgctgtcctcaattgacacccctacattggcctcccaaagtgctgggattacaggcctgagccaccgcgtctggccttttcttccctctctgcttacattcttaattattctctaacagtaatgtctaaatctgcaaagttctttggataaaatgtatacaaaaggcacaagtggatttataaatccagtacttccattcatggcatttccttgctgttatttcagttgtctgaattgccaagagattcagataccacttatgttttacagaccccttgatagtaaaacaggcagctatattctgtgcttggagctcaaatgagatgtgtaaataaaagaaccattggctttatattctttttttgttttttgtttctttcatttcttggttcaccatatacataggagaggttgacactatgtctaaggagtgaagaaagaagaagtgaataagtgctatggtttgagtgtgttctccagatttcatatgttggaaacttaatccccagatttatgtgttgattggtggtggggtctttgggaggtaattaggattagaaaaggtcatggtaagatgggataattcccttgacccccttgctggacttgtgacaggggtgtggcttgtttacttggctgccgtgtgcccaaaccccttgcatgagggagcacatgagcgagtgcaggaacgagagcaaatgaatgctggaagcagcccagttgatcctctctggcaggagtaggttctgtgtggaccccgtagcagcatccaagcgtgttacaaccagtgctctttcagctctcctgtccagggatgaccaagtgccaaccagctcagtggagggtcagagtggcagctcctgccctctcggcacctgggttcttgtctggcatctgggaagaatcaggtcacacaaacagattgaagggtagtatatgtggaggattttactgggcaatggaagtggctctcagtgggatggggagttggaaaggggattgtgtgggaagaaggtgatgtttccctgaagcccagctgtctctggctgggcccctctccaaagctgcacatctgaaattagccgcatttatccatcgtctctgatgctcagtttcttctctgcttgccactcagctgcttgtatccacaatgctcagccgcttgtatccacattgctcagctgcttgtatccccattgcttagccgcttgtatccctgatgcttagctgctggtatccctaacactcagctgcttgtgttgctctgccagctgaagtgtttttttcagggtggcaggggtgtggggggtaaggacgtggcaggccaaaaagtcaacatttgggcagaaaactgggtcagctgttttcacttagtgcagaggttccaggcttaagggtggggtttagccggagcccagcccttatgtatcaatgtaggggtgagccatgatgggcctggtggctttataagaagagaaagagagacctgagctgccatgcttttcccacacgtgataccctctgccatgatatgacatagtagtaagaaggctctcaccaggtacagcccctcaaccttggactttgcagcttccaaaactgtgagctaaatacccagtctcaggtattcagttatagtaaaagaaaatgaacaaagacaacaagcaacttttgtttttctttttttcttttttttgagatggagtttcgctcttgttgccaaggctggagtgcaatggtgtgatcttggctcactgcaacttccacctcccgggttcaagtgattctcctgcctcagcctcctgagtagctgggattacaggcatgtgccacaatacctggctaattttttgtatttttagtagagatggggtttctccatgttggtcaggctggtctcaaactcccaacctcagttgatctgcccacctcagcctctcaaagtgctgggattacaggtatgagccactacgcccggcctttcttttttggtgtaatccaaaatacctaaatccagtttaaacatccagaactatatatgtttaaatacaaaatgaatttgagataggggtgtgtgtcaggggatggtgggggaatgtgagaggtagtacagaatgaaaaataagttccagttattagtatctcttgagtgggacagttgggacagctgtcctggaagggccatggggatggtttttcataaagaatgaaccatgggatgtccacagtaaatgaattttgccttaggcttgagggaaaactcatttagagccttgaatgctcatctagagtatcaaaatgaaggaagaaacttgtaagtaaaacttatttttgtcttttaaaaggcttaatgagtggccctgtgtgatggctcatacctgtgatcccagcgcttggggaggcagaggcgagaagatcacctgatcccaagagtttgagaccagtctgagcaacacagggagaccctgcctcaaaaaaaaattttttttataaaggcttaacaagttcaagttatagaatgaaaaaatttcaattaattcaatggtaggctgtcatgaaaacaaaacagatttcaattaagaaagggatgtgaaattgagaggcaaacaaaaaggaaaaggggctagttagtacagcagtcactgatttgtctgtatagagagggaaaactgtttttctctcaaccctcattggttcttttcttttttatttaaattgagacagggtcttgctatgttgtccaggctggtctcatacccctaggctcaagcagtcctcctgccttggcttcccaaattgctgagattacaggcatgagctgctgtgcctggccgcctcataaattcttaattggaatagattcctgtaacaaaagacagattgacaagagaagaacaaggttatttcctggagcagagcatggaagatgtgggtgttcagtgaacttcccgagtggccataatggttgtattaataagttattttagtttatatcaagtcatccagcttcagcttgtagggctttgggacaggagaagctagagtctcaataaagatccaggcagtcagattttagttcctagtgacttcaagtcaggaggatgggagaaaaattggaaacattaattaccgacaagatatgcaagacagcaggatccaatttacagagtagtgaaaaataactcagagacaaataacagaactacagtctgataacccaggaagggtaggttgtagttttctattgaaacgtaaaatttctggctggacgtggtggctaacgcctgtaatcccagcactttgggaggctgaggcgggtggatcacttgaggttaggagttcaagaccagcctggccaacatggtgaaaccccatctctacaaaaatacaaaaattagctgggcatgatggcaggtgcctgtaatcctagctacttgggaggctgaggcaagagaattgcttgaacctgggaggtggatgttgcagtgagccgaccgagatcacactgctacacttcagcctgggcgacagagcaagactctgtttcaaaaaaaaaaaggtaaaatttctctgtacagtcatcctctgttttcacttagtgccgtggttccagtttgatcaaagataaaatgaagaccactcttgtttccaaatctaatcttattaaatttggtctaatcatttatataagtgcagcaagaatgataattggacatatgcttgatcttaggttatcgattttttttttttgagacagagtctcactctgttgccaaggctggagtgcagtggagctatctcagctcactgcaacttcctcctccagggttcaagcgattctcctgcctcagcctcctaagtagctgggattacaggtgcatgccaccatacctggctaattttttgtattttagtagagatagggtttcaccatgttgcccaggctggtctcaaactcctgagcttagggggattcgccggccttggcctcccaaagtgctgagacaccatgcccggcccagcccagttttttttgttttttaaattttaattttcattcctattttacagatgagggttatcagttttgatgcacctattagcgtctctggtagggttctggaaattcctacccagtccagtggtatgatttcaaagttatgtaagcaatgtcatgagaaatctataccccagagtacctttataattctttctatgggtctctgaggcagtcacttatgttgaatatgaagcattccagcttgtagctgattgtgagccttcagggaagcattcgaatataagagtaattatatgtgaatgacaaaagacctaaaatggccatggttaaagattttattagagttcattatcaaaataatggagttgacaaggaaatttggtcatttctgtgccaaacaacattttaagataataactggaattatgattgataacattatatcagaatatattatggacagtgagtgcattgacaaatttctagaaacttcatatagttcttttaaaaaggagacagggtcttgccttattgcccaggatggtcttgaactcctgggctcaagcgatcctcctgccttggctgctgaagtgctggggttatagacatgagccaccacacctggccttccatacagtttttggagtatttatattaataacattttctcatacagatatgaacccaaaatatgagactgggtctaagtcaatttggaaagtttattttgccaaggttaaggacctgcccatgacataatctcaggaggtcctgatgacatgtgcccagggtagtctgggtgtagcttgcttttatacaatttagggagacctaatatatcagtcaatacgtgtgagatttacattggtttgatatggaagggtgggacaactcgaagtgggggcttccaggtcatacgtagatttaaaaatattcagattggtaattggttgaaagatttattgttaaagaaaggaatgtctgggttaagataaggggttgtagacagcaaggttttatcctgcagataaagcctccaggtagcagactttatagaaaatagattataaatgtttcttatcagacttacagtctgcattaatattagggctggaggggtatgatgattacccccacttcactttcatggcctgaaccagtctttctggttaaattttagagtgccccggccaatgaggaagtgcattcaaatggttgtgagagccttcgaattttcccccttttgtccaagatttgccagaggcaacatcagtggccaccagattttaattttgtcccatagtattgttgggatggcatggctggcctgcccctggtccatcctgtccttcagtgggactccgtatggccaagggacttagagtaaacaagacttatagccaattaattatcctaagccagataggaatagacatggacaggcattcattaccccttataattattatttattttgttttttaagtagaagatgaacaaacaaaaagccaaaggtgaggttacaaaactgacttatttttaacttctatgctacgcattgagccatagctcaatcttgtttttagttttagtatgtaatcttggttttggttacagacttatggcaattagctatacaaaacatacccgttctgaaaaaatttaaaatatgtatctgtacaactcataactgggagtattatacccaggaggctttgtcacaaggtatcattattcctgtcagtaattattttcttcttttaccagttgttcaggcatctttgtacccatccttgatttggagggtctgaccttgacctaattatatccttcaaaactcgcccttacactctcatgcgacagtccctgggcttagagggaggatgcctgtatagtcttagtagcaaggcatttgcagtgaaaaacagattgggcccagtgggattgttacaggtaattaggcatgagctgggcaggagagagggctctcctctaccaactagaatgtcgggtgatggttcagcaattattgcattgcctgtctaaaaatgataatttggcagcaccagggagaggccatttcctgatggtccacacctgttaacatcatcaaactgttaattgactgcaggccccacggaggagcagcttcctgggcatgcgtattaagagaccaaaaaaaaaaaaaaatggtgaggtatgatcttctgggggcacgctccactggaaaagggaaggaagcctcagatgggcatgtttataactccctaaatacattgcgtgtgttcagttccaaaggataaggaaagccctgggcgtgtggaaagtctgccctaaaggaagaaacatgggaaagaggcgagcttataaaattcctaggatcacggttaaacaaggcacttgaccttttccctttaaccttcacgtgcccacttgggtctcttccaagcacacgttccttgctttcatgttctaaggccttttcagataaacttctattcctgctctggaacttgccttggtctctttttctgctttatgcccctcagtcagattctttcttgtggagaggcaaggactgaagttgctgtggactcctacggatttgctgccagtaacttggatctcttccactggttaacaggatgccaaatgagagaggttggcatctctggttttaagaataccataattttggtttccttgtaagtaatgagaaataaataacattaatattttgacaatcaaaagagtatttgtatgtcagaacagaaaaaggaacctcttccattagggcaccaactaaagatatgaagaaaaattataatctggtactctctagaggattattgtagccaagaaataattcataattcaatctatactcaaaaaaacaaaagttagtgtcaagtgttacacttttcctttgaaacaatttctctctctagacttccttttctattaaagagaaattatagtaagatcaatttgtatgcaaattaagttttaggcttattatactttgcctgattattcacataaagtgcagcaagaattgattggcttggccgggcgcggtggctcacacctgtaatcccagcgctttgggaggctgaggcgggtgggtcacaaggtcaggagatcaagaccaccctggctaacacggtgaaacccagtctctactaaaaatacaaaaaaaaaaaaaaaaaaattagctgggcatggtggcaggtgcctgtggtcccagctactcgggaggctgaggcaagagaatggtgtgaacccaggaggtggagcttgcagtgagccgagattgcgccactgcactccagcctgggcgacagagcaagactccgtctcagaaaaaaaagaaaaaaaaaaaagaattgattggctatgtaggctcctttcaagttggctttgctggaactttacctaaaaatatgctattttagtcaaagtcttggtaaaataaccagtgtctccagttgttttgttctaaaagactcttactgaacttatgcaaataactatattgtcataaaatcacaatttgaattttggacaactcagaaaggtaaatttgcttacaaaaacatagttcacccaaatgctctaaactataaataactataaaaaaaattttttggaccgttctttaaccagagcagcagccttccaaacaaggtgtttgttcacctcagaactgccattcacaagccaaacaggtcatgagagctatcaggcactgtagaatctagcagctcctcagataactagaatcagtcctagggacaaaaagagggtccttgcttatgagtatttccttcttgtattcccaggtagcaagagcctgtgtaaaccattttaattttatcatggaactcttttgaacacctttatttccattagcataggggtagctcaagccaatattccataacaaggcagtaaatgtccctcaagtagaaattctctagtccagcagttgttattgggaagtgctcacagttttttgtcataagtcccaatactccacaaaaggctacaaagtggaggatttgtcccatctagtactccagcttctcccctatattttgtgggctaaggcaatctttctagttcccatttagtaagttcagttaatatttgtcaaagggcagatttacctgccttcagttttatagtactagatagggaaaacatcccccagtcacatacagtacccattttcataagacatttaggtaaaaggagtcacaactaccttacataaagtctgtgtaaacatctcagatttcataattctgttaaactgtatggttttatgttctggtcccaggaacttttctacccccagaccattctaccttttctggtaaaaaagggtttgggttcccagcagggagttgagccaagggactcaggccttttcgtcaaatttatatcttaatttgcctcagcattgccccagaaaatgtcagctttctcatgataacctttgctgccttaaaaaacattttccagtctagggcaaatagtgaataaccatccaaaaatttctatcactcttctgggatgaattcttttttttttttttgaggcagagtctctgtcacccaggctggagtgcagtggcgcgaactcctcggctcactgcaagctccgcctcctgggttcaggccattctcctgcctcagcctcccgagtagctaggactacaggcgcctgccaccatgcccgggtaatttttttttatatattagtagagatggggtttcaccgtgttagccaggatggtctcgatctcctgacctcgtgatccgcccgcctcggcctcccaaagtgctgagattacaggcgtgagccactgcgcccggctggggtgaattctttcgctccctttttcctttcccttttttttgttaataaccccccctttttttttgggatggagtctcgcccaggctggagtgcggtggcgcgatcttggctcactgcaacctccgactcccgggttcaagcaattctcctgcctcagcctctcaagtagctgggattacaggcacttgccaccatgtctggctaatttttgtattttcagtagagatggggtttcaccacgttggccaggctggtcttgagttcctgaccttaggtgatccacccgcctcagcctcccaaagtgctgggattacaggcataagccaccttgcctggcctactccagtgttttattaagcatgtgtaagaccatgagggacagcaaatttgataaggcttctcaggcaattatatgattctgtgggaggggtacccatgtaaaaggggcccctttagccttcagatttaccatgaactgcgttatggacatattaggtaggagaatatcctggtcattataaagctagttccatatggcttgcatatgaagcatatcaactgtttcatctgcggtgctctacttggtattttatagggagagcaggaagtcccgttctcagggcaaaccttacagtggcatttatttggtccactaggctggttgttgtctcaggaataactttctgtgcatttagatcacatacattcatcagtgattgtttaatagtgagctttgggtcctgcattaacccaaacaagctctttcattctgtagcatttaaaattaagaattttgtccttaaaatggtcatttttacagtcccttactataaaagtttctccagaatctgatgataccaatctatgaaacagaacagttcctttacattatatcctctgattttaatagttacttggttgtgcccttccccaacattgactatcttcttggtaaccacaggcctcagaggtaactttatttgtcctggcttactttttctttttatccatttagttttatttgtacagtttttcctttattttaaagtgatgcttaaatagtctcttaactaggaaaaaaatttacattttcttcagcaaaaaacacatcctcgtgtttgtttatttatttttgagacagtcttgctctgtcgcccaggctggagtgcagtggcatgatcttggctcactgcaacctccgcctcctaggttcaagcgattctcctgcctcagcctcccgagtagctgggattacaggcatgcgccaccacggccagctaatttttgtatttttagtagagatggggttgcaccatgttgtgcaggctggtctcgaactcctgacctcaggtgatccacccacctcggcctcccaaagtgctgggattataggcatgagccaccacgcctggctgtttgtttgttggtttgtttatttttgagacagagtctttctctgtcacccaggctggagtgcagtggcactcatgatctgcctgctttggcctcccaaagtgctgggattacaggggtgagccactgtgcctggccttttttttttttttttttttttgatgtctcactctgttgcccaggctgaagggcagtggtgtgatcttggctcattgcagcctccatctcccaggttcaagtgattctcatacctcagcctcccaagtagttgggattacaggcacacatcatcacgctcagctaacttgtatttttagtagaggcggggtttcaccatgttggccaggctggtcttgaacttctgacctcaagtgatctgcccgcctcagcctcccaaagtgctgggattacgggcaggagccactgtgtccggctgttaatttatgagtactctttacctgtaagtcaatctggtaccttgtggccaaaaacacataacagaatatgtgtacatatacctaaacacatatatatatatatacactcatacaaagttcctgtagtttatgcttcagaactctagccatgagatattaacagagacttaccagtttgcaaacaatagtaaaaagaaacggttggatgcaaacagtggattttatctcagtagaaaagtaacagcagacttaaagcaggctgaaaagaaagcagagagatagagaacttaggaactttatagttgcagattgactttcgagctctgaatttttcttgatgtaatttgcccatcagtttaaaatgtgcgcaagaacagacctataatgtgtaaccagctgcagtattggaaaacctggcatgcccttccattacacaaccactttcaagtagaggggtcatgaaaccaaacagggtgcctgagagggaccactctccttgtgttttttcattcctaaattatttgtttcccacattttttcttaaaaggaggaactgagctgtgccttaaggtttagtggagtgggtcaaagtgtgctggttgtgggtgggactccatagtgtgtcaccagtgagtcatttctgcccttttatgtgtctcagtttctctttctggaggtccagcaccatgaggagggctcaaagtgaggaatgaggctgggtgccttgggtcacgcctgtaatctcaacactttgggaggctgaggcaggtggatcacttgaggtcaggagttcgagaccaacctggccaatatggtgaaaacccgtctctactaaaaatacaaaaatcagccgggtgtggtggcacgcacctgtaatcccagctactcgggaggcttggacaggagaattgcttgaactcgggaggcagagcttgcagtgggccgagatcccgccattgcactccagccttggcgtctcagtgagactctgtctcaaaaaaaacaaaacaaaacaaaacaaaaaatgaccagctcctgtatgcatttcctggacaataattttttaaactaattttctcgagagttccctgtagggctgctacacgttgtagggggtcaaccctgcaggcacttccacttggcccccagtcacccagggacgccttttggttggaaagagcaaaatgccctttctttttggagctgaggaaactcagcctgtcatctatgaaaatgatagttcagttcctcacacaaatgtgcacatgagccaatcgagattaattgcaggaggaaaggcaatgagaagactctttagaatgcacctctgggccaggtgtggtggcttatgcctataatcctagcactttgggaggccaaggcaggtggatcacttgagctcaggagttcaagaccagcctggccaacatagcaagaccctgtctctacaaaaagtacaaaaatgagctgggtatggtggcacacatctgtagtcccaactactctggaggctgaagaggaggatttctggagcctgggaagttgagactgcagtgagccatgatggtgtcagaggactccagcctgggtaacatagcaagactctgtctcaaaaaaaaagaaaaaaatataataataatagtaagaatgcacctccgaactagaattaggatcctagacaacaacttcctaggagcttagctaaaccagctaagaccacttcctgtaaactgtcctcagccactcttaactttgtagctctcatctgccattacacatgccaaggccaaatcctctcatggtacaaggtaatttctggcatctccaaaagtcagagtcaggtagtgcaatacaggaaagcagaactgtagacctaaaagaatctgcccatcactcgtgaaaactccataaagaaaacaggacatcccaaacagtggcaagtggtgcctttgttctgagttctttaaggggttcgggtcattagaaggcttctctagatttttttttggcagcaaagatggggaaggggaaggggaagtaggagtaaggtggaagaaaagacaaggaagcaaagacagaaaccacgtgcatggttttgttttgtttttcctttttgctgctgcaaggaattttagccaattcggaggccttgttccccataattggaattctcattcagatttggccaagtcggttagagttggagctcgtcaaacctgatgggagaaagaccagaacaacaacaaaaacccaacaatatgattactgagtgctccaatggtaaggtgaaattaagaccagctgattgttaattgtaactttagccgaatgaaagcccagttcagctacttacctaggaatgggtctcaggttgaagactgctctctactatgctacaagcaggaaaaaactcaaactccagaaaggagttagctgccttccatcattatggaagcaggaaaacttgccttccttgttggagcaagtaaaacttcagaaaaaggagttgtacaacaaaataaactttagatcttgaccaaattttgggagatcagggattctctggtgtggggcctcccaggcctcagccaattatcctcttggtttgagagtaaagatagatcaagctggtaccaagcaccagtaggcgatttgtcaaaggtcaggggcacttgcactcagaagacctttcaggttgccaaatgtaaacccaaaatatttgagataggtttcagtgaatttagaaagtttattttgctggggttaaggatgcagccacgacatagcctcaggacgtcctgatgacatgtgcccagggtggtcagggtacagcttgcttttatacaatttagggagacataatacatcaatcaatatatgtaagatttacattggtttaatgtggaagggtcagacaactcgaagtgggggcttccaggtcataggcagatttaaagacattctcattggcagttggttgaaagtcactgtcggtagaaaggaatgtctgggttaagacaagggattgtggagaccaaggttttatgctgcagattaaacttccaggtagcgggttttagagaaaatagattgtaaatgtttcttatcagacttaaagtctgcattaatgttgatgctagaggggtgtgatgaggcatgtcctacctccacttcccttcatggcctgaaccagtcttcctggttaaattttagaatgccctggccaaggaaggagtgtattcagatggttgtgggagcctttgaatttttatttttgttttacacagatataacttaagagaaggttaagcatcacttctacaatgtttcccatgcaatttaacatgtcaaataaacctaattaaaaaaaattaatcagagagaagttcaggaaaacctagttatttttaacatctctctttttaaaagttgaaaaaacaaaccctttgagactttcaaggggccctctggaaaaatctcagtttgagatcaagattttatttaggatttgattttgagaaggcaaaatgtcaaaaggttcgaatgtttgattaaatagggtcccaggtcacttttttaaaagaagacttggttctcttaaataaggatatgataaagcactggaaattattccaataagacacagaatctttgtttcctaggcagattacttaaaaagtaaagaaaaatcttttacacagtctctcatgaagagcagactagtagtccaagaaatttagtcccttgagagagaaaattgaactctagttttactacactattactatttactacactattactagttttactacactatacatcagtacactattgatattaaagcttattttaaaacctcgtaaataaacccattcagtcttagccagctcgaccatataaaatactagtttttttctcttgtttttttcttccacatttcctttacaacttcatatattccttcaggtttttgtccttttctctttctcattctggaacaacctttcaacaacctcttaaacaactacaaaaacatattttgcattccttggatacttttcatacagagttgtctcccttcatgcttattgcttctagtagttttgtttacgtatataaattatttttaacaattaatctttattttacagggaaatctaggaagtagacagtcgtgaattgtctgtcacataccagcatttttttagcagattagtaaattttatgaatatagcatctcacatgttctagaaatataaacttcttcataataaaacttctcaatgttgtcaaaagtagatgtttactaagagacccaaatatctttagtttctctataaaaataagtactaaaagcatatataatttaaacttatgtttagtaactgtttcagtattttattttacttagaacaatctatatatttaatgaatacctgtcacttagtataacttaaggtttcaaattaccaaacagattttggaaatgactttttttttattttttaaacagcctttgagcaaataattttttcttttaaaaaaatttgtacttttaggccaggcgcggtggcttatgcctgtaatcccagcactttgggaggctgaggtgggcggatcgcctgatggtcaggagtttgagaccagcctggccaacatggtgaaaccctgtctctactaaaaataaaaaattagcctggtgtggtggcgggcgcctgtaatcccagctactcgggaggctgaggcaggagaattgcttaaacccaagaggcagaggttgcaatgagccaagatcgcgccactgcactccagcatgggcgacagagcgagatttgtctcaaaaaacaacaaacaaaaaaaatttttttttgtactttttttttttttttttggagaagtggggtactgtatgttgcccaggctgttctcaaaattccaccctcaggcaatcctcccgcctcagcctcctgaggtagctgggcttataggcatgcaccagggcctgtcttatttctacttttaagacttatgaaacacaattgttgaaatagtttgtcagaacagagactcaatttgattaaaatcacatctgtaaatttatgatcttaaacatctaataaatatattagcttattttatcagtaagcccaataaataaaatatgtaaatataaatacaaataaaatatcaataaagtatacatataaaataaatgtctgcattatacttaatttggaaaactctgaagacattgaagacatatcttttaataaatcaacaatattatttttgttgtgtttttgtcacctaggctggagtacagtggtgcaatcaccgcttactgcagccttgacctcctgggctcaagcaaccctcccacctttgcctcccaagtagctgggactacaagtgtgcaccataacctagctaataaatcaacaatattaaactatttttttcttttttctatgtcctgcaggcattaactccaaaaacacatacatttaaaaaatatttaagttagttttctatatttttgagagtttcgggactacttaatttatgtaagtgcttattttctctaagcccattatttagaatggagctcttttattaattgggtaataccatctggaggtaggaaaatatcacatgtgcataatatatatacacatatacagacaaaagcagagaatattatgactttcactctaaaaatttagtctttagtcaggcataaatacagtgatacagaattcactagtttaaatataagagtctgttcttgtctttgcctcactttatttttttatctgaaatatttttctagtggatagaacaaattgctcaatatgagggctaaaactttttaccaatatttgcagaggagacttttaagactttgttttgtcttgttgtatttatggaggatgtagactaaattctgttcccatttatcatttttagccccaggtggttgctttcaaggtccctgagtccccttcaagatctccctagggaaggagcagaatgcctaaaattccagtgactacagggacttgaggaggtggagtctgaagggatgggtctcagaggagccagcttgggagatatttaggttttctcacagaagccattgaagtgctgggcacggtgtctttgcacctataattccagttactcaggaggtggaggcaggaggatcacttgagtccaaacccagaagttcgagaccagcctgggcagcatagcaagaccctgtctcttaaagcaaaaatttaaaaatgaagccattgaagttctaaattatgcttagtaaagttatgccaataagaaaggaagggaaagagctagtgctgccgtggcagagcatatagtcagcagggttttgacaaggaagggtttcagttgactgagaaattcccatgagaagagcagggtgaagtgtagagaaccgagaagccttgaaacaaagagccagggagaacttctagcctaagaggagtacagagaggctcaaaaccaaaactgggaagaagagttccagcccaacgagttccttccaaacaaagaagccttagattctaacccagcttcagagagcacagtcattcaaaatgtgactgaaataataagcctttttatttatggcttacccatggatgcaataggtgttcccaaaaagtgtgtagaagatggagcctctgttccaaagtcactcccaaagatatccaaagagagaagaaataaaaatcttttttgctgcaggcaatgagaatagtgtttgtcaattccagatcaaggcagattcagttaaaataaaaaaaagaatgatgtttgtgaaaacttgtgtccgtggcctccaacaaaagtgagatacttttgacactgggtaggtgatgctgaaatgggattcctcagtactagcaaggcggcaaggaaagagatgacgcaggcccttatggactgagatcttttatttagacagactcccttgagagctggcatggtccttaggaaagtatctcaggcccccaggccactggctgcctgcctgcagacatagacccactggcaggtagaaaaccaataacgagaatgcagtcactggattcaagccaaggtctcaggacacaaaatgaaacaaacaggacactatggctatccctgagaaggaaaggatctattataagagtacttgaaccaagagtgacagtacccgaagaactagttcctaaagtgtttcctcctataaatctagattttggaaaatcccttttagaaaaggaaagcagaagctcttaacatgcttactcagctggaccccgagatttagggtctgacaggtaatatgtttattttcactggctgggtcataggtcctgggatttcagttgcagtttccagaacaagcaggaaatcccagccatcccaacctcactgacaaatctgttgggaggaaaactttccctcctccaacctgggtttagttgttggggacctgcacattatccgataataggcaggttgataggagaaaagacagggtttatttatgtgtgtcatgggagtgctcagtgatgagtaattcactcaatagtcagagataaaaggtttatacagtagttccccctaatcccctatggattaatatgggattcctctatgttccaagaccccagtggatgatcaaaaccattgatagtactgaaccctggccaaggaatgctaaggtcactttttcgcttaaaggaagcactttatggcttctctttggcatatccaagttgccagcatcgctatttttgtgctttgggaacataactaagtaaaacaaaggttactttaacacaggcactgtgacactgaaataattgacctgataactgagaaggctactaagtgaccttgggcagcatatacagcgtggatacccagaacaaaggaaggattcatgtccaggtcaggaaggagtgggagggtgcaagacttcatcacactactcagattggcgcacaagttaaaacttgtgaattctttctggaattctccaattaatattttcagttcttcactgaccatgggaaactgaaatcagggaaagccaaactgcagataaggaggaactattgtttaccaacttaaaatggaggagaggggtttagggcttcaattggaaggtgtagatggttctgttggcctttttgctgccaatggcaatgggcagactctctatggcagctgaattccaggaaactcccacggagagagggttaatgacagctgggctttccagagggaagttggataagggaagttcaggtaatatgtctttctgcggctgggcacagtggcttatatctgtaatcccagcacttcgggaggtggaggcgggtggataggttgaggccaggagttcaagaccagcctggcaaatgtggcgaaactttgtctctactaaaaatacaaaaattaggcatggtggcgcgtgcctgtagtcctagctacttgggaggctgaggtacgagaatcacttgaacctgggagatagagattgcagtgagccgacatcgtgccacagcactccagcctcggtaacagaacgagactctgtctcaaaaaaaaaaaaaaaaatctttctgcatcttcagttcaaattacttttattttaaaataatctttattccaactctgtggatctaagtaggtgccctaatattgaaatctttctaaaatatattaaaactcttacctgggactttcattattttaacagctttattgctgtataatggggatatagtaaactgcacatatttaaagcatataatttgataaagggacatatgaatgtatccacgaaactatcaacatgatattcaacatgatagcgaacatatctatcactcccaaaaatttctccagtgtccctttaaaaatttcgcccttgattctccccaaaccatccctgtcaggaaaccagtgatctttttgtcactgtagatttgtttacatattctagagttttatataaatggaatcatacaatactctttttttgtctagctaccttcactcagcataattattcttgagattcattcatgtttcttgtatcaatagttcattcctttttattgctgagcattagtccattgtatgatataataaggctggtatgaccatttgcatatgtttgtgaaactgccatggcaaaattgtgacggtaaaagaagtttgacatggctgactctgtcttggttctaacctcaaagctatctttgctcattcctgggtataggccaagctcatgatgggaagaatttagtttatagtttaacctgaaagcaaggataatattcctttcctaaaacttaaccccttccttgttcagggaccgaaaaccacttttgtcagactaatgaaaggccacaagattaggattatgtgaggggtctgaattctgctaaaatataggcatagtttttataatcctttcctgctcaggagtcctgtggccagaggtgacaggatttgtgactttcccaagtgctcctgtagatgacatcactaatgtagaacctaagattggtcttttgagatttttttcaaactttctggcaaccgactgatccccacccagaaccatgactcttgactcagctggtcctgtggccccacccagaggcagactcagcccataaggaatgttttccatacatatatgatttcatccttaaccagtcagcagcactcattctccagccccctgcccatcaaattttccaggaaaactctgcctagcttctgagttcttggagagactgatttaagtgataactccagtttccctgtgttgctggccatgtattaattaaattctttctttactggactgctgcaatctcagtgaattgattttgtctgtgcagtgggcaggaaggacccactgggcgattatgtttctatggatgtatgctttcagttttcttaggtaaatacctaggagtgaaatggttgaacataatggaaagtgtatgttcaacttttaaagaaactgataaactgcaggagtgatggtgataactgcaccattttgtgctcctactaacagttcataatagtttcagttctttgacctccttgccaacacttgaaaaatattgaggttagtttcttttttttgagacggagtcttgttgtgttgcctaggctggagtgcagtggcatgatctcagctcactgaaacctccacctcctgagtttaagtgattctcctgcctcagcctcctgagtagctgggattacaggggtgtgccaccatgcctagctaagttttgtatttttagtggtgacggggtttcaccttgtgggccaggctgatctcgaactcctgacctcaggtaatctgccagcctcggcctcccaacgtgctgctgggattacaggtgtgagccaccatacccagcctagtttttatatttctgagagttttaggattatttatgtaagtatttctttttcttttctttttttttttttttgagactgagtctcattctgttgcccaggctggagtgcagtggcgcaatctcagctcactgcaacctccacctcctgggttcaagcaatactcctgcctcagcctcacgagtagctgggactacagatgcacgccaccatgccacctaatttcttttgtattttagtagagacagggtttcaccatgttccccaggctggtcttgaacacctgagctcagtcaatctgcccacctcggcttcccaaagtgctaggattacaggtgtgagccactgtgcctggctgcatttatttttctttgagctatttagaatagagctcttattaattggttaataccatttggaggtaggaaaataccacatatacatactctctatacatacaaaccattcaataattctaatagatgtgtagtagtacctcatagttttaaaataatttttaatttttaatttttgtgggttacgtagtaggtgtatcattatagttttaatttgcatttctctagcaacctgaaataatcaaaatccactttaaagagtctattcaggccgggtgcggtggctcatgcctgtaatcccagcactttgggaggctaaggtgggcgaataacagggtcaggagttcgagaccagcctggccaacatcgtgaaaccccatctctactaaaaataaaaaaattagctggcagatacctgtaatctcagctacttgggaggctgaggcaggagaatcacttgaacccgggaggcagaggttgcaatgagccgagattgcgccactgtactccaccctgggcgacagagtgagactctgtctcaaaaaaaagagagtttatttaagtgaaaaactgggaatagccatccaggagactccagagaaatggagtcattgctctgaaataagtttttgcttatataggcagaaaagaaagaagtttggtaggagtataacattttgtatacaaggctggtttatgagttatagcagatcaattagttacattttgcatttttccctcccatggcttgttttgttttctttatagctggttttcattttctttccaatttaaaagaatgtatttaacattctgtcttattgtgatagtcatgaagtctttgtgtgagaaaggtaagagggaagttaatctataatgaagattaacagtgaagagaggagtcttccctggcatcttttagtcatttgcaacattttataaaactgtaggtaaagataaaggatagtattactctagagggcaggctaaaccattatgcttcactctctctctctctcttttttttttttgagacaaagtctcgctctcttgcccaggctagagtgcaatggcacgatcttggctcattgcagcctccaccttccaggttaaagcaattctcctacctcagcctcctaagtagctgggattacaagggtgggattacaatagtttttctatttttagtagagacggggtttcaccgtgttgcccaggctggtctcaaactcctgacctcaagcgatccacccgcctcggccttccaaagtgctgggattacaggcgtgagccaccatgcccagcctgataaaggatagtataatcaaagaaataggtttgcagctgcctaggttatagctacttgtcatgtgacttaagccctataaatcacgagtttaaggctcaaaataatttggcgttccaacagctaagattttgaattacttatttccacatctctaatgactgagttctgtttatgtgcttattaatcattcccatatttctttggtgaaatgtctatttaaatgttttgctgctgggtgtggtggctcatgtctgtaatcccagcacttcggaaggctgaggcaggaggattgctagagctgaggttgaggattgccagaagttcctctctctctttctctctctctctctctctctctctgtctctctcgatggatcctcccaccccagcctccctggtacctagtagctggtactagaggcatgtgccactgtacctagcttgtctttgcattttttaacttcttttcttttgaactgcgtaagttttcagttttgatgaagctcagtttattagtttgtccttttattggttgtgctttcggtgttgtatctaataattctttgctaaccaaagctttcaaagagttctcttctgtttgtttttttctataagctttacaattttagcttttactttttgtctttgattcattttgagtttgtgtgtgtgtgaattacaattttaatgcattctcaatagggacaagaattgatattttttttgagatggagttttgctcttgtcacctgggctggagtgtgacggcacgacctcggctcactgcaacctccgcctcctgggttcaagtgattctcctgcctcagcctccctagtagctgggattacaggcgcccaccaccacgccaggctaattttttgtatttttagtaaagacggggtttcaccgtgttagccaggctggtcttgaactcctgacctcaggtgatctgcccgccttggcctcccaaagtgctgggatcacaggcatgagccaccatgcctggcctgattcttagggaatgaaagaatattactgtttttacatataaagcacgggtatatgtagcacataaacagatacacagtttatctgtggtattaccgtttcatgagggaaggcacaattaggttgaaaatgtctagaaaggttccttaggggtgcaacaatgaaaagttgagaaacaaggtctaatttatactctgaatgttggtacacaattgtcccagtcccatttgtccaagagactatcctttctcccattgaattgccttatcagctttgttgaaaatcagttggttgtttatttctggactgtgaattctgttccacagatctgtatcagacaacttggttataatatcacatatagtagatagaataattgttcagatgcattaaatgttagcacctcaaaattaattccttgtaaaattttttttttttttggagatggagtctcgctctgttgcccaggctggagtgcagtggcgtgatcttgactcactgcaacctctgcctcccaggttcaagcaattttcctgcctcagccttgagagtagctgggattacaggtgcgcaccaccacgcctggctaattttttgtatttttggtagagatggggtttcaccatgttggccaggctggtctcaaactcctgacctcgtgatccgtccatcttggcctcccaaagtgctgggattacaggcatgagccactgtgttcagccccatgtaacttttacttgaaagaaagcgcatagttttttttgtttgtttgttttgttttttgcgatggggtctcgctctgtcgccaggctggtatgcagtggtgcgatatcagctcactgcaacctttgcctcccgagttcaagcaatttccctgcctcagcctcccaagtagctgggaccacagatgcatgccaccatgcccagctaactttttgtgttttagtagagatggggtttcaccaggttggccaggatggtctcgaactcctgacctcaagtgatccacccgcctcggcctcccaaagtgctgggattataggcgtgagccaccacgcccggcaagaaggtgcatagttttaattgaaggaagatggatgcgtgtgtgtgtgtgtgtgtgtgtgtgtgtgtgtgtaaaatctttttaagagatgtggtctcgcttgttgcccaagaatgcagtggggtgtttatagctcactgcagccttgaactcccacctcagccttctgagtagcagggattacaggtgtaggtttataacctgcttcataggagattttgggggtggtttgtgagagtggtctttctgcttctgttttctaaaatgcctagatgacatattttggggtagcacttcctgtaccccatcaattccatgaaactatatagctttataactgtaaaatattgccatctaatttgaataaagtcctatcttttccatataaggatagaattttcagtcttttttgtgactgtggttttctgttttttgccaaagatgcttaactcagtttttggattgaccccattgctggttaagttggaatctgcagaaattaacgttagccgtaaagtctttgtctcctttttttcattacaaaaaaaattatgtggcaatagtctataaaatctttgtcttaaagacaaatcaacaagaggaaacttataaagaaaggaaaaggacatgccacccgctggtgttttactgagtttctttgacgtaaaaacacaagcaaactattctttttattttaggaatttgagtttattgttaaatccattctctaataaaccaaactcttttcttcattcctgttaagagttgtaaataaagatttgcaaagcattatttgcccttggaaaagcagagaactactcatggaataaccctaagtgagggaaagaggaaaaaaaaatgtttcttgagtgcctacagtgtgcttagtactattgcatgctttagaatattttcttatttgaatcttgtgactgtcatttaagattagtattattagctgcttttgaaaacggatgaaatgaaggctcattttaagttcaggggtacatgtgcaggtttgttatataggtaaacttgtgtcatgggggtttgttatacagattatttcatcacccaggtattaagcctagtaccttttagttatttttcctgatcctctttctcctcccactctctaccctctgacaggccccagcatgcgttgttcctttctttgtgtccacaaaccccgttttctgtattgtggtttctttctttccttttttttttttttgagatgaagttttgctcttgttgcccaggctggagtgcaggggcgcgatctcagctcaccacaacctctgcctcctgggttcaagctattctcctgcctcagcctcccgagtagctgggattacaggcatgtgccatcacgtctggctaatttttgaatttttagtagagacaaagtttcaccgtattggccaggctgctcttgaactcctgacctcaaatgatccacccgccttggcctcccaaagtgctgggattacagatgtgaggtaccttgcctggccacaaatgtttatttttatttaatacacagtcataatgtatgaattatctgatttttgtactcacatgtagacaattctaccatagattttctgggaacagaccttattttcattatcctgctgtcagaatgtgttagatcataaatgtttggttttataaatttatatatttttatgtttctatagttttagtagtttttttagagaaaacttttttcatagtatttatttataatgactttaatattgtatagtcataccatattgtttagtagacagttggattgtttctagactttcttgttgatagtacttcagttcgtgcttttgtacagtttttgcatctgttgagttatttattcgggccttttctcagaggtggggttattagattaaaggccgcgaacactgattttattttgtcatgttgctttccatgcagattttttactttatacttaactcattgtactagttttactgctcttagttagcattgtttgtttatttttgctcatttagttataaatagtgacttaagagtgtttacatctccttttgttttattactgtttacgatggtttcaccatgtgcttattatttgtacattctctcatgtgaattgtcttttcgtatcatttgcgtatgtatgcatggaaatcttgatatgttatataaaaataatgatattagccttttttcagtaacttgtaaagattatcaggaaaggaaataatgctaggacaaggaaaggaaggtccatgttcaatggaaaccttaatagtatatatagctatgaatactggagaaagaaaatttttatttttaggaaataatacgtgagtaacaggaataaaaggggaggcacttaatatttattgaaaccctagttagttttaaaccttagggcaggcattttataaatgtaattttatttaatttttataagactactagctagatatttccccattttacagataagtaaactgagacagaaaaattaagcaacttttccaaagacacacatcttgttcataaaagctctattactgaattggctaattgcttcatggctgtgacatattacccataatccacatattttgaatctggaaactcatgtcctttaattatgttgggaatgaagtttttggtgttgcaaaaaaagaattaacgccgtgacaaatgatctctcagcaaggtgagctttactttttgcagaaagggtgctactcaaagctgtccagccacgagagcacaccaaacaaaggagccagttatttataacctgacacgtctaccctactgctgtgtccagtttccattggctggaataggacctcacattttacactttacccgattggctgttagtttaaaacttttttaattgggtaaggggaacagaacaaagaaaaggaagttgcccagggatagttaaggaagcttctccaaataaggaatggcatggactatggactggggcttgtctagttttgtccaggcgtgccagagcaagctaggacagctgatttggaatatatgtgtgtgtgtgtgtgtgtgtacacacacactgtaatagtggatagcaatcttatagtaagaaattgtgactttttataatctttgaagaagaactttcccatttctcacaatcccttctctttttactttatacttcttcttcaaatttgtttagcatgttttgactttgttgtttggcctgatcctctggaaggagcagtctttctgaatacagtggcgggggagttggggatagattagtaagggtagtactgacgagtttctgcactaaccttcgagtacaaggtataatacaccaacaagaaggagtatacttaatacagtagctaaggaggtgagaactgaagcgatagtttcctttcatctgccaaactaactcttttaccagtttgaaatggggttactaatgtcagaatttttagctaattcatctgatagggcagtaagtccttgtagagcttgggttatgctcccattgggggcagtgttatttggaataaatgtacagcactgggttttaatcattacacagacacctccctttttagctaacatcatgtctagggctttcctattttcccaagccatttgactggtagaccctaattgctctgcaattcctttctttccccctcgggaggtaaccttcctcccgtgcctttcccttctggaggttctttgcactcgttcagccccgctgccagaagtagaccaccaaggaagtagtttgtcaccctttgcaacatttcctaccttggccctcgggcgaggttacctggttgaggcccctgatatctgcggcttggtaagccactccttctttttggcgttactgagagtccagatagattgctcgcaccaggtgtgtcctggctctcttctcccgggggctgccgcaaagggcagtggggcgcctccccacgagggagggcaagagactgccctagaggggaaagggagccccacgttggagcaccaaattgttggaaatgaagtttttggtgttgcctaaaaaaggaattaatgtgggaacaaatgatctctcagcaaggtgagctttactttctgcagaaaaggtgctactcagtagctgtccagccaccaaacaaaggagacagagttatttataacctgacacatctaccctgctgctgtgtccagtttccattggctggaataggacctcacattttacactttacctgattggctgttagtttaaaactttttaaattgggcaaggggaacacaacaaagaaagaaaaggaagatgcccagggatagttaaggaaacatctccaaatacggaatggcatggactgtgggctggggcttgtctagctctgtccaggcgtgccagagcaagctaggacagctgatttggaatatatatatactaatagtggatagcaatcttatggtaaaaaattgtgactttttataatctttgaaaaagaagtttcccatttctcacaattctgagaaatctttttgtataatttattggataatttcctctataccatatttttccctcttctaattttgaaactcctgttattcatggttggaccttcttgcttgatttctttaattttcttcctttttttcttttcttcaatttttatctttttgcctttttggctatcattatagaaattttctcaactaccctgctgtgttaatttttcatttctgctattttatttccagatattaatttctcatttgtctttaatgttcctttaaacaagtagggagttggtacttgttatgtaggtggtctcttgtttatttctgataatgataattataggtcatattttgaattttaaaaaactccctgaattgtttgttcctgtaaatttctatttttttctatttattttgttctctttcacattggagttttcttcaaatatttaatgcttctttactgttatttatatttaagagtgatacacgaagaggttgattagaggccttgtgagtatgggcatagctgaaggcctactgaacttagtcatatgatgctggggtatataccttacagtcagtatctgttaagtttattttcctggtcggattgctcctcagagaggaattttccactacttctgcttggaagtcctgctgccagtgttcttggagcctgttgtataataaagaatgtggttggcctttgcccctggttcctaggacagaggctttaaatcctggaatttcttccgtgataggagtgtctttatttttgacactaggcccctcagatcatactttatagtttttgccaaccaggtgactgatagtgagcccctagatagtttatgctaatgaatgacacaggatggggattggtaactccagaaagactgtgattaaggagttggggctttcacccatgcagtatcaccctgacctccggggaggataaggtggggctggagattgagttaaatcatgtgaccagttattcaatcattcatacctacgtaatgcagccccagtaagatctctggacactgaagtttgggtgagtttccctggtgaacagtactctgtgggaacccctgaatccctggtgaacagtactctgtgtatattgttattgcacctgtgtgataggtgggtgatttgtcctgactccacaaggaaaggctgcagaagcttcacatttgggcccctcccagaccttaccccaggtgtctcttattttcactggtcttgatttatgtcctttttgctataatcaaactataattgggccgggtgtggtagctcatgcctgtgatcccagcactttgggaggccaaggcaggtggattacttgaggtcaggaatttaagaccagcctggccaacatggtgaaaccccatctctactaaaaatacaaaattagctgggtgtggtggcacgcacctataatctcagctactcgggaggctgaggcaggagaatcacttgaacccaggaggcggaggttacagtgagccgagatcatgccactgtgctctagcctgggtgacagagtgagaccctgtctcaaaaaaaaaaatatatatatatatattatatacacacacacacacacacacacacacacacatatatacatatatacacacacacacacacatatatatttgtaagtataggactttcctgagttctatgtgttgttccaccaaattattgaacctgagggggtagtgggaacccctgaatttatagccagttttttgttttgttttgtttttttgagatggagtctcactctgttgtccaggctggagtgcaatgacaccatctcggctcactgcaacctgggccaccccggttcaaacaattctcctgtctcagcctcctgagtggtgcacaccaccatgctcggctaatttttgtatttttagtagagatggggtttcaccatgttggtcaggctggtcttgaactcctgacctcaggtgatctgcccgcctcggcctcccaaagtgctaggattacaggcgtgagccaccatgcccagcctggccagttgtttagaagtgaaggtggcttgggaaccctcaagcttgtgattagtgtcagaaatggtatcctcttttagaaggatagtacccttaacttgtaaagttaggcctaagtcttggtagtttgtatcagaattgccttgcagagtcaaaggagaaaagaggcctgggcaccgtgccgtcagcatgtagaattgcactttacctaccagttttcagaataagtctctttctctcagttgtgcctgagatccttgagtccagacccctctgcttcactctccagaatggaaaactacagtcttccaccagggttggtgatgggatggtggctgggccaagtaagccgattttcaacctcttcttcggtttccaacctgttttccaaaatccaacagatttttgatctgtttccctactttcagtcggaagtagatagtgtttcccatttcttatttctctggagttatccagtgggaattgcttgcttcttagctgccatagcaatcatatcacttaaatgttgcaagaatttgttactcttttctgttctttctctcatctcattccctatattttcttttttcttttttgagacagggtcttgctctgttgcctaggctggagtgcaatggtgtgatcatggctcactgcagtcttgatctcttgggctctagcagtcctcccatctcatactctctagtaactgggactacaggcatggagccaccatgcctagctaattttttatagagatgtggtttcaccatgttgcccaggctagtctcaaatgcctgggcttaagcaatccgccccatttggcctcccaaagtgctgggattataggcgtgaggcactacaccctggtcttatatttttcatttttgtgtttgtaataaagaattgaggctgggcgtggtggctaacgcctgtaatcccagcactttgggaggccgaggtgggcagatcacgaggttaggagttcaagaccagcctgaccaacatggtgaaaccccgtctctactaaaaatacaccccggtcttatatttttcatttttgtgtttgtgataaagaattgaggctgggcatggtggctcaggcctgtaatcccagctactcaggaggctgaggcaggagaatcgcttgaacctgggaggtgaaggttgcagtaagctgggatcatgccactgcactctagcctggccaacatggtgaaaccctgtctctagtaatacaaaaattagccaggcatggtgctgcatgcctgtagtcccagctgcttgggagactgaggcggaagaatcgcttggacctgggaggcggaggttgcagtgagccgagatcgtgccactgtactccagcctgggcaacagagcaagactccgtctcaaaaaaaattaaaaaaaaagaattgagggattgagcactttttctgtaccctttgttacctgacttttatgtttttagctagttgactttagagtgtttaagatctacataaatattctgttgatatttagaatagcaggtggctgagtgctattcattttgctatagatgagttataattaaaaattttgaaattactgtgatcaggttttaatatggaagcataaacatggaaataaaattttatgtaaaatttttctgaaatattttttaattttgtaatttcaagatggcaatttctgataaaatatgttatttattggaggagactgtttggattaacagtgtgatctgtctgctaggcccagataccaaataggaccttcagaaaaaccagagctaaaactacttcaaaagagaaagtcgtagatgtcatctgtaggcctcccactagactgtaagcacagtaagagtgggtatcctcagcatggtatagggctttttggacacttagtaaaaattcggtgatcacgaccaactctttctaatctgtatgaaatcttgtacatgacccagaaaaaccttaagcagttagagttagggataaaggtttacaaatgtaccagagtggttactaaatgtgcaaaaatggttgctgccaggggttgagttatcaagggcaaaataaatctcaggagcaggatttggagccttaaagtccagctacccttctcacatggagattctccctcagttgccttgttttaagttaatattttgttagttcttcgcttttaaggaaaaaactttttaaaggattttcagacgtacacaaaagtattactgatattgaagtatcaaggcttggtttcattaatgatgcaagttgattctataaagctgccttgaatatgctgtgaagttggctaggtttatagctaagcatacctcctagtatgcatgattcaaatttatgtctgagcacagtcattttctatacatcagagctgttcccaattgcttgagactgttttgaaattgtgaatgttcaatcttcagttgtcataggtgttctgttacatgctatggatgtatttaaccagagtccacaccaaatctaatacactgtgtactcttttttttcccatttccacctatcgccagatttggggcttggtttactgttaaactgcctgcccctcataggccattacagcattcagtaaactggaaatttccttgcatgatgattattacatagtaggtgtacatgaagtcattgagctttggaagccatccagaggtgttctgggtgagtctgtccttggccagattttacttacgaaaccaaataaatttcttttttttaaaatatgtaaatttgttaaattagcatgcagaatatggcagtaatacccaattgaaacactagttggttgtatattaaatctaataataggaaatatgaatttgcctttaaaatgtatttcatttcacttctatttttagctgtgccaaatgaaacaaagttggacttcatgtataaaggctctagtaatgtcctaggtcatcagataaatagaagccttattattttatcacaggtggcaaaaagaggactaattacacagacttgtgagaaatgaagttgcctatctactccataactcttcttttggctacagtttccttctcttggtattttcaaattgttaaattgaaaattgttaaatgtaagttgggaaattaaaagatttaattgttaaatgtaagttgggaaattaaaagtctgtgtaattagtcctgtttttgccacctgtgataaaataataaggcttctatttatctaagaagacccgggcatacacaacagtggtttttaaaaatttaccgtcaacttgaagtattttcctttctcttccatgaagagcagtaacattttttctcttttcttatttttagtaacttttatcttcctgacttccatagccagcatcttattttcttcttggtgtcctttttcccttatcaaatgtaaccaggatctttattatagtggaaatggggccagttgatgaagtctaatatgaaacgaatattttaactttcaaatgcagaagagctaagttgcaaagatagcagaactgtccaatctgtctaccttcacagcagtgcttcttacatttaagaagcagtctgttgaggaccagttttgttttttaaaaaaatgttcaattcctcaccaaaaatacataaaaacatacaatccgattattttattaggttaattgacataaaaatagtcatttttccatgaaagtttctaaatatttactttcagtttgtataattacctcatggtggactggtagtgaagtttgtggtctggcactgatatgtagaccatactttgggtagcattgctctagattttctagcaaatcaggaaagccaaggatgttgagctcttgtttacataaccagattgaaagctcttcaaaagcaggtccatatgctgttcatcttatttgaaggattgggacagggcctgatacatagtaggcaggtggtgaaaactataacttaggccacagactataagctgataataagtgggatcataaagctgaatgggctagtacaaattctgcgagtattccaaaatatgaattgtgaaatattaatagtaatttaggagggtttccatatcagagtatcatctttttctttgctttaaaaaatgtctgataaagtgtattcagtcctgaatgtcaattgagaactggctctcatcactggctttcataataatgttaaacattttgctctattttaagaaaataggctgggtgtggtggctcatgcctataatcccagcactttggaaggccaaggctggcagatcatctgaggtcaggagttcgagaccagcctggccaacacaatgaaaccctatctctactaaaaatacaaaaattagccgggcgtggtggcgtgtgcctgtaatcccagctacttgggaggctgaggcaggagaactgcttgaacccaggaggcagaggttgcagtgagccaagattgtgccactgcactcctgcctgggtgacacagtgagactccctctcagaaaaaaaaaagaaaacaaaagccgcttggtgccaaacatagtctataggggaaaataaaatttaagagatttagtaaggttgaaccatttgaaattagcatacttgtgagtccaaaacagttgaatactgttgtatttatatggctcaacctacagatatagcaatatggaatgtaattacttgggggcacatgcagctcatatagcaaattctctttgcttaattttagggaaattgaagcccagagaatacatttgaaacagtaaaaccatactataattaattgtacagtaaatcacatttcacaaatttactgaaggtgaaaagaaaggacaaaatcagtttgcttttctttttggactatatctacttagagttttggaccattttccttttcttgatggaggggagggagggagggtatcactctgttgctgggctggagtcccatggtataattttggctcactgcagccttggccttctgggctcaagtgatcctcctacctcagcctttccagtagttgtcaccacaggtgcatgccaccatgcctggctcattttttgtattttttatatagttgagatttctccatgttgcccaggctggtttcaaattcctgagctcaagcagtccatttgcctctgcttcacaaagtgctgggattacaggcatgaaccaccgtgcctggcctcagtttttacttaaaataatggcataaacaatttgagatttgattctcagtaacgaaaccagtttcaagggaaatctttatttagtctttttttttttttttttttaaagacaggatcttgctgtgttgcccaggatagagtgcaatgggtattcataggcacaatcatggcacaccgtggccttgaactcctgggctcaagtgattctcctgcctcagcctcctgagcagctgggactacaggtgcacaccaccacatctggcttttatatgtaggttttttttgtttgtttgttttcaaacaagaaaatgtttaagagctttataaaatacttatttacctaaactcttttggacagtttcacttgctttagatcattatgtaatttttattctgcaggctatagaaatacaagtttttttgacgtggcatttgatctttaattatataaatttatatttttcgaggaagaaattctgatggcataaatcaggattaaaaaaacattctctttaagactcattactaacaatagtcaccagaggcaaattgcttttactttctcaaggtcttaatttaattgtgctttcaacttggcagtgttgtatattttataagctccactaaagaacacatctacacattatgacatagcacgttcttggaaacttgacagaactgttgacaagtacagatttgtttttggttactgtgagtattttttgtggtaattgaactgttgttagttcttggtagctttatgtgcttgtcagtctgttttcttcataagtgatgattaatttaaatctgtgtgatgtgttccagttcacttacttgatggaaattggagaagtgcatagctttctgatattcttaattactggttcccattaagtgactggagaagcaaatatttatgtctcaggtattgtagtattgaatttccagtcattctttcttcctggctataacttagtcactgaagaaataactatcctttattcaaacaacttccttggtacaatccagcaatatgttttttttcttgcaatattaaaaacctccgatgtaagtggaaaaagagttatttccaagcagaatgagaataatcatagcgctgggcacagtggctcacacctgtaatcccagcactctgggaggccaaggtaggtggatcacctgaggtcaggagttcgagaccagcctggccaatatgatgaaaccccatctctagtaaaaatacaaaaaattagctgggtgtggtggtgggcgcgtgtaatcttagctacttgggagactgaggcaggggaatcgcttgaacctgggaggtggaggtctcagtgagctgagatcacaccgctgcattccatccagcctgggcaacaagagggaaactccacctcaaaaaaaaaaaaaaagaataatgataaatatattatttgtggataagagttttctgcattttaaaaaattattaaaaaggatatacagttgtcccttggtgtccatggggaattagttctaggatctcgaaaatcctcagatgctcaagtctctgatataaaatagtgtggtatttgcatataaccaaaatacactctcccatatactttaaataatctctagattacttataatacgtaaaacaacaaatgctacataagtacttgttatactgtattgtttagggaataatgataaaaaaaagtttggtacatgtttattatagacacagatttttattttgaatatttggccctcagatggttgaattcctagatgtggaattcacagatgcagagggccaactgtatatgacttactagaaataccatgataaagaatatttcctatgattaattttttttctttcttggaaaaattggattacttaaactccaggttgtcttgtatttggatcaataagatattctagaagttatttccttgacaatattttatctagtttgttaaaaaagagttgcaagttattaggctgcattaatttatctgttatatttggtcatagaattcatgtccccagtatttgttttttttgtttgtctgtttctgacagggtccctgttgcccaggcttcagtacagtggtgcgatcactgctcactgtggccccctgtctcctgggctcaagcaatccttccacctcagcctccggagtagctgggactacaagcatgtgccgccatgcccggctaatttttgcattttttgtaaagacagagttttgctatattgttgttagggatagcgctcaaaatcctaaggaaattgaacactcgaacaaaggatttttagcaaaacaattttacttctgcgcagaggggtgcctccttggctggttgccgtgagagcacacctgaataaaggggcgtgagagcctttattcctgatgcaagtcctgcccctgcaccctttcctcatttgctacggttgggttgtacaatctaaactaatcccggttggctaaacgtttgattttttaagataagatgggcacgtaaaagaaagtggagaggaatgggaagggtgtctgtaatgagctagaaagttagtcctctttccaaataaggaaaggaatgtgagctggtactgataatgcctggtactgtggcgtgcctgggcatctaacaaaggcaaaaaggaaaaaagagaaaaaggagaaaaaaggtgtgtgtgtggggtactatgaattaaagaataaaagattaatcagattatttgaagagaagcctcatgatatcccacagttgtccaggctagtcttgaactcctgggctcaagtgatccttttgccttggcctcccaaagtgctgggattacaggcatgtgtcactgtgctcagctccctgcatttattcttgatcttaagaatcaaggtttttcaaaataagctaaatttattatattagattagcaagttttctttacttttttgacatggagtaaaattggagagagaggccaggagcggtggctcatgcctgtaatcccagcactttggttggccaagcagggaggattgcttgagtccaggagttcgagaccagccttggcaatatagtgagacttcatctctacagaaaattttaaaaatttagccaagtgtggtggcacatgtctttagttccagctgctcaggaggctaaggtaagaagattgcttgagcccgggaggcagaggtggtgaacagagattgtgccactgcacgccagcctgggtgacagaacaagactctgtttaaaaaaacaaacaaaaaaactggtgagataaataattctaaggttataataactgtagacatagtttaaacaaatctcattatctaagtagaaaattctcattaaagaaaatttggggaatgatgaaaaatgaagaaaataaaaatgatctctaattatactgctgctattatttttctttccctttttgtgtggaggtgggaaacaagactcagatcacttttgcttgttttaatatattatagacctgtacaaaataatttcaaataatttatgtagatactttgcctccaaggaggtgtcgcataactctctattcttatgggtgagttgtgtgtaatgacttccttctaagaagtagggtatggaaaggggaaaaaagcaattttacagcagagaaacctgacaggcactacctcagccaggtgatcaagattaacattaacaaccacaagccatgttgatagcacatacccttgatatggtgggatgagaatggcactttatctctgcgttctttctccccaaaacacataacctttgtctaaccaggaggcaaacatcaggcaaatctcaactgagggaccttctacaaaatacctggtcagcactcctcaaaactgtcatgaattaggtgcttatcaatctcatgcataatgtcacatatttgttatgtatgtgtttttagtatttttcatcttataaaatttctgttttgtttgtttgttttttagtagagactgggtttcagcaagttggccaggctggtcccaaactcctaacctcaagtgatccgcccgcttcggccacccaaagtgttgggattacaggtgtgagcctccgcacctggcccttataaaatttcatataagtagtatacttatatgaaatactactttatatatttgtctgcaatttgctttttttgttattattgttcaattttggtgtttgtgctttatccatgctgatagatacagttctgatttgtttaccatattctagtccattgtttggctgtcactattcacttttttatttcagacatttgggttaattctaatttgttgctgttatcaacattgctgcaataaccatttttgtacaggaactcctagtccctaggtacaagggttcctgtaaggtttttacgttgcagaggagttgctttggtctaaaatacataaatcttaaatttttatagataatgccaaaatttcatagataatctccaaaatgttacatttccaacaacagtatttgagagatgctggtgaggatgtggagaaactgtattcactatcgtggggcattttatttttgccagtataatggaagggaaatggtattaattgtcattgtcttgattattaggttgaactaataaatattttcgcttatttatcatttgggtttcctcctctgtgaattgtctgttcatatttttggtcaggtttttatgttgtttttcagtttgaaggagtcgttatatatttttcatactgctattttgttagtagtatgctttgcatgtcagtagtatgtcagtatgtaatagtacgtagtatgtcagtagtattttgcttttcaaaatctcagtctttgatctgaatttaaagaatagtatttttttgtgtaagaggttatttttatcttttgctatttaaaaaatcaagtgccatttgtatatgatagtacttaagtcttcagtttgaattctaaaaatgtgtatacctatataatccacacacctgtcatcccatcatcctatcaacacccctgaaaattcccttgtgcctcttcctagtcaaccccaccactgcctcaagtaagtactcttctgatttctgttctcatagattagtttcacttgctctagaacatcatataatggggctgggcgcgatggctcacgccagtaatcccagcacttgggaggctgaggtgggcagatcacttgaggtcaggagtttgagaccagcctggcaaacatggtgaaaccctgtctctactaaaaatgcaaaaattaacctggtgtggtggcatgcctttgtaatcccagctactcaggagtccaaggcacgagaatcgcttgaacctgggagacagaggttgcactgagctgctgcactccagcctgggcaacagagtgagactgtctaagaaaaaagaagtttatatgatggaattatacagtaaataatctgtatctattttcatttagcattgtatctatgaaattcatgcatgttttatctattaatattttttttggccgggctcggtggctcacgcctgtaatcccagcacttttggaggctgaggcaggtggatcactaggtcaggagttcaagaccagcctaggcaaagatggtgaaaccccatctctactaaaaatacaaaaattagctgggcatggtggcaggcgcctgtaatcccagctactcaggaggctgaggcagagaattgcttgaacctgggaggcagaggttgcagcaagctgagatcgtgccactgcactccagcctgggcgacagagcgagactccatctcaaaaaaaaaaaaaaaaaaaagtttgttttaaataggatattttttagagcaattttaggtttatagaaaaaactgaagggaaaatacagagagctcccataaaccctctcaccttcctcccccttgcagtttcccctattaatatcttgcattgatgtggtagattaattgcaattgatgacccaatattgatgttattattaattaaagtccattgtttacattagcgttcactctgcttcagctatttatctttctctccctcctccttcctgaacccctggcaatcactgatctctttaccgtcttcacagttttaccttttttagattgtcatctaggtggaatcatacaatatatagcctttttagaatggcttctttcactgaattatatgtatttaagattctttcctggcctttcatggctcgatagctcatttctttcttttttttttttttttttttttgtattttaattatttgactctaattttcctctttgggaactcttagataagctcatttctttttagtactaaataatatttctttgtctagatatactccggttttatttatctgttcacctactgaaggacattttggttgcttctaacttttggcaattatgaataaaactgctataaaaaaccacatacgtgtttttgtgtggatgtaatttttcaattcatttggggaggtatcaaggagagtgattgctggattttatgcatatggcaagagtatgtttagtttcttaagaaactgccaaagttttatccaaagtggctattccattttccactcccaccagcagtggatgagagttccagttgttccacatttttgtcaacatttggtgttgctttttctgcatctattgatagaattatatgatttttttatatgatctttctgtaaatttctttataagcactgcttttgatgcattttacaatttaggttgtattttcattaaaatatttcattaaaacatttaaattatttcactaaaatatttaaaaatttctctagacttcttctttgacctttatattattttaaaatgtgttgtttaatctccaagtattgtggggtttttcagccatctttctgtttttgatttctagtttaatttcattgaggtctaagagcatacttcgtataatttctattcttttacaattgttaagttgtgttttatggcccagaatgtggtctgtcttggtcgttgttccatgtgagtttgagaagaatgcatcttctgctactgttggatgaagtattttgtaaatatgaattagatccaggtgattagtagtggtgttcatttcagctgtgttctgcctactggatctgtcagttactgatagaagggtattgaattctccaactataaaagtggatttgtcaattttactttgcagttctatcggtttttgcgtctcatatgttttataccagttaaaatgcatactagggtagctttaaaaaaaaggaaaatcagtcagttaatagagtaactaaaaaaaaaaaaagaaaaaaatacatactgtcagagtgaatcaaaagacaaatacccaactaactatatgttgtctataaaaaacccattttaaatacaaagaacataaatataaaaaagataaagatacaccatgctgacactaaccaagtgaaagtgggagtagctacattaatttcagactgaacagacttcagagcaagaaaagttattagggatcaaagaagagtattacacaatgataaagaggtcagttctccaaaaaaacatgtctttaatgtgtatattcttaacaataagcatcaaaatatctgaggaaaaaactgatagaactgcaaggagaaatagatgaatccactatttatagttgaagtcttcagcactcctatcagtaatggacaaatgtagcaggcaaaaaatcaccaaggatatagctgaagtgaacaggatcattaatcaactaaatctaagtaacatttatgtactactacagtgggagaaaaagggagagatgaagaggtggaacacagaatttttagtagtaaaccataatataaactatagactttggtagataatgatatgtcattattggttcatgcattgtaacaaatgtaccacagtgatgtgggatttttttttttttttgagacggagtctcactctgttgtccaggctggggtacagtggtgtggtctcggctcactggaacctctgcctcctaggttgaagcaattcttctgcctcagcctccggagtagctgggattacaggtgcgtaccaccaccagctaattttttgtatttgtagagatggggtttcaccatgttggccaggctggtctcgaactcctgacctcgtgatctgcccacctcggcctcccaaagtgctgggattacaggcatgagccaccatgcctggccatgatgtgggatattaatggtggggtaagctttgtttgtgtgggagggtcttctggaactctgtagttttaagctcaattttgttatgaatctaaaactgctgtaaaaaataaagtttgcttttttttttttttttttttttgagacagtttcactcttgttgcccaggctggagtgcagtggcacgatctcggctcactgcaacctccgcctcctgggttcaagcaattctcctgcctcagcctcctgagtagctgggattacaggcatgtgccacagcacctggctaattttgtatttttagcatagatggggtttcttcatgttggttaggctggtctcgaactcccaacctcaggtgatgtgcccgcctcggcctcccaaagtgctgggattacaggcatgagctgccgcgcctggccagtctgctaatttttaaaaatgcatttggaacccaattgtttctaaaggtattctatggtttcttttttgtagaagtatttccattagatctgtattattgatgtattactactaggtaaaaatatagaattgttttgctctgatattaaagttgacattgggcccagtgtggtggctcatgcctgtaatcccagcactttgggaggccgagacaggccgatcacttgaggcccacagtttgagaccagcctggcccatgtggtgaaaccccatctctactaaaaatacaaaaattagcccagggggtggtggtgtgtgcctgtaatcccggctactaaggaggctgaggctcaagagttgcttgaacctgggaggcagaggttgcagtgagccgagatagtgctgctgcactccagtctgggcaacacagggagattctgtctgaaaaaaaaaaaaaagttgacattgagccaggcatggtggatcattccatatagtcccagagctttgagaggctgacgcaggaggatcacttgaggccaggagtttgagaccagcctgtgaaacatagtgaaaccccacctctaaaaaaataaagttgacattatttgaaagtatatttattgctagatgccatttatccacgtttgtttgttgtaatcaccaagccttgttttgaaatactactctaataaactaaaagcttagtggaaaaagctatgttttacctaccaaagagtatcaggaactgactttctgtggtttatttttagtgccaactttaaatactcttcaagcagcaagaataaattaatggttgtacaaatgtgaaattttaggggacttatttgggactaaaagacaggctttggggttgattaatatcaaggttttttccttcaaatattgagctcccaatttcagttacttaattagcaatttactaaaaaatggtatcattatcttgaggttcattctatttatttattttaaaataacagtcattttgctcttgaatctgaactgtaggcagtgctaagaggaaaagttcctctccttaaggtgtttgcttgactaggggctgaaggatctacttctaacatgtctcattcatctgactggcagtttaatgcttgctattgactgggagctcagccaagactgaggggtgaaggacagagttcttttgacatggttcttcataagctgtttttagcacagtgcctaggttctaagagagacaaaggggaagttgtcagtttcctaagacttgagccagaaaattggcatagcatcacttctgctataattttttaaaatgtggatggatattttgatataggcattcaatgtctaataatcatatcaggggaaatgggatatccatcacctcaagtatttatcctttgtgttagaaacaatcaattacactcttttagttactgtaaaatatacaattaaattattactgactatagccaccctgtcatgctatcaagtactacgtcttatttattctttctatatttttgtacccattagtgatccccacttccactgcccccacctcccactatccttcccagcctctggtaaccatctgtctaccctctttctccctgagttcaattgttttaatttctagctcccacaagtaagtgagaataggccagaatgtaatcccagcactttgggaggctgaggcgggtggatcacgaggtcaggggttcgagatcagcctgtccaacatggtgaaaccccgtctctactaaaaatacaaaaattagccaggcatggtggcaggtacctgtaaccccagctactcaggaggctgaggcaggagaatcacttgaacctgggaggcagagattgcagtgagccgagatcacgccactgcactctagcctgggcaacagagcaagactccatctcaaaaaaacaaactaaaaatagagctagcatataattcagcaatcccactgctaggtatattcccaaaagaaacaaaatcaggatatcgaagagatatctgcactcccatgtgagccaccgcgcccggcctatttttagttttttgaggaactccaaactgttttccatagtggttgtactaatttaccttcccaccaacagtgtacaagggttcccttttctctgtatcctcaccagaatttgttattgcctgtcttttggatataagtcatttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttagctgcataaatgtcttcttttgagaagtgtctgttcatgtccttcgcccactttttgatggggttgtttgtttttttgttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttctgttgccattgcttttggtgttttggacatgaagtccttgcccacgcctatggatataagtcattttaactggggtaggatgatgtctcactatagttttgatttgcatttctttgatgatcaatgatgttgagcatcttttcatgtatgtttgccttttttatttctttttttgagaaatgtctgttcagctttttttgcccattttaaaattgggttattagatttgtcctgtagagttgtttgagccccttttatcctggttattaatctcttgtcagatggatagtttacaaatattttctcccattctgtggattgtctcttccctttgttgatggcttcctttgctgtgcagaagccttttaacttaatgtgatcccatttgtccacttttgctttggttacctgtacttgtggggtatttactcaaggaatctttgcccagtccaatggcctgaagagtttccccaatgttttcttgtagtttcatagtttgaggtcctagatttaagtctctcatccattttgatttgatttttgtacatggcgagagataggggtctagtttcagatcttctgcatgttgatatccagtttgcctagcaccacttattgaagagactgtcttttctctgttttggcacttttgtcgaaaatgagttcactgtacatggatggatttgtttctgggttctctattctgttccactggtctgtgtgtctgtttttatgccagtaccatgttgttttggttactgtattagtccattttcacactgctgataaagacatacccgagactggaaagagaaagaggttttaatgaacttacagttccacgtggctggggaggcctcacagtcatggcggaaggtgaaaggcacatctcacatgaaggtagacaagagaagaatgagagcttgtgcagggaaactcctttataaaaccatcagatcttatgagatgtattcactattacgagaacagcatgggaaagacttgcccccatgattcaattacctgccactgggtccctcccacaacccatgggaattcaagatgagatttggatggggacacagccaaaccatatcagttactatagctctgtagtataatttgaagtcaggtaatgtgattccaccagttttgttctttttgctcaggatagctttggcgattctgggtcttttatggttcattatacattttaggattgtttttctgtttctgtgaagaatgtcattggtattttgatagggattgcattgaatctgtagattgctttgcatagtatagacatttcaacaatattgattcttccaatccatgaacatggaatatcttttcattttttttggtgttaccttcaatttctttcactattgttttaaaatagttttcattatagagcgctttcacttctttggttaagataattcctaggtatttaattttatttgtagctgttgtaaatgggattactttcttgatttctttttcagattgttcacccttggcatatagaaatactgctgattttcgtatgttaattttgtatcatgcaactttactgaatgtatcagttgtaatggtttttttggtagagtaggtttttccaaatacaagattatatcatctgcaaaaaagaacagtttgacttcttcctttccaatttggatgccctttatttctctcttgtttgattgctttagctaagactttcagtattatgttgaataattgtggtgtaagtgggcatacttgtggtgttccagatattagaggaaagtcttttagttttcctctattcagtacgatactagctatggatctgtcatatatggcttttattatagtgaggtatgttctttctatcctgtttgtttgtgtgttttttcagttagcactagccatctcatccccggttttttttgacagttttcatcatgaagggatgttgaattttatcaaatgtcttttcaccatcaattgaaatgatcgtatggtttttatctgttgatgtgatgtttcacattgattgatttgtgtattttgaaccatcctagcattcctgggataaatcctacttggtcatgatgaatgatcttaacatattattgaattcggtttactggtattttgttgaggatttttgcattaatgttcatcagagatattggcatgtaggtttcctttttaaaaatttttaatgtatctttggttttggtgtcagggcaatactggccttgtagaataaatttggaagtattttcacctcctcaattttttggaatagtttgagtaggattggtattaattcttctttaaatgtttgataaaagtcagcagcaaagccctgaggtcctgggctcttctttgatgggagactttttatcatggcattttttttttttttttttgagatggagtctccctctgtcgcccaggttggagtgcagtggcgcaatcttggcttactgcaacctccgcatcctgggttcaagtgattctcctgcctcagcctcctgagtagttaggactacaggcacgtgccaccacgcctggctaatttttttgtattattagtagagatggggtttaccgtgttagccaggatggtgtcaatctccttgacctcgtgatccgaccgcctcggcctcccaaagtgctaggattacaagcatgagccactgctcccggcctataatggcttttaatgcatgttcatcttgttacttgttattggtctgttcaggttttggatttcttcattgttcaatcttggttggttgtatgtgtctaggaatttatccatttcttctagattgtccagtttgttggcatatagttgttcatggtagcctctaatccttcagtttctgcggtatcagttgtaatgttttctttttttatctctaattttatttatttgaatcttgtattttcttagtttggctaaaggcttgtcaattttgtttatcttttcaaaaaaccaactgcattttgttgatctttggtatagttttctacatttcaacttcattatttttgctctgatctttattatttctttgcttctactgactttgggtttggtttgctcttgtttttctaattctttaagatgcatcattatgttgtttatttgaagtttttcctctttttgacatggggacttatagctataaacttcttccttagtactgctttcactgtagccagtaggttttggtttgttgttgttgctgttgtttgagacagagtctcgctctgtcacccaggctggagtacagcggcatgatctcggctcaactgcaacctctgcctcccaggttcaagcgattctcccacctcagcctcctgagtggctgggattacaggcgtgtgccaccacacccagctaattttttgtgtttttagtagagatggggtttctcagtgttggccaggttggtctcgaactcctgacctcaggtgatccacctgccttggcatcccaaagtgttgggattacaggcatgagccaccgcgctcaacctgttgtttttccattattgtttcaataaattttttaatttccttcttaatctctttattgaccattcagtaatggtcattacagtaccgtattggtcattcagcagcatattgtttaatttccatatgtttgcatagtttccaaaattcttcttgttgccgatttctagttgtattccattgtgtttaaagaagatacttaatattatttcaattttttgaatattttttagacttggcttgtagcctaacatatgatctgtcctggagactgattcatgtgctaaggaaaagagtatgtattctgtagccattggaggaaatgttctgtaaagtctattaggtccatttggtctatagtgcagatgaagttaaatgtttctttgttgaattttgtctagatgatctgtctaatactgaaaatgggatgttgaagtctccagctattattgtattggggtctgtctctttagctctaataatatttgctttatatatctgggtgctctagtgtcagtgcatatatatttaaaattgttttattgttttgctgaattggctcttttatcatataatgacttttttttttggtctcttttgtagtttttatcttgaaatccattttatctgatataagtatagctactcctgctccttttggtttctatttgcctggaatatcttttcctattcctttatttttagtctatgtgtgtctttttttttttttttttaattttttttgagacggagtctcgctctgtcgcccaggctggagtgcggtggcacgatctcggctcactgcaagctccgcctcccaggttaatgccattctcctgcctcagcctcccgagtagctgggactacaggcgcccaccaccacgcctggctaattttttgtatttttagtagagacggggtttcaccgtgttagccaggatggtctcgatctcctgacctggtgatccgcccgccttggcctcccaaagtgctgggattacaggcatgagccaccgcacccggccctatgtgtgtctttataggtgaagtgtgtttcttttaggctacagatcattggatcttgtttttttatccattcagccactctgtgtcttttgattggagagtttggttcatttacattcaatgttattattgataagtaaggacttactcctgccactttgttatttgttttctggttgttttgtggtcttctctcccttcttttcttcctccttgtcttctttttagtgcatgtgattttatttggtggtatgttttaatatctttttattttttctgtatcctttatatcacagtttttagatttgaggttaccatgagcttgcaaataatatatcccattattttaaactgatgacaacttaacattggtagcatacataaacaaacaagcaaaaagaaaactagtaaaaactctaactttgtctccctgctttttaactgttttttgtttctattttatattttattgtactatgtcttgaaatgtcattgtagttattgtttttgatcagttcatcttttagtctttctactcacaatatgagtagttcacacaccccaatacagtattagaatattctgtgttttttcatatatctactattaccagtgaattttttaccttcagatgatttcttattgctcattaacatcctttcctctcagactgaagaattccctttagcatttcttgtaggacaggtctggtgttgatgaaatcccacagcttttgattgggaaaatctatttcctcttcatgtttgatggatattttctccagattactattctggtataaagtttttttttttttccttcagcactttaaatatgtcatgccaatctcacctggcatgagattataagggttccactgaaaagcctgctgccagatgaattggagctccattgcatgttatttgtttcttttctcttgctacttttaggatcctttctttattcttgactttcaggagtgtaattattaaatgccttgagacagtcttctttgcattaaatctgtttgatgttctgtaaccttcttgttcttgaataatgatgtctttctctaggttggggatgttctgtgctgttatccctttgaataaactttctacacctgtgtctctgtttaccttatctttaaggccaataactcttagagaagcccttttgaggctgttttctaaataatctcgtaggcatcattctttttttttttttttttttttggagtcagagtcttgctctgctgcccaggctggagtgcagtggcatgatctcagcttgctgcaacctctgcctcctgggttcaaggaattctcatgcttcagcctcccaaatagctgggactgcaggcaagcgccaccatgcctggctaatttttgtatttttattagagaccaggttttgccatgttgcccaggctggtcttgaactccagagctcaggcaatctgcctgccttggcctcccaaagtgctaggattacaggtatgagcccctgtgcccagcctctttttcttttttgtttcctttgactgtgtgttttcaaatagcctgtcttcaagctcactaattctttcttttgcttgatcaagtctgcttttaagatactctgatccattcttcattatgtcaattgcatttttcagctccagaatttccttttgcttcttcttaattatttccattttgttgttaaattcatctgaaagattctgaattccttctctatgttctcttgaatttcttcaagttttcccaaaacagctattttgaattttctgtctgaaggatcacatatctctgcctttctttgattgttccccggagctttatttagttcattttgggagctcacgttttcctggatggtctcgatgcttgtggattctcgttagtgtctaggcattaaagaattagatgcttattatagtcttcaccatctagtacatcttgtttttactcatcctctttgggaaggctttccaggtatttgaaaggatgggggtgttgtgatctaagttgtatctgcattaaagggcaccccaagtccaacatcattgaagttcttgcagacttgtagaggtaccaccttggtggtcttggataagatctggaagaattctttctattgccaggcagagactcttgttctcttccctttttcccaaataaacagagtcactttctctgtgctggactacctggagctgagggacgggtgacacaaggacccctgtggccactaccactggcactgtgctggatcagacctgaagtcagcatggtactgggtcttgcccaaggcccactgtaaccactacctggctaccgctcaaggcctaggactctacaatcagcagatggtgaagccagtcaggcttgtgaccttccattcaggggattgagttctcctgagccctagtagttttagagatgctgtctgggagccagggcctggtttgtaaaccttaggaatctacctggtcctctgttctgctgtagctaagctggcaccgaaaccacaagacaaagtctttcccactctttcctccccttctcccaggcaggagagcctctgcctgtatctgccaccatcaaaggcccataggaagtattgccaatgttcacttaagtcctaagggcttttcagtcagcttgtggtgaatgcttccaaatctgcaactcacccttcctggcattgggctcctttctgggccaggataggtccaaaaatgtcatctaagagccaaggcctgaaattgaggctccagagtctgtttggtgctcttccccactgtggtagagctggtacctaagctggaagataaagtcccctttatttttccttctacttttttcaagcaggagtctctccccataaccacataggtaggaatgtggtaggtcacacctgaagccagcatgtttcatagtctcactcaaggcccacagcatgttctacctggttaccactgctgattattcagggctgaaaggccctttagtcaggaggtgatgaatcccgccagcagtggatccttcccttcatagcaactggttcccatctggcccagggtttgtctagaaatgttgtccaggagctagggcctggaatgggggcctcatgactctccttggtgcactgtcttactttggctgagctggtgtccaagttgcataacaaagtcttctctactgttttctctcctctcaagttgaaggaaggagtctcttttggagctgtgagctgtgctgcctggggttggtggaggggtgatgcaggcactcccttagctaccccagctggtgactcactatgtcatgtgtcccctgagtccgctggctctgatcctagcacagcttttagactttcctgtaagtttcagtccttgtggcctagagtgccttttgtttattgaggaccccacagctctttagctttctgtggtgaggcttgccgaactcaagttctggcttctgagatgagcaatcccactttggctagagctgatctaaatgttccctctgtggacattggctgagttctgcctggtgttggcagcaccaagttccaatgtaaagtcccacaattgctgcactctccctctcccaaacacacagattctctctacttggctgctgctagcggatgggggaagggtggtgtcggaaattaaagggcctttcctacccacttcagtttgtttttctgcagtatgaagttaaaaccaggtattgtgatcactcacctgatttttggttcttgtgaaagtgcttttttatgtaggtgtcatatttggtgttctgacagggaggaagattggtagaggcttctgtttggccatcttgctctgcctcccagggcctagatggtaatttgttaaacaatggatgaaccaaaattggcacatgattactatccaaagtctgtaatttatcttagggttcacgcttgatattgtaacttctatgggttttgacgtgtataatgacatgcatctggcatatagtatcatgcagattggtttcaatgtccaaaaatctctgggatccacctattaatccctccattccctcgcccccaaaccctggcaaatattgatttttttttttttttttgagacagagtttcactcggtcgcccaggctggagtgcagttgcacaatctgggctcactgcaacctccacctcctgggttcaagcaattctgcctcagcctcccaagtagctgggattacaggcatgtgccaccatgcctggctaattttttgtgtgtttttttaatagagttgggtttcaccatgttggccagcaggtctcgaaactcccaacctcaagtgatccgcccacgtcggcctcccaaagtgctgggattacaggagtgagccaccacacccaggcaactattgatcttttcactgtattccatagttttgctttcccttcaacatgtgtttgtagagcgcctactgtgttccagttttgcagaccttggggattaaatattaagtaagaagcagtggcctttggagcaagatataggcctggcagttaccctgcattttaataaataccactagtttactaggcagtctagaaagacccccgtcccagatttgggagttaaggaaagacttcatggaaaaagttagatctacatcgaagcctgaagaaagaggtggtatcaacaaggtaaggcgataaaggaatagcaactaagattttctaggcagagagaatagcctaggcaaaagccaagaggatagagatagaatatacacttaagagctaaaaggagctcaaaagcaatggtaggaagaacaaatgattggaagattgtaagaggtagggggatatgaagagaaatgaagctagagaaggggagaagtttcctgactgtgatttgccttgtaagccatattgaagacttagaatttaaatctagaggtcagagaagttcttatagatttttttctttaattaagctttgtatttagagataattatagtttgacatagagttgcaagaaataattcagagagactgggcacactgcctgacacctgtaatcccagcattttgggaggctgaggcggaaggactgctttgagtccaggagttcaagaccagcctgggcaacatagtgagcccctatggattagtcaattttcatgctgctgataaagacatagccgagactgggcaatttacaaaagaaagaggtttatttgacttacagttccatgtggccggagaggcctcacaatcatggtggaaggtgaaagtcatgtctcacatggtggcagacaagagaagagtttgtgcagggaaactcccatttttaaaaccatcaaatcttgtgagacttattcactatcgtggcatgggaaagacccgcccccatgaatcagttatctcctggtgggtccctctcacaacatatgggaattatgggagctacaagatgagatttaggtggggacacaaagccaaaccatatcactctgtctttacaaaaaaaaaaaaaaatatatatatatacacacacacacacacacacacacacacacacacacataatgccaggcatggtggtgcatgcttgtagtcccagctactcagaagactgaggtggaaggattgcttgagcccaggaggacaaggctgtagtgagccgtgattgtgccactgcactccagctgggtgagagaggaagatcctgtctcaaaagaaaaaaaaaagtgatgaattacattttcatttttcattcaaattcttttttttctttagtatcgtagcctaatttttaaatttgttttggctctgagccccttgctaatttgctaggctagattaggcaaacagaaatcagcaccctgaattattttctactcttatcttaaagaagtttatggtttgtgaatgtgtgtgagagaattttataaagcaagaagttggtagctttaaagaattctggacttaatgttgatctgcaacatttagaattttttatttgaaatgttattgatacagtatgaatgcttgttggaatatgaattctacttcaaggtgttagatgatgtatttgcagagatacatagaccctgctctcaaagtttagactctgttgggtcaaatagactttttgacataatttcatttcattgaggtaagtgcagggatagagatattagggcatttttggaagagaaaggggcacttaccttactaggagaggaggagtattggggaagccatacttgaactgagtcttgaatggtgaatagaaattaatctgttgaaggtgatgataagacatttcagaacatttagaatagcacgaacagagacacatagaagaagcatcatattgggattgctagttggggaattacaaacaggttagtgctgtttgagtgtcaagtgcgggaggcaggaagttgtaagacactaaaagataagcagggcctgttgtgttgagtttgaacttcatgctcagtgattctcaaacatatccagcccagtgtttctttttttgtagtaaatattttctaatgctcctttatgatccttaaaaggaattcttataattcacatataataaaattaaaacataatttctaatatgatgtcataaatgtagtacaaaggaaaagtataagaaatctaaacatgatttgaaatatatattttaaaatataaatgcttaagcattatatcattagaacacataatgaattaatcagatgcttgtacctatacatggtattactgtgaatgcacagcaacaaatgcaggtatataaaatgtgttgtattggtaggtaagatattttaaatggtattgtcactggtaatgagatttttcaaaatacttaacatcctatttgtaaagttctgaccaagtcaaagtacaagttgtattaattgcattcctggaaaacttggtgtttattaaaaccgtgaaaaaatacttttttatgtaaaacaaaatacttaatttttaggctgaagtaattataaacaggtttttccacacaatgtcagatgggacattgcaaagtcatgtgagacacaggtctttttgtcctgtgggatgttcttggtcaggggtctgcaaacatcagcccacaggtggtcacactgcctgtatttatatagcccatgagctaaaaatggtttttacatttttaaagagttgtacgaaaaagggaagaatatgcagcagagggttacaacttttacagaaaacttgccaactcccgtttcttgggtattgaaggatgccgaacatccctagctcatgctcacttaatgcgaacagcactccctccaatcactgtgaaaccaaatgtagcctccaccatttctcaggtgcctttgggagggcaatactacctggttgagaaccactgttttggtttatcagttttcaaatttttattcctctgcgacacatttaacagatagtaatacatgcataatatagttctatgcagagttcctgtgtttttaattttctttttttcttccattcaagtaaacaattaaaatgagggaggtaattgtttaatataaggatactttgaaaaccctctgatttatacttataaaaatctttacaaacattaatacttgtactactactactgctaactatattatgtacaacttaccttatacctcataggagagtgcttcacaccatcctgcctgaccaccactgaagcaagtaatagtcagccatgggataactttaaacaagcaagtgccagcatcctatatttatattatagatagatcactttgatagtggtatagaagatagacttgagggagtccacacttagtttaggttcaagatagtgagggcttctaccagctagtagggacagatcagaggggacatattattagagaattatttcagatgtaacaatcagtagaacttgacaactgaaagttacaggcatttgtttttctttttcttttcgaactcattttactgccagaggcatttgtttttaacactttgttgcctgccagaatcactttggaagctttttaacaataccagtgcctaggctttactccataattcctggaaatcagaatttctgggataatagctgggcgctgatattttaaaattgtacttcaggattctaatgtgcagccagtgttgaaaaccactgattcaagatgtggaagagagagaagaataaaggatgagtaccaggctgtcagcctaggctgccagtagatggaagtagtgtgctgtgaacagtatctgttttatggtagctattcaaatatttcttaagtgaaaattgatgactttgaacctaaaccaaaatcaatttctcatttaatttttgattgttctaaatttggatgaattgaccctagttcaagatattattgactggaacccaaccaaaataacttttgtcacagatgaaattatatcagaatggatatctcttgatattatttgagaagaagaatgatacaaattacctgagttgtgacataatattgtgaagcaaggtgtcagtggaaataatttgacttaattatagtatattatacaaaataattccttccttccttccttccttctttccttctttctttctttcttggcggagtctcgctctgtcacccaggctgaagtgcagtggcgcaatcttggctcactgcaaccttcgcctcccgggttcaagcgattctcctgcatcggcctctcgagtaggtgggattacaggcacctgccaccacccccggctaatttttgtattgttagtggagatgggatttctccatgttggtcagtctggtcatgaactcctgacctcagatgacctgcccacctcagcctcccaaagtgctggattacaggtgtgagccaccacgcccagcctgtatttgtattgattggcatagccagaggtttggggtcctgctatctggtaaataggcagatattcagtaaatgtttattgaattgtaatgtgaaatatctttaatgtaccagaaagttgtaatatttaccatataattttttatattaatgaagaaatgaaagacagcttgtttttctttcagctccagtctcacttgctctgcctgtgttctacttggtgttgttacctttacattcttctgttcccactgccaccaccctcttttagtcaagactcttggttccaaatgataggaatacagcttaaattgaatagttgatggaattttgggttgtctgtaggaaggatgctgagatagcattatagaattgcaggaaggcctgcaggaactagggtcttgggaactataaaacagggatatcaccccattaaaatccactctcacttcattctattttcttgcagacatgcttttgccaaaaggtccaagaaaatgctgtctgtaactccagcctcatgtccttcttatactatgacccaaaaagacaagatcatttctcctgccctaaattgggaccagtcagtgcgcccagagaaaggaggatattgtgatctgtctggtttggagcttatgccagtccccatggccactagcagataggggcatagcaaagaagaggcaaggggaggcttaccctggggactaagttattaactgctgctgtcctctcctaggctccattgccctagccctctgaaaatttttcacttcagtccaactacttactgttatcagattcagcttaaaatttttttttcattaaaaacatttttaaaagagagacagggttttgctgtgttttccaggctggtcattgtcaacctccagggcttgaacaatactcctgcctcagcctctggagtagctgggactgcaggcgtgtgacaccacactggccagattcagcgttctaaaccacacgttgcatcatgatttcccagttacctagcctttagtggcccctcattacgtatatataacaatgtctaaacttgatgtactttaatctggctccagactgccttctcaatcttatctctcagtttttctattcactgttaaactgagctagttggccttctaagttctgagaacacttacatattcctcactcagtcatctaaactttaagtaaaaaatttgtggtaatactcttcaaatcattgtttgatgtctcaggatctctgaaggccagcaactgaagcattgtagctactcattagggactggcatctctgtatcattgttgacagaatgtaccagtttacatttttttcagtggtagtgataccgagtctacttctctgtgtagtcacttgtgacagctaatcagagggaaacctggcttaactgttgaggctttggccctgcacttatctcatggtgctttcagaaaaatcagttgactgcttgaagcttcagtttccttttctgtaagttgagagtgaagagcactataatactatcatctacctcattgcctttgaaaattgattatgagggtcaagtgcagtaatacagacatacctcggaaataccttgggtttggttccaggtggccacaataaagtgaataatgcaattaagcgagtcacatgaatttttttgtttcctagtgcattaaagttgtgtttatactataccataccatatcatactacactatattaagtgtgtaagaacactgtgtctttaaaagcagtatacatactttaattaagggatactttattactattcaagaggctgaagtcagaggattacttgagcccaggagtttgaggctgcagtgagctatggttgtgctcctgcactccagcctgagtaacagagaccccatctcccaaaaaaaacctaaaaactttattgctaaaaaatgctaatgattacctgagccttcatctagtcatattctttttgctggtggagggtcttgccttgatgtcttgtttttgttttctaaatgtgtgtgtgtgtgtgtgtgtgtgtgtgtgtgtgtgtgtgtgtcagaagtgggatttgaattgccttgatgtcagtggctgcttactgatcagagtggtgattgctgaaagttggggtggctgtggcaatttcttaaataacacaacaatgagattgttgcatccgtggactctccctttcatgaaagatttctctgtagcatgtgatgctgtttgatagcattttacccacagtagaacctctttccaaattggagtcagttctctccaaccctgctgctgctttatcaactaagtttctgtaatgttctaagtcctttgttgtcacttcaacaatgttcacaacatctttactaggactagataccaagaaaccactttgtttactcctccataaggagtaacttcttatccattcaagtttgatcataagattgcagcaattcaatcacatcttcagatttcacttctaattcttgttctcttgctgttttcaccacatatgcagttacttcctccactgaaatcttggactcctcgaagtcatccatgagggatggaatcaacttcttccaaactccctttaatgtggatattttgacattcttctatgaatcgtgaatgttcttaatggcacttagaatggtgaatcctttcctgaaggttttcagtttattctgcctggatccattagagtaatcactgtctatggcagctatagccttacaaaatgtatttctttctttttttttttttttctttttagacagggtcttgctgtgtcacccaggcaggagtgcaatggtgccatcttggcttatgcagccttgaccccctgtgttcacagtgatcctcccacctcagccttctaagtagctgggaccacagatgcgtactaccccgcttggctagtttttttgtattttttgtaaaaacgtggtcttgccatgttgcccagaatggtcttgaactcccaggctcaagcaatctgcccacctcggcctcccaagtgctgagattataggcttgagccactatgcctggtcacaaaatgtatttcttaaaaaaaaaaaagactttacggtcaaaattacttcttgatccgtggtctgcagaatgaatgctgtgttagcagtcatgaaaataacatctccttgtacgtctccatcagagctcttgagtgactacgtgcattgttagtgagtagtaatattctgaaaggaatcttttttctgagcagtagttttacgtaaaatattaagcgcactgtgaatattttaaattcagctgagtattttaaattcagcaggccatgctgtaaacagatatgctgtttaggctttgttgttccatttatagagcacgggcagagtagatttaacatcattcttaagggccctagagttttctgaatggtaaatgagcattggcttcaacttcaagtcaccagctgcgttagcccctaacaagagagtcagcctgtcctttgaagctaggcattgacttctctctagctgtgaaagtcctattttatgagaactcacaaacaaaaaataaagtcctagatggtatctttttccgatatatggctatttcatctatattgaaaaccttttgtttagtgtaaccacgttcatcaaatagctagattttctggataacttgctgcagctcatacgtcagcacttgctgcttcatcttgtgcttttgtgttaatggagacaacttctttctttaaacctcatgaaccaaccttgcttcaaacttttcttctgtaaactttctcacctctctcaacctacatataattaaagaaagttagggccttgccctcgattaggttttggcttatgggaatgtggtggctggtttgatcttttgtccagaccaccaaaaccttctccatatcagcaataaggctgttgtgctttcttttttttttttttttttttgtttgagagagagtctcactctgtcctccaggctgaggctggaagtgcagtcgtactatcttggctcactgcaacctctgcctcctggattcatgcatttctcctgcctcagcctcctgagtagttgggattacaggcgtgcgccactacgcccagctaatttttgtatttttagtagagacagggtttcaccatgttgtccaggctggtctcgaactccggacctcaagtgatctgcccaattcggcctcccaaagtgctgggattacaggcgtgaaccactgcgcccggctgtgttttgctttcttgtcatttgtgtgtgcactggagtagcacttttaatttctttgaagaacttctccttggcgttcacaacttggctagctgtctggcacaggaggcctagctttcagcctatcttggcttcctctctaagcttaaacatttctagcttttgatttaaaatcagatatgtgtgactttttcacttgaatacttagaggccatcgtagggttattagttggcctaatttcaatattgtgtgtctcaggtcatagggaggcctgcagagagggaaagagaaggaatggccagtggttggagcagtcagaacacaagacatttatcaattagttagtttatctgtcttctatgggcatgtttcatggcgccctgaaagaattccactagtaacattgaagatctctgatcacagatcaccataacagatataaataatagtgaaaaagtttgaaatatgagaattttcaaaatgtgacacagagacacaaggtgagcatatgctatttgaaaaatggcaccaatagacttgcttaatatagggttgccacagaccttcaatttgtaaaaaatgcagtatctgtgaattataataaagtgaagtgcaataaagtgatgcacaataaaatgaagtatgcctgtagatgtgaaaatgctatggtatgctaaagattactgtgcaaatttaaggcatgttactatgcttgagcttatatttagttactgtgtcttcttggatgctggaatagagaacccagattcaatggcaattaacttttgaaaatttatgggaaagtataaagtagtatataatttcacagtagtattattgtgaatgagctgtttggctgaagatgggcttcaaagctaagataaatacattcacttaacaataatttacttagtgcatcacatggataaggcattatacagttgaagtatatcaaaccaagcctggctataaggcattgtgaaattatgtaagattttatcaaacaaccaattaattttattcttttgttttattgttattattattattttagagacagggtcttgctgtgttgcccaggctggactcgaactcctgggctccagctgtcctcctgcctcagcttcccaagtagctgggactacaggcacacaccaccacacctggcttgttttattacttcaaaaaaaatttcattttatctccccgccatagaactggatatttaaaaattatattctagttattgataccgaattgagtgacatggaatttttaacagtagcttttctgatatttgatgtttccaaagggagtatttttgttataaagagcttattctcattactgtctgccccctcccccacccacttttttttttttgagtgcagtcttgctctgtcgctcaggctggagtatagtggtgtgatctgagctactgctacctctgcctcccgggttcaagcgattctcctgcctcagcctcccgagtagctgggactacaggtgtgcgcaactacacccggccaattttgtatttttagtggaaaaacagggtttcaccattttggccaggttggtctcaaatttctgacctcaagcaatctgcccacctcagctttgcaaagtgctgggattacaggtgtgagccactgtacctggcctctttactgtcccttgatgaccttttattaaaatttatttcagtgaattttttttttttttttttttgagacagggtctctctctgtcacccaggctggagtgcagtggcgcaattttggctcactgcagtccctgcctcccggttgaagcgattcttgtgtctcagcctcctgagtagctgagattactgagattgctgttattgcatatataccacgcacaaccatgcctggctaatttttgtagttttagtagagacagggtttcaccatgttggccagtttggtctctaactcctaacctcaagtgatctcacctctgcctcccaaagtgctgagattacaggtgtgagccattgtgtctgggctatttcagtgatttaagagtcactcaaaatataatctgtagttaagaagctatctttttctaattacctatttaattcaaattttttgctttttctgtcatctttatagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggtgagttaaacttaagtcaattttcctttgtaaactgtatttttcactacatgttagcttgtctattcagcttgattttatgcaataacagcaacaggaaaagacactgtttcctagaatcctttttcagaggtagaatcatctgaaaatttggatactctcacttgtggacagagtctggaaactagcctcagggtcctggcagctgtctcagaagaacagaatgggccaataatgtgattgctcagaagctgaccactactgcatttggttagatctcaaaatccttggcatttgttcagaatttccaaggcaatgatagagataataaataaagaccaagaatttggattaaacaacacaatctcatccagtcatctttaataatcagtcaggtataggaggcagtgtatcttaatttacattaatacattgttcgtaaagacccctaaatgtgctatctctgtccttgaggtcacaaataattctcagtttaatcttatgtacagtgcttcttttcccaacagttacagcagtcattatagcagataattttaatgtctatatggtttttcttgaagtcattcactttgtgttccagatgactgccagctcagacttttaatgatctggcttatgtctttggggaaaaaaaaagaaactggtaattaggaagagaaaacccaggtcaatgaattagctaatcacatttattttcagataaataatcaaataagtgcttctattatatcctacaatagaaatttatttcttacttgatgagctgtcagattttcttacatattttcttttatagtttctttagatttttcagtgtttgcagttctgtactgactttaattttaatttaaaagataattcagggcctggcacagtggctcatgcctgtaatcccagtttatgcctgtaaccccagcactttgggaggctgaggtgggcggatcacctgaggtcaggagttcgaggccaacctgaccaacagagaccagaaaccccgcctctgctaaaaatacaaaattagctgggcatggtggcacatgcctgtaatcctagctacttgggaggctgaggcacgagaatcgcttgaacctgggaggtggaggttgcagtgagccgagatcatgccattgcactccagcctgggcaataagagcgaaactctgtctcaagaaaaaaattttttttaaataataaaagataattcagcctgagcacagtggctcacacctgtaatcccaacactttgggaggccagggtgggtggatcacctgaggtcaggactttgagaccagcctggccaacatggtgaaaccttgtctctactaaaaacacaaaaattagtcaggcatggtggcaggcgcctataatcccagctacttgggaggctgaggcaggagaatcgcttgaatccgggaggtggaggttgcagtgagccgagattgagccactgcactccagcctgggtgacaagagcgagattccaccagaaaaaaaaaaaaaaaaaaaaaaaaaaaaaaaaagataattcattaaaaatttttggccaggcgcagtggctcatctctgtaatcccagcactttggaaggccaaggcaggtggatcacttgaggtcaggagttcaagaccaacctggccaacatggtaaagccccatctcttctactaaaaatacaaaaacaaaacaaaacaacaacaacaacaaattgccgggcatggtggcgggcacctgtaatcccagttactcaggaggctgaggcaggagaattgcttcatcctgggaggtggaggttgcagtgagcagggatcacatcactgtactccaggctgggtgggagaccctgttgcaaaaaaaaaatttaaatatggaataccttttattcagttattataaagtagtgctacttgtacttgttgactagtttgtctgatcctaaagtcagttctcttgctgggcacagtggctcacgcctgtaatcccagcactttgggaggctgaggcaggtgtatcatctgaggtcaggagatcaagaccagcctggccaacatggggaaaccccatctctactaaaaatacaaaaattagctgggcatggtggcaggcacctgtaatcctagctacttgggaggctgaggcaggagaatcacttgaacctgggaggcagaggttgctgtcagccgagatggtgccactgcactccagtctgggcaacagtgaggcgctgtctcaaaaaaaaaaaacaaaacaaaacaaaacaggccgggtgtggtggctcatgcctgtaatctcaacactttgggaggccaaggcaggtggatcacgagatcaggagatcgagaccatcctggctaacacagtgaaacccgtctctactaaaaacacaaaaaaattagccgggcgtggtggcgggcgcctgtaatcccagctactggggagtctgaggcaggagaatggtgtgaacccaggaggtggagcttgcagtgagccgagattgtgccaccgcactccagcctgggcgacagagtgagactccgtctcaaaaaaaaaaaacaaaaaaaacttgtctgttctcttaaccattacgttatgtgacagatatttttacacacacacacacacacacacacacacacacacacccaacagattagaaaagtttaataagtacacttggatatctaagttttaccagctatttatatcggctatttagttttcatcctgccagcagtgcttatttcattttgtctatatttaacatttggtcaggaatatgaaaacataatctgttttaagactcctagaaagctatgatattatttcgttaatactatcataggtttctaggttacaggttgctcgcttctgtaatctcagtactttgggaagctgaggcaggcagatcacttgaggtcaggagtttgagaccagcctggccaacatggtgaaaccctgtctctactaaaaatacaaaaattagccgtgtgtggtggtgtgtgtctgtagttccagctactcaggaggctgaggcacaaaaatcacttgagcccggaaggcggaggttgcagcaagccaagatcggatcacttcactttagccttggtgacagagtgagactgtgtctcagaaaaaaagaaaaagaaaaagaaaaaaagtgtgacaatgattgtatacatatgtcaaaacttataaaattgtacactttattatttacagtttattgtacatcacatacttcaaagtagtaaagaaatagtcacaatgaaaatgattgatattgcactttagcccataaaatcctttttatttgttttttgagatggagtctcactctgtcacccaggctggagtgcagtggcacaatctcggctcactgcagcctccaccctccgagttcaagtggttctcttgcctcagcctccccgagtagctgggattacaggtgcctgccactgtgcctggcttattttttgtatttttagtagagatgggggtttcaccatcttggccaggctggtcttgaactcctgacctcgtgatccacccacctcggcctcccaaagtgctgggattacaggcttgagccaccgcgcccggcctataaaatcctttttaatacaaatatatgaagtcaagaaaagttgtaaagaataaagtaaacaataatagaacctagactggcagtaaaatatatagcccacatcctacaggaaatgtttttgtgagaactggatccttggttagtacttatgccagcttctaggttagtgttatttatgaaatactctactaaatcaagtacccaatttttagaacacctataggcacccacatcaaagttgttttcacactgctgacattggatgagcttgtgagagaattaacgatcctaggatatcaagaagttgcttccaagaagggtgaccaggtttttgttgaactctggtgtgtgtgtttatgtctatctgtgtaccccagggcaactaaagtactgtcttcagtttatatcattttaaagcagtagttctcaaccatggtcacacataagaatcacattcagagctttaaacatgttgatgctcagaccttacccccagccaattacataagaatctgtggggatggaacataggtatcgttattctttaaagctgcccagatgatttcagtatccagggttgagaaccactgtgttaaaggtagccaaaataattggatttgatgtgttaatagaacttggtatcatatttttacaacaagaattcaatatatgttggcatattgcttgtacttgatgtaatttgtagagtgcttgagattgtttattcaggaactagtgaaggtgggtttctttcatttccctcactccctatttaaatttctctctcctgttcagtttgtctgtattacttttctttggtctaaaaagtaacatttgaaaattggaagccaaagggctaatatccagaatctacaatgaactcaaacaaatttacaagaaaaaaacaaccccatcaaaaagtgggcaaaggatatgaacagacacttctcaaaagaagacatttatgtagccaaaagacacatgaaaaaatgctcatcatcactggccatccagagaaatgcaaatcaaaaccacaatgagataccatctcacaccagttagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgcggcactattcacaatagcaaagacttggaaccaacccaaatgtccaacaatgatagactggattaagaaaatgtggcacatacacaccacggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcatactctggggactgttgtggggtggggggagggggggagggatagcattaggagatatacctaatgctaaatgacaagataatgggtgcagcacaccagcatggcacgtgtatatatatgtaactaacctacacattgtgcacatgtaccctaaaacttaaagtataataataattaaaaaaaaaaagaaaattggaagccaagtacatacataaccttgttttctaaatcacagtatatattgcgatatcctttgagatatgaggaagccagagtaatagaaggcattataccttaatggaaatctgcaaagctagagaaaatgagtaggaactactgacccaattactttgcttgtagtgaatgttttttccaacagaagtaaaaattttgcaaaaataaaacatgattcaattgtaaaaacatgcagaaagctttaaggtgaatattttatatccaaaagatgaacatcaagtgctttgcttatgagactgaaatcctgtcatatttggccataaatcactgtgagatctgagccatgaggactgtaggaatctggcatatgtctttagaaatgttttatatttattcacctaacacctttgttgtgttttcctttcctggaacttcagtagagattatgatagaagtgttttctttttttaaacactaactggggagaagggatggtaatttataccttcagtggagtctcatttatggttatttcttctttttaggcttgaatttgggtattttataaagatgtattaggttttcttttatgacttcttgtccttcaaggccaaaaggacattttgtgaggaaacatttagacttagtctcagtactgaaccatttagtactgaattgttcttgcacatagattttaagatgccctgcatgtagagatcccaaaatataaaactcttttctttgttgttttttaatttatttattaatggctaatgttattgccttttctcaagtaagttttagtttaagcacttgtctagttttgggttgagtttttagcagacctatagaggaagacagatttttatattttctgatctagttgtttttttaaccaactcatatgctcactcctgtcatttataagcaattagatgagggggatattcactgaccatacattacagaatcaaaataggttgggttctgtattaaaaactcagcaattttgtctgaaacatagataaacctctaatctcgagggaaagtattcatttatttttaatttctaaatttcttttgaaataaactaaatacaatcatgctctgcataatgacatttcagtcactgatggatcacatatacgatagttgtcccataagatgataatactgtattttaaaggtaacttttctatatttagatatgtttagttacacaaatataatacttatcattgtgttgcagttgcctacagtattcagtacagtaatgccctgtacaggtttatagcctagaagcaataggctataccatataacctaggtgtatagcaggctacaccatctaggtttgtgtaagtacactctatcatgttcacacaatgaatcacctaatggcacatttctcagaaggtatcctcatcgttaagctatgcataactatacactgatctgcttttgtaattctagctagtaaataaggagtaagaatctgctaaaacatataattaataatccgtttatgtctgggcgcagtggctcacacctgtaataccagcactttgagaggttgagggaggcagattacttgagcccaggtgtttgagaccagcttgatcaacatggcgagaccccatctctacaaaaaatatgaaaattagccagatgtgatactgcatgtctgtaatccaagctactcgatagagtgaggatcccttgtgcccaggaggtcgaggctgcagtgagctgtgattgcgccactaccctccagcctgggtgacagagtgaaagtgagaccttgtctctaaataaataaataagtaaataaataaaatcagtttatactgagcttggtcatgtaccactgtagcttcacaagcctgaggaatagtcaccacagctatctgctttgtgtcataggggaagcagcaaagttgcgtgcacatgcacacagacccacaatctttcatacacacacacagacagacacacacacacacacacacacacacacatatatatttgtttatacctgtgtatgtgtgtaaatacatagagggatttgtaaggataggatatagggattaaataaaatgccattttattttatcaacgttcagtcaccattttgagattatgttgtcttactccaaatagctaccgaggggaacagataacgtgcttggttatataagctgtaatgcaagcaatacaaatttgtttctgataattcttgtatttaaggttgatttttactttcaataatctactaaaggaaagcctccaaagaattagtgaaactagttttctgataagatattcaactatcatttgtcagtagggattgataaaatttaacagcttgaagatacttaaatcattttagaatacattatttatttgtttgtttatttatttacttacttacagagtctccctctgttgcccaggcaggagtgcagtggcatgctcttggctcactgcaacctctgcctcccgtgctcaagtggtgattcttctgcctcagtctcccaagtagctggcactacaggcatgcaccaccactcctggctaatttttgcatttttagtagagacagcattttaccatgttggccaggctggtcttgaactcctgacctcaagtgatacgcccacctcggcctcccaaagtgttgggattacaggtgtgagccaccgggcccggtctagaatactttaaaaaaaaacagataaaggaattttccatttcgtattttatatcagatttagaacatggaatttacttaaactttaattctgaatgagtcaactctttttgtagctctaagaagtgttccataatagtttgtgttctaaagttatggtcttcaacttacagttgaatttaaaggtataatttatagaaggcaatgcttaaagtttataagagaaaaaagaaagaataagactgggcatggtggctcatgcctgtaatcccagcactttgggcgactgaggcgggcggatcacctgaggtcaggagttcgagatcagcctgggcaacttggtaaaacccagtctctactgaaaatacaaaagtttgccaggcatagtggcacatgcctgtagtcccaactacttgggaggctgaggtaggagaatcgcttgaactgggaggcagaggttgcagtgaggcaagatcacaccactgtactccagcctgggcaacagagtgagactgtctcaaaaaaaaaaaaaaaaagaaagaataagaaattttgtttccttagaaagttgttataatttttgctttcacacacttgttaaaaaaatctatgaaaatctaaaacttattattgaaattcaagctaactctgaattagctatttgtaaacatactttgtggagaagggaatgttttaacaaagtaaaataaaataaaaaataaaaaagctaagaaaaaccccttttaaaagcattactagttataatgaatagtgaaaggactattcttgtgaattctagtgaatggctagtgaaatacttgtagtaactagtgaaataaaaatgtaagtttaatgctttttagttttgaaaacattaaaatcagaagtattcagttattcataacttaccagttgaaaagtagaaatttttgggaatgttttacataaggattataataagtgatatttaatatttttgatgtattgtagattagactgctgtactgttaatacagtacttctttttcttagctaagtctttcctttaaaatttatataatgtttttgcatttattctcgttttaaataatagtcttgagattttagttactggatccataatcaacatttgacatacttgaattaccttgtctttgaaatatttgtcttccagaataccgcatttgcctgattttcctgctagccttctagctcttttttttttcttttaaaatctcttttgcagcttccttctaatcctcacaacatctaaatgttggtgtacccttgaactctgtcctcgatcttcttttcttcctttttacaactcacttcctagttgatctcatgtaattccttgcatttaaataccatctatatggtaatgactcccaaatgtatatctccaaactggatttctcccctaaatttcagatacatatttatgacatactggagatcctgacttaaatgtgtaaaaggtatcaaaaattgaatatgcccaaaactaagttcctcatatatctccaaaacctgttccccctgcattttttctcatctcagttagtggcacctccattcttccagttcatatctttttgttttctcctacccacatccattccaccatcaaatcttgctgggtctgtttttaaaatatatctaaaatttgaacacttctcaccacccccaactactctgtttagatcaccatcacctctctcctagattataacatcctcctaaccgatgtctctgtttctgcttttcagtctgttttcaacacacagcatccagaatgactgttaatgcataactcagaaaatatattcatggctttccagttcactccagtggctttctgtgtcagtcagattaatagttctctcccttacttcgtctactctagctagacccactggccttgttgctaatttctgaaacattccagggatcttcaggacctgtatacttgctcttgcctctttctcaattcgtcttactccagatatggctagccttttcacttccttaaagtcttttgttttttttaatcaccttctcattaggccttcaccagctacctctctaaaagaattctccatgtcctgctttatgttttatatttacaattgacaatgtataatacaataaactatttatttaaagtgtacaatttggttaattttggctggtgtacatgtctgtgaaaacaccagtacagtcaagaaccagaacacgttcctcagcccctaaatggggactgtgtccctttacagtcatccacaatttgtggacaactgctggtctgccttttgttactttagttgtttttcttcttgttacttattactacctagcatgctattttacttattaatcttgtcagtgctccagattagcatttaagaggacaaagattttttttttttaattgctgcatcctcacagtcttggatgcctcccggcacatggtgttcagttaatatttcttgagtggataaatcacgtaactcactataaagcatctcctatgtgtcagacactacataggagttgaggatgtatcagtgaacaatacagacaagtttattatcttatggagctcacagtgaaagaaagttgttaataattagtgtaagaaattttatcagagatggaagagccttaccaaagctcaaaagatggaatggctatctttacccaggaagttgaagaaggcagttcttaagaggtgacatttacatatgatttttccaacatcgtaaactctgtgatccagagctgagaatcatgaaataagaacaacaaaaaagttgatacaggcaagatggattctctagagtttatgaacatatctttgcatttaatgcatagatgtatgactgggcgcagtgactcgtgcctgtaatcctggcactgtgggaggctgaggtaggtggatcatttgaggtcaggagtttgagaccagcctggccaacctggtgaaactccgtctctactaaaaaatacaaaaaaattagctggggctgggtgtggtggcatgcacctgtaatctcagctgcttgggaggctgaggaacgagaatcacttgaacccaggaggcggaggttgcagtgagccaagatcacgccattccactccagcctgggtgacagagtgagaccttgtctcaaacacacacacatacacacacacacacacacacacacacacacacacacacacgtgacctttggcagtgatttttttttttttttttgagatggagtcttactcttgttgcccaggctggagtgcagtggctctcaccgcaatctctgcctcccaggttcaagcaattcccctgcctcagcctcctgagtagctgggattacaggcatgcaccaccacgcccagctaattttgtgtttttagtagagacggggtttctccatgttggtgaggctggtcttgaactcccgacctcagttgatccacccgcctgggcctcccaaagtgctgggattacaggagtgagccaccgcacccggcccctttggcagtgatttagtacaagtccctagtgattgccatttctttctcaccacctcccacaatgttgattttccattttttcagcccgctgtcagtaagaagtagcaagaagtaaattggcagaaaagctattataagcaaaaggaagattcacttagctagtgattcaaagcatcactatatgtcagactcatctgaggagcttaaaaagaaattaagatgcccagaccccatctcaaagtaagtggctttactttaatttgagtgaaggaagatttcttctctgaggtgagctgagctttgaatgacaagaaggaggcagccccaggaagatctgggggcacaaaatacaggcagagggagcaaccaaggcaagaaattagccttgttaagaattttaagtgtaatgggaagccattagagggttttaaacaaggaaagatgtgatgtgacttatattctaataggattgccttgattcacctatggagaatggatttctgggatctcagtactgggatactgagatcccagggggaaaatatcactaaggttggaattgcttttctgcacattaaaagcaattctctttttccttgaaacctccatgtgatgttaattaggtaaatgggatttcaaggaaaaaaaaaatacaaaacaacaaaaagaaaaactgttatccttcattctcttaataagatgaggtattcagaaatgaatggagccaatattaatattccactccaaaaaatagtagaaatgagtttacatggacttctcacaatctccattccacatttccatctctgtttctcatttatgacaggtcccttcctttaaaaactttttttattataatatgttccaaaacttgtttgtcaaacctagggataactaataaaaatcagtattgtagggggaaaaaagtgaaagcaggaggccacttactgggctctcacagtggtccaggtgagataacggcatggaaatagaggtaattttaaggaagtgaagtgagcaggtagagtgtaggttttgaatatgggtgagttgctttgagttgacttggaagggatgtagagaatgagagaaagtgaggaattgggggtaacaccttgttttttcttgtaagactatgttagcataatttggtaattctagtcattgttaaaacagtcttattgcagtgttgactgtctaacatacaacttgagttttctggtagctataattaccccttccacttggggaaaaatatgaaagaaatcatttaacatttggcagttaagaagatgttgtttgtgctgaagtaattttatttttaaaactctcaacttacagagagatgcacttgagattactgaacataaattttttatagactttaaaagaaaatcattgtttcttatgatgtgccctttcttatgtatactatacccaataaaatgatttaaagaggaggagagaaaaagatgagtgtctttgcagattcattgaccctgtgagaatagggctttggcactgctgaagtcctcagcctctgactagtagcttgccagcacgcagcccctggtgttggacttcgttcagctgttcaggctgtctgtttctattcttgcagacagatggggtgcttgagaggaagccaggaagccaagccttaagaggacttggaagcaatttttggatataaatcccttgtcctaaactcagggcaacagtgtatcctgcccagcagtgttgaactgcctgtgtttgtctagtatgtgtgtactggctggttggctctgggcttcattccatgtatgccactgctctattgccaagataaatgtagaaggcctctggcccaagcccttctttagtacttaaaaaaaaaaaattgtggtaaaatacacataacaaaattttaccattttaacctttttttttttttttttttttttttttttttttttttgagacagagtcttgctctgtcacccaggctggaatgcagtggtgcaatcttggctcactgcaacctctacctcctgggttcaggcgattcttctgtctcagcctcccgagtagctgggactacaggtgtgcaccaccacgccaggctaatttttgtatttttagtagagatggggtgtcaccatattggcttggccagtatggtcttgaactcctgacctcatgatccacccccctcagcctcccaaagtgctgggattacaggtgtgagccactgcgcccggccatttcagcagtttttaagtgtacagtccagtggtattaagtacagcccagtggtattaagtacagatggttttcttttttaagagatggcagtcttgccacccaggctggagtacagtggcatgatcatagcttactgtagcctcaagtcctgggctcaagcagtcctcctgcctccacctcccaaagcactcggattacagatgagccactgcatccaacccattcatgatgttgtataaccatcaccactatttgcagatctttcttttttaaatcccaaacagaaattcagtacacattaaacaataattcccaatttccatctcttcagcccctggtaacctcttttctacttttttctctgtgtatttgcctattctaggtacctcatataaatagaaccacacaatatttgtccttttgtgtctggtttattttacacatagtgtcttcaacttttatcgttgttgtagtacatatcaggatttcattccttttaaaggctgaataatattccattgtgtacatataccacattttgtttatccatttatctgttgatggatatttgagttgtttccaccttttggctcttgtgactaatctgctgtgaacatgggtatacaaatatctattttagtctctgtttttaattcttttgggtatatactaggagtggacttgttggatcatacggtaattctatgttttaactttttaaggaactgacaaactattttctacagcagttgctcaattttacggttttttgcagtacatgaagtttccagtttctgtacatcctcactaacacttgttagtttctgggttttttttttttttcttttttttttttgatagttgtcatccgaatgtatataaagtggtatctcatttagttttgagttgaagtccttaatgattagagatgttgaacatctttttatgtgcttattgggtttgccctttttgtttgtttttttgagacaagagtcttgctccatctcccaggccggagtgcagtggtgcaatcttggctcactgaaacctccgcctcccaagttcaagtcattctcttgctcagcatcctgagtagctgggattacaggcacacaccaccacacctggctaatttttgtatttttagtagagacagggtttcaccacttttggccaggctggtcttgaacgcctgacctcaggcaatctacctgccttggcctcccaaagtgctgggattacatgcgtgagccacgatgcccggccaggtttgcccattttcaaaaatcttttttatttttctttcttttctttttgtctctcttttttcttttcttttctttttttttttttttttttcgagacagggtcttgctctatcgcccaagctggagtgcagtggcacaatctcggctcactgcaacctctgcctcccaagctccagtgttcctcccacctcagccacctgagtagctgggactacaggtgcaagctaccatgcctggttaattttttatattttttgtagagacggggttttgccatgttgcccaggctggtcttgaactcctgggctgaagcaagccactgcctcggccttgcaaagtgctgggattataagcatgagccactgaacccagcctctttttttttttttttcctacaccaaacacctgaactcattttatgcacttttattgttttttttgttgttgagttgtaggagtttttttaaatgtattcaggatatcaatcacatattagatatatggatttgcaaatattttctcccggtctgggttttcactcccctccagatcatatcctttgatgcataaaagttttaaattttgatgtggtccagtttatttttacttttgttgcctgtgcttttggtatcctatccaagaagtcattgccaaatccaatgtcatgaaacttttcctctctgttttctactaagggttctatagttttcactcttaggcttaggtctttgatccactcgagttaattttttcatatgatatgaggccattcttaacattttgtatggatttttaaaaaatgatttatgctactagggaaacagaaaaaaggacttctgaacttgaagctgataagttgtaaatttatcatgtttctgaattttctagataactctgtataattaattaaacagagctcttatcacccaagacattaatgagtggtagtctctaggaaccagctcagattaactgccaaataagctaaacttcctttttattgccagagttattaacctaagtggattataagtcaataacagaggaaatatatctgaattttaatgagccattttatagtcttgtggatacagtacaaaagcctgaactgaattatgataaacctagtgaatgtaacagtgttgatcacaaaattagtttgatctttgatcctgtgatactggcctccgtccacacacacacttcttagtctaaagaaaacagcctagtcttcttagaatatcatttaaaggctgggtgcaatggctcatgcctcttatgctaacactttgagaggccaaggcaggcagatcacttgagcccaggagttcaagaccagcctgggcaacatggtgaaaccctatctctacaaaaaattaaaaaaaattagcagggcatggtggtgcacacctgtagtcccagctgcttggtagactgaagtgggaggattgcctgggcccaggagtttgaggctgcagtgagctgtgatcatgccactgcactccagcctgggtgacaagagtgagaccctgtctccaaaaaaagaaaaaaaaaagaaaaatgaaggtatcttttggctgtgtggctctgttcatgtaattctttaaaaacgctgacttcaggctgggcatggtggctcacgcctataataccagcactttgggaggccaaggcagaacgattgtttgagttgagaacaggaggtcaagatcagcctgggcaacacaggaagaccccatctctacaaaaaatttttaaaattacctgagcatggtggcatgcacctgtagtctcagctacttgggaggctgagataggaggatcactggagcctgggaggggagattgaggctgcagtgagccatgattgtacctctgcactccagcctgggcgtcagagcatgacctatctcaaaaaaaaaaaaaagtctgactttatgtggaggtaagatcatgggtagcaggcccatacgcatcttttcaggtacttccgtcttcccaacacatgtatattgatgaaaggtggattcttattttccctgcttaggtcacatggcacatggctacccagggggaagtcactgttcattggaattagggtaatttagggaaggtataaattgacagctgataccacagggaataagtgaggagcagttcaccaaaggaattaggcatgctggacaaacaaaaccaatatgatacaaaggtacttttgtcaaaataaaaaactaaaagtagtactttgttactaactaaactccagattttatttctatttcagcagtttttccattaatattccctttctgttccaggattaaatccaagctaccactaaattgctaacaagctaaattgcacttacttatcatgtctcccaatcatgtcagatcactgtttcagtttttaatgagcattatggttattttccggctttattgggatatagttggcaaattcaaatggcatatatttaaggcgtaaaaaaactcgatgttttgatatatatgtacattatgaaatgaccttgacagtcttgaagaatactagccaagtatcctatagtgtgtcctctaatctgtgcttgtctgttgtttttctcatggttagattggtttataggtgtcttagtgtgttttgtgctgccataacagaatacctgagcctggataatttattgagaacagaaatttaatttctcatagttctgtaggctgggagtccaagattgaggtgctagtaggttttgtgtttggtgaaggcctggtctctgctgccaagagggtgccttgaatactgcatcctccagagagcaggagcactgtgtcctcacatggtagaagaatagaagagagcaaacccactcctacaaccaaccaaccaacttccctccctccctccctccctccttccttcctttctttctctctctctttctctctctctttctttctctctctctcttccctccctccctccctccctccctccctcccttccttccttccttccttccttctctttcctcctttctcttttctttcattttctttttgatggagtttcactcttgttgcccaggctggagtgcaatggcgcgatctcagctcactacaacctctgcctcctgggttcaagcaattcttctgcctcagtctcccaagtacctgggattacaggcacccaccgccacacccagctaattttttgtatttttagtagagatggggtttcaccatgttggccaggctggtcccaaactcctgacctcaagagattcacctgccttggcctcccaaagtgctgggattataggtgtgagccactgcacccggccctaaaagctcttttcataatggcattaatccattcatgagagtggagccctcatgatataaacatctcccaaaaggccctacctcccaacactgctgcactggggtttaagtttctaacacatgaattttgggggacgcattcagaccatagtagtggattttgggaaagagcacaacagaggtgaagtagctttcttgtcacaccatgttaggcgatagatgcaatccacatgtcatcactgttgatgttaacctttaccacttggttaaggtagtgtttatcagatgtatccactgaaaagttactatttttctctctcccaactcagttcttcagaatttgcttttttattattgtagaaacaagtcactccagcccgcactcaagaggagggaagattggctctacattttgaaggaggtgtcagagaatttgtgaacatattctaaatctctacaatacactcttcagccacagattatttacattcatcccacgtgcagaatacactcaccccctcctattattctgcagaattctcatttatagcatcagcttacagtccaggatattgtcatctaaattaggtccagttttggatgaggctcctcagatgtatgtagtttcttcagctccttgagtacattacttctctatgtgaagacctgtgaaactaaagaggcaaattgtttgccccacacataaccaagatgcaatgattggtcaggtgtatgataactagtgtagacattcttgttcaaacagagggaaaatgttggtacaaaggtgtcgttacgtcacaccatttttgaaattcagctgggcacaggttggtaattccttgattaaaatacaggtctggaaataattcattatggctcttagctcgtccttctgggcttttgtttccacactctgagttttcttttctgtgaaaagtaggaaagtaggcttttttttgcagctgtgtagattcctctatccacttccaacctgtagatgtttgggagtccaaggccctcttttcattttgtactatttctgtctctttcagtcgaaatgggcagtgtttctgccaatataactttcttcaaaaccttatgggtctcctgttaatatttgggctcacttccttaaacaaaagtcacacctaaaaatctctttgagataagccattctcgttcttgaaattccgctgagaggcaatagcttttagcttcttagaaactctcctctttgatggttgggcgtggtggctcacgcttgtaatcccagcactttgggaggctgaggtgggcagatcacctgaggtcaggagttcgagaccagcctgaccaacatggagaaaccccatctctactaaaaatacaaaaaaaattagccaggcgtcatggcgcatgcctgtaatcccagctactcaggaggctgaggcgggagaattgcttgaacctgggaggcagaggttgcggtgagccgagattgcgccattgcactccagcctgtgcaacaagagcaaaagtccgtctcaaaaaaaaaaaaaaactctactctttgattaaaataatctgtaagtcacacctttaaaatctttaggaggccttttgtctaattgaatagtactcagaggcatgatctgggatctcaccaaggttgaattttatagctgtgtcctcaaccacatcttttagatcgttttcttgacagtacttgggatttgaattttgctgggaagccattttttgttttagtattttttgcgtgtgagagactgggaatcttcaaaaccagcaagttctggctcctttttgttcaactgctcttgagatatttattaggagtttggaaatttgagtctttgttacagtggtgtagacttggcaaaatgagaggtctgggagtcttcagcatttgttcagtggaattgaagagattgaggagcagaaggaaagctaagggtggagctttgagaaatgtgtatctttaataagcaaatgaaaaaagactgagagagacaaagttggagggggtcaaagacagattggagaaatggaaagtacaggatcagagaagtattgacagtggcctggcctcctcactttcttaacatggttggtttggtggaaagttttccagtttctcttcataataaactctttgagtcaagcagattaataccttttatatcttaatgtttatatcattagcttttgtattaagctgaagaatggaaacaccactccagaggcaaagttggagggcaagtctatataactttgccctgtataaccataaagaataccatggaaaagaatattacatgcttaaagtcatacatgctttcaaaaattggcttgtctttttgttgttgaagtttcacagtgttttaatcactgtgtttttaacatcagggttaaactctctaacagatacttgatttgtgttttcttctgtagaatgtcttttcactttctcgataatgctctttgatgtacaaaggtttttaatttttataaactcctatttttttttgtttgtgctttggcatcaaatctaagaatccattgccaaatctgattcatgaagatttacccctatgtagatcttatatttagattgttgatctacttggaatcagtttttatatagggagtaaggtaggggttgaatgaattttcttgtttcattttattttagagtgtgggaatcccaactggtgaatatatgtctgttcttatacattgagggcagatagtatacaatcgtatacaatacaggttttaggagattttctataatgtagtttttaactcctctgtcagactcttaagaaaattgcttgaccctagttcctggaatttggttttgctcctttttttttttcttttgaattttgattataaagaaggatagttctagaaactataagttagatattttagcatgagtcttctaatattatttaccggcgcttcttttttttttttttttttttttacatgaagccgaggccagtgtatgttgaggcacttggtaaacaaacaaatcataagggtaaagtatttttaacaatgtttggatgttgtctttggaatgtgttttaattctagtttcaccatttttttttttttggccaaatcaatagctgcatatcactttttttttaaaacaattaattggaaatacttctgaataaaatgatttttgtaaattcatactttgcaccccctctactttagtagaaatgatagataaatgtagaaattgaaaagacttagccacattaaggaaagatcaacatgtctgtgaacctgaaatggaatcaaaagagtgaggtgatgagtgaggcttaaagccagggatcgtttagagtccaatgtaagtgctagtcgctgagtttcattcctaagtagtaagggaagtaaatgtacttcatggacaccatttatataaagcttttcagaatatccagttcactttaaaaatctcacacctgtaatcccagcactttgggaggccgaggtgggcagatcacctgaggtcaggagttcgagaccagcctgaccaacatggtgaaacctcgactctactaaaaatataaaattagctgggcatggtggcacatgcctgtaatcccagctatttaggaggctgagacaggagaatcgcttgaacctggaaggtggaggttgcaatgagctgagatcgtgccattgtactccagcctgggcaacaagagcaaaactctgtctcaaaaaaaaaaaaaagcatgagaatgcaaacacaaaatttagaatagtaggtacccctgaggagtggaaaatggaaaatggaataagggaagacatagtagcctttaacactgtatgtaaacatttgttaaacttaaatccaaaacaaagagaaaaactgaatgtgtgtattgtgaggaagaagaggtacccacaggaatttagcctaaagaaacaacccaagattctacaaatatttatatatgcaaatatttactgtggatttttttttttttaatacagaatttctctcttgtcacccaggctggagtgcagtggagcaatcttggttcactgcaagcttcacctcctgggttcaagcgattctcctgcctcagcatcctgagtagctgggagtacaggtgcacgccaccacgcttggctaattttttgtatttttagtagagacggggtttcaccatgttggccaggctggtatcaaactcttgaccttgggtgttccgcccgccttggcctcccaaagtgctgggattacaggcatgagccacggcgcttggcctattgtggaatttatgtggtagaaaattagaaacaactgaatgtccaataatagggaatgaatgggaggaaagggaagaacaggagaatacaatggttatatctactctatggaatactctacagtcatttaaaaaaaatcagtgttgttacagaccaatattggaaaatgtttatgaaataatgttcagtggaagtaaaagcaagatacagaattgcatacatagtataatctaaattttaaaaaaatgttaattgtggtaaactacatataataccattaaaaacattttggtatattcacaatgttgttcaaccatcataatccaaatttaataaataaatattttgcataggaaaaagtaccaaaagaaaatacatgaaaagtgttcacggtgatgaaaggtgttcacggtgatgatttttttgttttttgtttttgttttttgtggagacagggtctccctctgtaactcatgctggagtgcagtggtgctatctcagctcactgtaacctctgcctcccgggttcaagcaattctcccacctcagcctactgagtagctgggactacaggcgcgcaccaccatgctggctaattgtgtgtgtgtgttaattgcaagcctagtaaattccattataatatatgtgattatactctgtagagtagtatactatatatacatcctttgctattgatagttacattccaacaaagttaaactggaattttgtattgaatctttcaggaggaactttgaagttgtttatgaatatctccaaatatcttttttggggcttatataaattaaaagttacacaagaccttttcgacctagttagtctcttaagagtgttctttgtttataggcttctgtaaatatgtaatgtaatgttaccttatgtaattaatgtaagctaccttattttgaaaattcagaatatttgccttataagattttttttctatacaaatttatctgatgccatcggacctgtaatttctttttctctccactcaggtttaaaaattcaaaataattggtacatataggtagtttacaagaagcagtcattaatgctattataagttctgttctttatttcttagtgaactagaattttcctgtttcctgtgcaatcttgatgcttaaaagaaaaggccaggcgaggtggctcacgcctgtaatactagcactttaggaggctgaggcgggcagatcacctgaggtcaggagttcaagaccagcctggccaagaaccctgtctctgccaaaaatgcaaaaattagccaggcatggtggtgcacacctgtaatgccagctacttgggtggctgaggcaagagaatcgcttcaacccgggaggtggaggttgcaatgagccaagattgcaccactgcactccagcctgggggacagagcgagactctgcctcaaaaaacaaacaaacaaataaaaaaaaaccaggctgggtacggtggttcacaccccagtgctttgggaggttgaggcaggaggatcatgttaggccaggagttcaagaccagcctgggcaacatagcaacaccccatctctacaaaaaaattcttaaaaggttagctgaacatggtggtgcacacctgtagtcccagctacttggaaggctgaagtgagggcattgcttaagcccaggagttagaggctgcagtgagctctgattgtgccactgcattccagcctggggaacagagcaaggccctgtctctttaaaaaaaacaaacaaaatcaaacaaactcaaccccaaaggcagaaagtagagaacggatgctaagtcaataataaaaaaatactaatgtcatttgctttctgacaggtaagtaaaagatgactggggatacactgtttttttgtgtgtctgtgttttaaattattttgtttttggagtcagagtgtcgctctgtcacccaggctggaatacagtggcatgatcttggctcactgcaacctccacctccagggttcaagccattcttccacctcagccttctgagtagctgggattacagacatgtgctaccatgcccggctaattttttttttatagttttgatagaggtggggtttcgccatgttggccagcctggtctcaaactcctggcctcaagtgatctgcctgccttggcctcccaaagtggtgggattacgggtgtgagctactgtgcctggccaggatacactgttcttctacctactttgcacttagggaaacgggcatggagaggtgaattatcatacaactagtagaaggtagagccagaattcagacacaggcctctctgattccagtcagactttatataaaactcagcaacccatccagctacctgttgctgtatgtattaggccgttctttctttgctataaagaaatacctgagactgggtactttataaagaaaagcagtttaattggcctacagttctgcaggctgtacaggaagcatggtgctagcatttgcttggcttctagggaggcttcagggagtttttactcatggtggaaggcagaggaagagcaggcacttcacatggcgatagcaagaactaaagaaaagggtgggtggtgccacacacttttaaatgaccagatctcttgagaattcactcactatggtgaggactgcaccaagccataaaggatctgccccctcgacccaaacacctcccaccatgccccacctccaacattggagattacatgttaacatgagatttgggtggggacaaatacccaaactatatcactgtgtgattagtaatctctctcacttttagctgttcctctcttggaactatatcttaccccttgataccaaagccactgtattctttagggagatgacattgtcacaaaaggtataggacaaagatggtggattctggatcctgacattgctagacttaaatcccacttctgatagtaatcagccatgtctccccaccattatgatcctcagatttctcattcctaaggcagtgtagtaacatatactgttaaagattgttctgaaaattaaagataatatatattatgtgtataaacatatgtatatgtgtattcagtctttccaaagcttatctaatatcattgtaacttatgattccttttaattttaatcatgattcttttttgggtttctaatttcatattttctcttttgctacttattttgataccacctggttttgtatatacttgaatcctttttgtatttatttagtgataaccattgtcttagtactattgagatatcatgtgaaatttttattcacttttgtcaaaaaatcactagcctaaaagtgtaaatcccaatcattgatgtgggatagtgtagcagtttctttcttaatattgcttattatatcttgcctaagttctgaattatgtggactgtataggtgtagcattctatattatgagcttgtgtttctcttctggctaatacaaaaatcaagagctgtaagagtttataaaatcatggttctaatatttaccatctctgtggtaatttgatctaatgagttgactctgttattactaatgtttattacagcataggtaattattctaccaagaaaaattgcttttagtaacatgccctacatagggctgttttcattcataatttttttgtcacactttcaagtaggtaaaagttactggcaacactggaacacctcttttagaactgtattgaatatgggcattactctgcatattttggagacatttaaatcttcagtataattttgtgacagaaaaggacagcaatgcctgcaagtccctatgccttaatttatgttatgttatgttatgttatgttatgttatgttgtgttatgttatgttatgttatgttatttttttgagacaaggtctcgctctgtcacccaggctggagtacagtggtactatctcggctcactgcagcctccacctgcctggctcaagcgatcctcccacctcagtctcatgagtagctgggactaagcacacttggctaatttttgttatttttttgaagagacaatttcttgctatgttgctcaaactcttaggctcaagtgatctgcccaccttgacctcccaaagtgctggaattacagccataagccaccgtgcctggccttctatgccttattttaaaaatgggtaataatagcaactaaatttagttcctgatttttatagtccatgttagcctgttcagtgcattaaagaaaacagtggagtagaaagtcctcttcacattagaattgaaactcagtgactactgtatttaggaagaatagagtagcaactaactgccaccatggagatttctgctacccagctgacttcagtaattgtggctttttttaagaatctttgcagaggacaggttgtcagcatgattactctgtctttaagcttctgcataggtttgcagtaaggtcttcttttttcaatataaaaggaaagtgtgttgttttctgagagaagatagatgatagctttctctgaactatcactgggtaggggtaagtcttgatacactttaatattttgtaataatttagcaaaacattattttttaaaaaaatagtttttaatgctttatccaaactgtaactatgtcttttgtaattcaaaagcagtactattttccttctaactgaagattttgacaaaaacttgagtctgggaggtcatgagccatgactgtgtcactgcactccagcctaggcgacagagtgagagcctttctccaaaaaaaaggaaaataaaaaggattaaaataatgatgccaataaaactattggataggttttttttccccaaaagggtgttatattctactacattggatggattataaaatttaatattacagttgtctttagtgactcttctttgaatacatttcattaatgagatatagtcaaattattttattatagtcacttaaaatatttcctgattttgttctaaatgtatgaacacttgcttgatgaatacttcatttcagttatttaagttcatttttattgtgagagtactgatgtcctaaaaactgccagtttttgtccctaggctgcttttatctaaatggtctttcttactagtagcattctggttgccagaaaataaaggaaattggcttcaccatcaatttatgagataggtaggaagatatggttgactctccaaagggatgctagaattctatttagctaccatatgattattttgtaatgattcttaatggttatagatagaagattcatatatatgagatactgctagatatccactgtacctaagaatagaaatgctaataatgttatgagatgtacatactgttttttaaattcatattgtttttttaaattagatatccaaatctaattgttatactctttgggcacagttaccaattggtatcaaattacaagcccaagaatacaacaggatatgtgtatgcataaagttcacaaatttagataaatctaatttcactttattagattccaattttgtcttgatatatggagtctttttttaccccctttaaaattttttattatggaaacttaaaacagaaaaaatatatataatgtatccattatatgggcataaataaaataatataatgtacctatattcctattacccagcttcaatggttattaacccatatcccttcttgttttcatctatatttctttgcccattggattattttgaagcaaattccaaaaattatttatttaatcatttaaagagaaactttgtttctttacatatataaccatgatatagtaatcattatcacatttgaaaagaaaattagagtttcctgtgttctggattttgctgattgcatccccatgaagttctgtagcatgtttctctgacacctgtatttcctgttagacctagaaaaggttctctcaacttctcactgttggaattttgtactggataatttttttgttgtagaagactgtcctgtgccttgcagaatgtgtgggagccaagcccttcggccccagtggtttgctgaaaaattaccgacaagaagcagattgattaataggaaaaaaggcatacacatttgtttaacgtgtatacacgagagccttcagaacaaagatccaaagatatagggaaattgttcattttcatgcttaggtccagcaaagtatggacagccatgtagaaacatgattggacaaaaagagtatgatctaatgctaatagacttaatggggaaacccagcaaagcctgtctgttgagattcttcttgccctctcagagcatgcatttcgtccttctgggtgtgggcagggctctctctgggatgggggtcttatggcccacagtgaaacaaggtaggtcatttcatttctttatggccagtttttacacagggtattgttaggctttctggttggtttttgaggaaaggggttctgatttctatgacccaccttggggaagggggattctagtttctgtggctgacctcgggggagaatgggactaagagacaggagagcagaagtcagaaaaaaacttagcttctgcggctgcttctgaagcctacagtttggggattgttttctgagctccagtagatgtttagcagcatcgcaggtctctagccactagtcaacagcaccccctccaccaattgtgacaaccaaaagtgttccagacattgccaagtgtctcctgggggcaaaaattgcccctattgggaactctgctaatctagaggctgatgagattcaggttcattttcttggaaagaattcttcatatgttgttgtggtattttctaccttttctaaacatcactttttatctcttttgtcatatacggtctcttaatagactatatacttaaaatatttgctgaagctttagaagcctcagttttaacatttatttgagtatttatatgataatatccaaaatgtattagttattttaccatttattttgaattttagaaaaaaacaatatattttacaatttggtaaaaatacagtactctaggtgactgtgtaacctcttaaatttttttcatttacaccccccaggtttggatttaggtttacagtttatagatacaggtgcttcttgttttagtattagtttgataaagtaccaattatttttaaaagggatgatacttagtatcattaaatagaattccaaatgactaataagagagagaatgcaggcaaagtaaacctttgagattttgtgaaacatcctctgaattctctatattctggccatactgatcattgcctcactactcttttatctgtgttggcaattgaccttattctctagccccttaaccaactattccttaagtcctcacattagttagacacaaccagccccaatactagtgagctaggcctctgtataacagaagacaaaatataattaaatcctaaataaatgatactatgtttattgagtactttttctttttaaattaggtttacttaggaattcaaatgcattcagtagttactgttttgtgtttgatcttttaagcacccaactctgttgctacagagcatagatactttttctatcccattaattggcttgattgaagctgttaagaagcataatactcattggtaggatactgactaaaaatactgcttgtttctaactgtgcttcaccagtgaaagttgttggtaattaaaatggattaactcatatctggttttttgtttcacattaaactgaggagccagggtatctgtcatcttacattgggctcgtcttttctctgggggcctgttgtttatgttaaagtaaattttgtttgattacttgttttcatgatgctagatttgcatgaatttcattttgaagacctttgtggttatcagtggcttttaaaataaaaatagctccacattctcaggaggagttggaatttgatctctaacgaattatacagggaaaggcttgtgtggtgggattccagtgatctttactcagattatctctgtctgacatctcagaaactgggttattttagctccctttaaatttgcttttgagaacatccactatcacattaacaatacttagttgattgttgcttctgtgaaatgctcttttctgctacattggtctaccttgtctttatatgcctttaacactttagtatgtataacacaatctaacacttcatacaatttattatttccctagttaaatttttgaaaagttttgagtataaaattgtgtgttatatatcttgtactgaacatgtagaaaagactcagaatatgcttgtgattgattgtcaggttattaagaactatccagcatgtatgaattttgtaaatatgctcacaggaagagttacttcaaatctgactgtgccagaaaccactgactcatgaccaggtgtggtggctcacacctgtaaccccagcactctgggaagctgaggcaggagcatcacgtgagcccaggtggccgagatctccctgggcaatgaagcaagaccttgtttctacaaaaaatgtaaaaattagccaagcgtggtggcatgcgcctgtaatcctagctacagaggaggctcgggtgggaggatcacttgagccccagagttcctggctgcagtgagctatgatcatgccaccgcactccagcatggatgacagagcgagaccctgtctctaaaacaaaataaaattaaggaaaaaacctacaaaccattgactcatggaaataaaaaatcatatctgctgttcaaagcttcaggcatgttctttgaaattaataattgtttactttggtggaacctcatacatccctatagatttcccccttgctgctctttttctgttggtttagcttctttctctccttctctcctctctctctttctctctttcactccttccttccttcattcattcattatttttttgagacacagtctcactctgttgtctaggctggagtgcaatggcgtgatcttggctcactgcatcctccaccctccaggttcaagcgattctcctgcctcagcctcctgagtagctgggattataggcatgtgccaccatgcccagctaatttttgtatttttgtagagatgaggtttctccatgttggtgaggctggtcttgaactcctgacctcaggtgatctgcccaccttggcctcccaaagtgctgggattacaggcgtgagccatgttgcctggccagtttagcttctttaaaacagacataaataaatgtaccttaacttacatcttaggtttagatttttgaacgatttatgacttagctgtatttggttactattttgtactagcttaaaaaaaaagaaattaattttaccagacctgatttacttcttttttctttggaaacaggaatatctggtataaagggtaatatcctactagagatgaatgaggaaaccatagttttaagatgacttctgctgatacaggatatgctttcattatgcttttacttacctttctcctcagttaatgaacaaaggcaagtctgaaatattttttggaatgaaaatgttgaattaggatagccttgggagagaacagaaaaatatcttttttaaaagttactttttggacacagtggttcacgcctgtaatcctagcacttcaggaggctgaggcaggtagactgcttgagcccaggagtacaagaccaggctgggcaacacagcaagacccccatctgtaaaattaaaaaaaaaatgttaagctacttcttaaaaagaagtaccttagatataaatacttcaaatatttgtttgatttgccctgctctcaagctactacatttagttgttaaatttgaactccaggtttcagctagtggttatattagatagcacattagagagggtgaaactcatcaaatggtgtgactgcccaccttgtcctctacatttatgatgaaaactgaagttaaaaatatatcaaaagaggctggacacagtggcttgtgcctgtgatttcagccctttgggagaccgaggcaggaggactgcttgaggccaggagttcaataccagcctggccaacatagggagaccccatttctacaaaaatgtaaaaaaaatagccaggctggtggtgtgcacctgtagtgccaactacttgggaggctgaggtggtaggatcgctggagcctaggaagtcaaggctgcagtgagccagcctcagcaacagagcaagaccctgtctcaaaaaaaaaaaaaaaaaaaaaaagaaatgtattaaaagaggttacggatttgaaattcagcctgttggggtggaaatgttaggtaggagactgttttagtttggttctttgtttccattaatagtcacacttggccgggcatggtggctcacacctgtaatccagcactttgggaggccgaggtgggtggatcacctgaggtcagacgttcgagatcagcctggccaagttggaaatcccgtctctattaaaaatacaaaaattagccaggcgtggtggcaggcacctgtaatcccagctactcgggaagctgaggcattgcttgaacccgggaggcagaggttgcagtgagccaagatcgtgccactgccctccagcctgggcgatagagtgagactcagtctcaaaaaagaaaagaaaagaaaaatacagtgaagactggtgtacctaccactaatttcattacttgctaaaattttgtcatttttgcttcaactattcatgaacatctaaatgttttcagatgtttaaggctcaactcatcattttgtaattgggccatatctaccttgaccaggaagttgttatagtataaaatacacagtatagttgccagtcactatgtgtatggatgactggtaaggttttctcaatgtacaaaatacctgacttgcctttgccctttgatttctaaggagaaacagttttaaaaaaaaaagtctcatcctatgtttctgaatactagactgtgagagcttcagtttagacagacattaaagagaaccaagcaataagtgaagctgttagcagcatgaggctcaaattacttgcttcatcatcatctttgctctcatgacagccaaaaactgttatccaatgactattctgtgtaagataatcatttcacatgtttaattcttatgtttccttctgtgaagcatgtaggaagtttgggatatgatttcagtatttgatttagataaaaatttgtgcaggtctaagcttgaagatccacactactacagcacagacctctgcagcacagggccttggatagagtggagtaggcattcatgataagtttaactgaatagtattattttgtatactgatacttaaagaaaagaaatggcacctctcatttaatggtttctctagaagttttcacaatatacttattttccctttattccaatacatatttattaggctagaattcaaagctcaactgaaaactgctcaggcaattgaaataagtttttattgatagtgacctctgattggtgaggattcccagttctatgtttgtgtgttgagagagagccagagtatgtgtataagctgtagcaatcaaggtagaatggttttttggccagacgtggtggctcatgcctataatcccagcactttgggagacctaggcaagtggatcacttgagcccaggagttcaagaccagcctggccaacatggtgtaacactctctacaaaaaatacaaaaattagctgggcatggtggtgcatgcctgcagccccaactacttgggaggcttgggtgggaggatctcttgagcccaggaggttgtggctgcagtgagatgtgatcatgccaactgcactccagcctgtgcaacagagtgagactctgtctcaattaaaaaaaaaaaaaaaaaaaaaagcagggctggcatggtggctcatgcctgtaattccagcactttggggggctgaggtgggcagaccacctgagcctcaggggttcaagaccagcctgggcaacatgctaaaaccctgtctctaaaaaaaaatacaaaaaattagccgtgtgttgtggcatgtgcctgtagtcccagctacccaggaggctgaggtgggaggatgtctggatcctgggaggcggaggctgcattgagtcaagattactccattgtactccagcctgggtgatagagtgagaccctgtctctcacacacacacacacacacacacacacacacacacaaagttaggatggtttcttagaaaaaaggtgtagggatttttttcttcttgagacaacaatgctaaattaatatggaatcttttcaagtttagtaaacaaagataaaccttctatttgctatgattggttggtaaaatgagtatctttcacactgacaagttacataataatactttaaatagtgttttatggacattgttttatcatatccttacaatgatactgtgaaataagtagggcagctgttaaaatcctttttaacaaatgaaaaggcttgagaaaaaaattacttgctttttagctcacatgagtaatttgtaacataggcaaggagaaaacaaacttacattccagtttgctgttctttttgaagaccacatagtcttcgtagtctttaaattattgtgtattacaactgcaggatatggtattaggtataacagctaatgtattggatggtatgtctttggaagttagaaagaagtgcagctgatagtggctcctctggagctgatgtaaggggctttgttttgttttgtttgttgttgttgtttcctgaccttatatgatttaaactttgacatcagttctaatgttcgtgatgctttgtagacatagcctgtcattggtggttgtatacatagaccatccatcacttccaccttggttttattctgaatttaagatttattttcaaagataaactaaaatttactttctgtttggcccctaggattagtaaacttaacctgctttttgattactgctcatactcttgtggtaggactttttaaaataatactttcttcttgttgttttacgagccatttgtagatgagtgatatatagtggtttattggggtgattggggacaatgagtttttgttgtaccttgcattcaagtatatttacttatgcctataaatcaggtattatcacctctcctttttcagatgtcagtccatcaacagtgtatgctctttaccatttgcatttcaagaaccacttggaaacttggaaataatcctttatttttgctagtcatgcctctgtcgtaatgttccaagaggcctgggctgctttggagaggcttgtctggctttgcctgccccctgcctcatttaactacaatagaatagctcataagatgctctctgcataagattttatttgaaggaaggtatctatatttaacttgggaaacaaatagcttaggtagaattataaacgagatggtaatattgccaaataaatgggatacaccctgcccagctccttcccattctgtcacacagtgcataggagcagttttgtaattagtaaactctatgtggccatgatctttggaatggtatgtatgggatataacttttatttccattaatatatatttatgattatgaaagtcttagatatggtagctgcgagaggtatcattttactggttattagtcttattcatatttggattagaactttatggatttccttgggcaattagggagataacttttaatggtttacattttgctccttggagttatgatgttacccagaagtctcaaagcccatcatgggggagggagaagccaactgaaatatacatggctctggccctaatagccattttagttggaggagctccagttttatctgttaaattagtgggattctacaaaaaattagtttgaaagaagattctgggggtaaaataaaatttgaaaccactggattagtagaaagatctaggagttagaagacttatgttccagttttggctgtcacattaactagttttgtactgttagataagtcacttaacatatttttctcagtttttcacatataaaacagaactaattcggtctgcctcacagagttgtccttggatagtggtcttaaaaactggtgaatcagtctgggcatggtggctcactcctgtaatcccagcactttgagaggccgagatgggaggatcacctgaggttaggagttcaagaccagcctggccaacatggtgaaaccccatctctactaaaaatacaaaactagtcgggcgtggtggcatgcacctgtaatcccagctacttgggaggctaaggcaggagaattgcttgaatccaggaggcggaggttgcagtcagccgagatggcgccattgcactccagcctgggtgacggagtgagactctgtctcaaacagcaacagcaacaaacaacaacaacaacaaaaataaccaaaaaacgatgaatcaaaatgtattaagtaatgaagatattgttaataatagcagcaatactccaataactgagaaattgaaaatggctttgaattttgttgtagaatttatcacaataacgtatggctttcttttttccaattttctgttatctaggcatgattgtttcttttttaaatgttttattttttgatattttattttttatcatttatttatttatttatttatttttgagacggagtcttgctctgttgcccaggctggagtacagtggcacgatcttggcttattgcaacctcagcctcctggattcaagcaaattctcatgcctcagcttcccaagtagctggacttacaggcatacatcaccacgcctggctaatttttgtattgttagtagagccggggtttcaccatgttgcccaggctgatcttgaactcctgacctcaagtgatttgcctgccttggcttcccaaagtgctaagattacaggtgtgaggcatcactcctagcctgtttccttatttttttaatgttagatttgttggccaccttccttaaaatttcatttctaatgaaagacagtttatgtatactcatatacacagcatatatagttgtgtgtatgtattttgaaaaacttatattgattttcttttacagtttctaagaacgtaagtagataaatgaagcttaatttggagaaaactttaactttctctgccattcccaagagaaatcaagctcagaatgcttgcatttatttccagcctttgaagggccagaaaattgtgcctgaaaattgggttagcacattttctgaatctgactgctgttaagttactctgtagttgggttggatgctatttcctgtcttctttccttcaagcagagaatatgcacttcacattttttaaggaaaccattcctagcttgtatattcatttacattctacatcttatgattgcaaggatacacataaagagtaggtcttattcagaaaagtcctggcagttgtcccagccttaaagagaacaagcctgtgctcttcccttttacctgatggaatatcactatggcctttctttgaggagttgattagcaaacttgactcagagaggaagtgagaatagcacattgtggttaggtggtgctggctgattttctagctcttgcacagcatatgcctcttaaatatcagggggagtaagctgctcttgcatcataccaccatggttggatagcccaagttgcaatttcaagtattgctggccagtttctggtacgtagttatggaaatataggaaagcacaattctgtctgacgaaggaacatatatatctgcttgtggagtattaagtgtgagatatgccaggtagtattttctatcttttggaagttaagaaaattaaatacctgaaaagaagtgttcttttttcttatttaaagctctttctactaaacacaaatatccttagaaccaagaattccataggaactatgaaacctaactggtcaagtattttctggcatagtaacatgtagttttattgcccaaaggccctcctgggaaaaatttatatagctagcaatccctttgataatcataccaatagccatttgttaagagtaccgcttagctgggcacggtggcttatgcctgtaatcccagcactttgggaggccaagacttgggggattgcgtgaggccaggaatttgagattagcctagtcaacatagagaccctgtctacaaaaattacaataattagctgggcatggtggcatgtacctgtagtcccagctacttgggaggctgaggtgggaggattacttgagcctagggagttgaggctgtagttggccatgattgcatcactggcactccagcctacgtgacagagtgagactctgtctcaaaaaataaaaatagaaaaagtacctattatatgccagttcttaaaaaatgtattttaaggtaaataaatgaagacaaaggtcatacaagttagtagcagggccagagggttgagtacaattctccctggtgtaaaactcattttctttccctatgttctcagtgaaaaatcatttataaaatatatcttttacttttcagagtatagtttctcttgaaaacaatttatgtgaagtgaaacctacttgtatttttcatggtgaaattagacataatatccctaaaaatgaaaacccaaaagacaaaatatttcaggaagaaaattaaggttggagttcttggaattatatatcaccaagatcaatttgccttgcttgaggattttagtatacacctgtcagtttactttttggttgtgtcatagtctttagtacaggaatttttctttgcccccttcccccctcccttttatttttggagacagtcttgctctgtcacccaagctagagtgcagtggcgcgatctcgactcactgcaacttctgcctcctgggttcaagcagttctcgtgcttcagcctcttgagtagctgggattataggtgtgcaccaccacacctggctagtttttgtacttttagtagagatggggttttgccatgttggccaggctggtctcaaactcctggcctcaagtggcctgcccaccttgcctcccaaagtgctgggattacagacatgagccactgtgcctggcctttttcttgcccattggtcactgttttcctcttcacactgctgtactctacccccagaacattacgaggatcttatcagtccatgccaccagaaactttgctcttcctctagatattcatgacttatacaggaatgcaatattacatttagtcagtagatgccatcatctaacatataatatgtttcagactggaacttctttaattcgtggctttagtttattttaaattaatccatttctactctctagattaaaaatcatgaatctcttgatttgttaataatgaaaactacttgtggtttttttttcgctcaataaattacatttgtaaagttgatgtgtgttttcttttgccagttttattaatagaaaagtaatcattgagctgtttttatgcattttgttagtattttgagatagggtctcactctgtcaccacgttggagtacagtggtgctatcatagctcactgcagccttgaccttccaggcccaagcaatcctcctaccttagcctcccaagtagctgggcaaacttggccaattctttctgtgttttgtgtggagatgaggtttcaccatgttgcccaagctggtcttgagctcctgagctcaagccatctgcctccctgtcctcccaaagtgctagtgtgtccggaattggtgggttcttggtctcgctgacttcaagaatgaagccgcggaccctcacgggtgagtgttacagttcttaaagatggtgtgtctggagttcgttccttcagatgttcagatgtgtccggagtttcttccttccggtgggttcgtggtctcgctggcttcaggagtcaagctgcagacttttgctgtgagtgttgcagctcataaaggcgatgcagacccaaagagtgagcagcagcaagatttattgtgaagagtgaaagaactaagcttccacactgtggaagaggacctcagcggcttgccgctgctggctctggtggcctgctttttattcccttatctggccccacccacatcctactgattggcccattttacagagagctgattggtccattttacagagcaccgattggtccattttacagagagctgattggtctgtttgacagagcgctgattggtgcatttgcaaacctttagctagacacacagcgctgattggtgcacttacaatcccttagctagacacaaaagttctccaagtcccctacccgattagctagacacagagtgctgattggtgcatttacaaacctttagctagacacagagtgctgattggtgcgtttgcaaaccttttgctagacactgagtactgattggtgcatttacaattctttagctagacagaaaagttctccaagtccctacccaacccagaagcccagccggctttacctctcaatggcactctccgggggactttgtggcacctagcctgggcactccggcaacccagaaggagcttgtgccccgatcaagcccagcaggtgctggcgggccgtgccgagtgcagggcccactgagcccgtgcccacccggaacccgcgagcgccgagcgcagccccggctcccgcccgtgcctctccctccacacctccccgcgagcagggggagccggctctggcctcagccagccccggcgacgggctgaagggctcctcgagcgcagccagagcggatgccgaggctgaggaggtgccgagagcgaatgagggctgctagcaagttgtcaactctcactaggactacaagcataagccaccacacacccggcctcttttgtgcattttgtatgctgccattgaggtaatggtgccactagtaaaagcaaccctttgatgtagatgagatagtaggtcagttacagcctttgtctctgaaggtatttacaagaaattgaaataacgtcttttatttttaaggccaaacaatacttcaaacctattttttctgtgacgttttaaacagttgagaagattgtctagtatccactaactttggactaaggaactctgagtctacagtctttcacccgctaaatacacattgttttattcaaagatgccaagtcctatcatcatcttgagatttgtccatgagtcagactttggaaataccagctaagccagtgacactggatatagcttcaggcaaagggaatagcttgtaccttggccaggtggagattaaacaagaacagcagttactattcactgaagatacttctacttaactaatggctagggagtctaggggtgtctctttaaaatatcagacttgagttcattgctatttcatatttctttgttagctgcccttccttcagttctttacatttttattttttaggactaaaccttgttgggagtcatttttcagtctcataaggaagaaggaaaagtctttaaatttttgttgttgttgttacaggtatgagccaccaagcccagccaggtcttattcctttttgcatcacaggtgcttatgacagtattaggcttagtggtgccatacataaacttgtcgcattaatggacaaactgaggatcaggtgttaggagaggcaactaattctgggtaaggatttgcctaactgattctctccagaatattagttccctaaactaataactctcctctaaaatcttgctaactaccttgactaagtacagattgaaagaagaatattaatgatgaatatgaagaaagttagctgttctgagagaggatcttgtataaatttacaagatcagtggtaatttgctttttggtaaccatgagaacattaagccatttgtttctgaatttatcgtgctggtgtttttggtatgtgtatttcattctttctggttaggctctatatctgttttttcctgatgctatgtcagtttataatagtcctgtatcactcactgtggcattgaggaatatctgtcataggatttttgttatatttttgttttttagtgaggtgggggagagggggaatccaaacattttccacacaaaaatcatgatcctcatgtagtaaagttttatactttgctgttttcatggccttcttgctgctaatctccaggtggtgtttttgccttttggcttccctcttgtttatgttaaatatgtcagtaattgaattccaaaacccttgcaaactttggcagccaatttataatcaatttgtttattctttttcttcattatgattaaccaagactagattttactttgcagatttacttaaatttgtggctgtttaacaactcttcattctgctcagttagtcttcgtaacattaggttagaagagagatgtcattttcaaggagagatctttatgttatgtctgataacctaatctgcctcctggtttatctcttgcatttgctgtttgtgtattctgtgttctgccttgatccttttactgatttctgtgttgacctctgttttttaagctaccaatttaagctggaagttaggcacagaatttagaatggttgaaaatagttctttaatatattttgcttttatagtgcctttcctccaaaaaagcttcctgcttttataagtagcttatttgtcttcctggcatctttgcagaatagatttaaggattgggattagtgtttctttttttacatttgttttctgaaaaggtgaacctaacattgtgggctagcagccagtgtcaaagaaaattgaaaagttacattaatgggatgcattccattccttctcccttcacctaccaaagaaacaggtgagaatgagattctgatcatttgtatgtagaatcttcaaggagcaagctcctaacttaaaaaaaaaaaaaaaaaaagacctgttttcttcctgaataaactatcaaagagcttctatcatcatagttttattaatttgatctgtgttacagacattggggaactaagattgtaattgcccgatgggttcttccctgcctgctgcacagacaaaaatcaattcactgagatcatggcattgcagtagggaaagggtttaattgacatgaggctggccatgtgggaaaaccagagttatcactcaagtcagtctccccaaaggcctgcaggttagggtttttatggacagtttggtggatgggggctagggaatgggtgctgctgattggttagggatgaaatcacaggggtgtggaaaaactgtccttacgtgctgagtctgtctctggtggagccacaggaccagttgagccatgaatcacaggtctgggtggggtagatctgaaaaacatctttaaaaaattaatcttagattgtatagtagtgatgttatctgtaggagcacttggggaagttgtaaatcttgtgacctccagccacatggctgctgagcagtaaagatttatagaaactatacctatatcttagcagagttcaggcccctcccataatcctattcttgtggcctttgattagtcttacaaaggcggtttttggtccctgagcaaggtggggattcgttttagagagggactattatcatgcttactttccttcttcttttttttttttttgtatttttagtagagacagggtttcactatgttggccaggctggtctcaaactcccgacctcaagggatctgcctgcctcagcctcccaaagtgctggcattgcaggtgtgagccaccaaatctggcctcctattatcatctttactttcaagttaatttttttttttttttttttttttttgagacagagtcttgctctgtctcccaggctggagtgcagtggcgccatctcggcccactgcaacctctgcctcctggttcaagcaattctcctgcctcagcctcccgagtagctgggattaccagtgaccaccaccatgcctggctaatttttgtattttcagtagagacggggtttcaccatgttggccaggctggtctcaaactcctcatctcaggtgatctgcctgtcttggcctcccaaagtgctgggattccaggcatgagccactgctcctggcctcaggttaaattataaattcctcccaatgtcagcttggcctatgtccaggaatgaccaaggacagcttggaggtcagaagcaagatggagtcaactctgtcagatttcccttactgtcataattttgcaaaggtggtttcaagattattagtatagtttttacagataaagaaatcgagtcctggttaagtcatataactttattctaactatccttcagcaagtgctaaaaatagttctatgctataaaggtacagaaaagtaaagaatttggtctggctatggataagacaggtgtttgtatgtgtaattctgaccaataaaattttatgatagtgtgaacaaaagtgctaagtaactaaaagtcaaggtaaatgtgactagtcaaacaaaagagttcatgaaatcatgacttgagatgggtagaatttatccagagccctatgacttgtaagagaattgggatttgtgtacatcatggtgttcattatatactactattttctgcctgaaaattaaaattagagtagaacgtacgatgaagcattcattgaagaagtaaagagaagaccttatgaatccttatgcctactatattgtcttgatcttctgaacacagtttattttccttcaatgaattttgacaagatgattcagagaatttagcagatggcagttttgaggaaagaacagatgcatttcttttttctctctccagtttgtgatttataaagcagtcacattattcagttgtttcactctctgcaatagctacagcattggagtaggtgaactaatacatgatttacaaagataagactaagcaaatgaagttcttgtgaagcaaataaaatgtttggtttctctccggtatctttggatgcaaagtagtggtggttattcctaccaccaccccaaactgcagacacgagccagagttccttgcttgaggaagaagacattaagaaacatttatttgttttgccagataccaaaaagtattcaggagagttacgtggtccctacccccgagtcccttacaatctggttgggaagacagaaatgaagaacataccttaagtctgcatattgctagtactttacaatttatgagcacttttctcatacacagtcatgtatcccataatgatcttttagtcaatgacagactgcatatatgatgctggtcccataagactgtaatggagttgaaaaattctcactgcctagtgacattgtagctgttgtaatgtcatagtacaattactttatttagtgtagtctaagtgtagaatatttataaattctacagtagtatacagtaatgtcctaggccttcacgttcacggaccactgacagactcacctgagcatcctccagtcctgcaagctccatttatggtaactgccctttcttttctttctttcttcctttctttttttttttgagacggagtctttaggctggagtacaatggtgaggtcttggctcactgcaacctccgcctcctgggttcaaatgattttcctgcctcagcctcctgagtagctgggactacagctgtgtgccaccacactgggctaatttttgtatttttaggagagatggggtttcactgtgttggccaggctggtctcgaactcctgacctcgtgatccacttgcctcggcctcccaaggtgctgggattacaggtgtgagccacttcgcctggccggtaaatgcccttttaccatttcaaaatctttttatactgtatttttacactgtatattttttgtatttttatactgtattataccttttctatgtttagatacataaaatacttaccattgtgctatagttgctcaaagtgttcagtacagtaacatgctgtacaggtttataccctaggagcaataggccataccatgtagcttaggtgtatagtaggctataccatctaggtttgtgtaaatacactctatgatgttaacataacaataaaattgcttaacaaatgatttctcagaatgtgtacctgcaagtgacacatgactgtattctgtttcaagagagtcttggagtcaccatccaagctgcccagttgacagactagaagccacatgatttttaagttgatgtgaatgaggaactaaatttcttttttttttttttttttgagatggagtctcgctctgtcgcccaggctggagtgcagtggcgcgatctcggctcactgcaacctccgcctcctgggttcacgccattctcctgcctcagccttcagagtagctgggactataggcgcccgccaccacacccggctaatatttttttgtattttttttagtagagacggggtttcactgtgtttgtcaggatagtcttgatctcctgacctcgtgatccgcccgcctcgccctcccaaagtgctgggattacaggcatgagccaccgtgctggccaggaactaaatttcagtacttgaattgctaaatgttatgctatggactatggacagtaaaatattaatggtcatgcaagaatgaggtgaccattgttcattgagagattttagggggtttacaaactccctcaaattgtatggtaaagtttatacgtgtgtgtttctagaacgttcatagttttcagcagatttttttctcgtttttttttttaattgatgtataattggcattcatatcatcagattttgaaagtaagtccctggccttggaaaaaggttttaaaactacttgtcttgagtatttggaaaacatttcttagagcatgaggccttggggtgagttctgaaaaataagcaaagagagagcaacctggacatatacaggtgacagcacctctacttttcataaagtatcccttcttccctttactgtgcctcctgttacaagagtcctaattgatttggatatagtggttactggtcacatcatagtcttaataatttttagatgttattgaactagtagagtatttttctagttaaaatgggtgagggaaatacatttaagaaatcacattacatgcaatagaaatgcaagtttaaccagaaaattgaataataattaattgcccaatactaaggatatggtatctacatattttaacccagaagcttatcatggaccagaaatttctgagaatataattaccaggaaaaaaaaaaaaaagacctagcccttgctctcctggagctttcaaaaggaatcccacaaatgtgtgtataattttaaaaactcagctatgctcttagatgtctctttttgggaaaatcccaaataagattattgacatatattggcaggccccctttcagatagttgttcttttattagatgagtggattatcctgggggtttgggaggagggattgtcccccaggggacatttggcaatgtctggagacatctttggttgtttcacctcggggcatgctactgatatctagtggatagaggacagggatgctgctaaacctcccctaatgcacaggacagccccacaacaaagaattttccagctcaaaatgtcagtcttaccatggttgagaaactctgccctaggtgaacatttcaaagtaactgaaaagttaatattgctgaacaggcctttataaggtagaggcagcacttactcaggtattccagtactgcaatatcgtaccatcttatggttctagtgtttcctcattagtaggtttcagactttattaaaagttcctctggtatactgaatttatattctgcttttggtccatttcaatggagtgattaatgtagtaggggataatggctaaggttggaagttggaactctgcttttaaaagaaaaaatgccctaaatttagtgatatgattaatatattgttattattatctgttgtcagttttactgtaattgcatgaatatatctgacagataaatcaaaaaaacatgatcagtttggactgacatacaggaaggacttagaaagtaatcaagataggtatttctggatgaatctctataacagcgcttcactggctttaacatgcagatgaaacacctgggaatcttaattaaaatataagctactgattccatacgtctgaggggaggtctgagagtatgcctttttatgaagcttctgggtggcaagtccagatgaagcattagatcattgcaaaaataagtatgctttaagtatcactttaaccaaaaagaagacaataatttttaaaagactttctggctttttatttatttgtaatttcattttttaattataaaagtgacataactaatgttggagaaaatttgaaaaacagaatagaaatctctagtactaataatgtctgccatctcaatgaagttgctagtattttgtgtatctttcagttattttatcctaagcgccaattaaaaatgttcttaaaacactgtatgcattatacaacttttcatttgcttttgttagggaaaaagggaagaaaaacattctcctttatagttttctcacttgtcttctctgctactatgttttgttattcagccttgaataattcttttcaggaaagaattttttactcctttaaggaagaggcttgctgagagagatcaaggatcacatgccttgctgtagaaacttcattttgtaagctgacttatgtcatgtggtagttaaaaatatatttctcatcactgggaaaactaaaatgagaaaagtctgtccctttaaatttgattttgtttctccttgaagatgcgtgactgatgttctgaaacttgacctagtcgaagaacatgaactttttttttcttaaagaaataccttttcagaagatcaggacttgtgaatcaaaaacaaaaacagaaacaaacagaaccccttttcttccttaaaattggcagctttttgacaaatatgtggttaaagtacaagtttaccttgatatgtacaggtacttaaaatctgtaggtgaaattgttattatgaatcttattttccatttacttgtattagttcagaaatgccctctaatgagaagactataaagaagtttacagattgttagagaaaattaccctttgctctatgcttttaatgcagcttatttacctatattttatttaattatattttatttatttacctgctcaccttagataggctcagtatatttcatgataggcttctagactgacaagaaattaacttacactctggaggggttactattattattttaaaactccatgtaacttataagccatctgagatctctgagggttcagtaaaccatacatagttctttaatctcaactcataatttgtagaaagcatcgtgtttaaagaaaaattgtagagtcattttataaagttgtaagaaatgttattgctgttctgaaaactaatattttttcatatatgcatcttaattgtcaatctgaaaggtcagtgactgatgacaaactttcttctcctcatctttggtctttgtcttctgatactactctttcaagcctcttgatagtttctttaatttgacaaatttctgaggtagattacataatgtatcccattggttagttagccctgttgcactgctgagtgattgttttctggattttcttaggtctgactctttcaggaatgaatttttaagtttcctatagttatatcataatcggttccattgggacctcctggaattgattgaaagcaacactgtaaatagtccaaaggttttaaaagctgtatgttcagtaaagcatgttaatggtttagtaagctcatgtattctgtacagttaccaatgtgattaggctttatagcaactattagcattcggtgactatgccaaggacttagctcatttactaagctgagttcactctttatacaaatggctcttcagacatgccacattatattggaagaatagtaataaaaagttcctcatctcctttctcagagaattaccatccactctttcagtcttcttcaatgagatgactctacagctcactcaaaaggaatctcttaaccatcctgttgctccttacctattgtatcagttgggattaagttcagctgcaaataatagagagccaaattaacacaggctttaaaaagatagaaattggcccagcacggtggctcatgcctgtaatcccagcactttgggaagctgacactggtggattgcttgaccccaggagttcgagaccagccttggcaacatggtgaaaccctgtttctaccaaaaatacaaaaattagccagtcttataacctggtatttaaataaataaataaatagattaaaattaaaagaaaaatagaggaagtttatttctcttttatgtaaaagtccggagataggctctgtcccacgtatcttcagggtcctagacttttccatcagattattccattgttgcttgggtatgatccttgtccttgtagcccaagacaccattatatccacatcacacatcaggtaataggatgcaggaaggttcaaagaagaaaaggtaaaggtacatatctcctgacatgagctatttgttaacatattcacataatctctcttctctttttgaatttccatataccactacagagtttattttttcactaatcactgcagttttttatcatttgggccaaagggacagctaactagtggtcatgtttatggaaaattcttccagtcttcagagtcctaagtataaaacccacgctgatcaaaaaaatatcattcttggcctggatgtggtggctcacgcctataatcccatcactttgggaggttaaggtgggtgaatctcttgagccctagagaccagcctgggcaacatgacaaaactccgtctctaccaaaagtacaaaagttaactgggtgtggtggcatgcacctgtagtcccagctactcgggaggctgaagtgggaagatcacttcagccttcactgagcccaggaggttgaggctgcagtgagctgtgatcacaccactgcactccagcctaggtgacagagagatcctgtctcaaaaacagaaaacaaaaagtatcattctcatactttttgtaattctgatgcctatctcaccctttgaatacatcagagtattaaaatgtgagtcacaaaataatgagaggaagatgagtgtaggagcaggatactatccatagaaacagaacttggaactttaagaaattggggtctctggaaaataaatgaagaccaagaccaactaataggaaataatttgctcatatatttttggaggtactcgtcgtatttatttgtggggtttttttagtgtcaaatttttattaatagggttttgtgcaatgaaaaaaaaatagggcaatacttccaccttgctttcttagtggatagaagaaacaatattacttctcaactttgactgatctacatatgtttttgaggctaatgagctgaggtctaaggttagaactgtaagaaaaaagaatgaagagagccagttccttcttctgaggtgttcagatgagctcaaaattagggctgacttacctcagcagtgagattttagggatgactgtaatgattgaattgacgataatcatccagcagaacatctggaaacacatttggccaaattctaaggatcagtggccatagaataccacattgatgtcacaccagttaccccagagaagaagggcttttgtgcatgatgtattacagttggtataggtacatggagtatttacatatggctgaatgtttcattttgtttttgtcaatttaaaatgaggcctggaaacagccccaaaaatagacaaatggaacttaaactttctgcacagcgaaagaaataacccacagagtaaagagacaacctgttgaatggaagaaaatatttgcaaagtattcatccaataggggtctaacatcaaaaatacacaaagaacttaaacagctcaacaacaagatccaaataatcctactaaaaagtgggcaaaggacatgaatagacatttttcaaaagaagacatataaatggccaacaggtatatgaaaaaaatgctgaacattactaattatcagagaaatgcaaatcgaaaccacaatgagatatcatcttaccccagtcagagtgcctattactacaaagacaaaaaatagcagatgttggcaagggactcttgagcactgttggtaagaatgtaaattagcacatccttggagataatgccaagatagtatgaagttatctcaaagaactaaaaatggaactaccatttgacccagcagtgccactactgggtatctaaccgccagaaaagaagtcagcatataaaaaaagtacctctactcgtatgtttatcacagcaccattcataatagcaaggatatggaatcaatctaagtgtgcaccaatagataaatggataaagaaaatgtagtacatatatacaattggatactatttaagccagaaagaagaatgaaatcatgtcagggacagctgactaatggtcatttgcagcaagaactggaggtcattaagtgaaacaagccaggcacagaaagacaagtagcacatgttctcactcataaataggtgctgaaaaaaatgtgttcaggtgaatgtagagaggtggatagataatggagacctggaagggaaaggaagtcgcagtggaggaggggaggatgatctgaaattggttagtgggtacaatttaccttatttgggtgatggataccctaaaagccgtgacttgacctctatgcaatctatgtatataacaaaattgcacatgtacttcataaattggtacaaataaaaaggaaaaaaatagctcataggagcacaaaccctattgtgaactgtgcatgcaagggatctaggttgcacactccttaggagaacctaatgcctgatgatctgaggtggagctgagatggtgatgctactagcactggggagcggctacaaatacagattaacattggcagagaagtttgcacagagaccataatcagttgcttgcatactcatatcaaaaccctatcagtgagtggcaagtgacaattaagctgcatctggtggcaggctttatagtggcaagtgagctgcatctggtgggaagctttaagtcgggctttattttagcctgcgcatggcctgcccactatttaccacttccatctgggcctcttttcctgcactgtgcacttgtctcactgacagttttgttagcccacaagctaaccctagccaaaataagtaaaaaggaagagtttatttgaaaagggggaaagacccaatgatgagacagcagaagactctaagactgccagcaaaaaagaaagctgcattgaaaagaaaataccaagagttctacttaaattacaggttcattgcaaccagtgattcacattctccaagcccactttgtatatgtggcgaccggctatccattgaagccatgaaaccttcaaaactgctttgccacatggagaccaagcaccctgcattaaaagacaagcctttggagtttttcaaaagaagaaaatgtgaatacaaagaacagaagcaattattgaaggccaccacttcaaatgtgtctgcattgagagcatcattcttagtagctaaccacattgctaaagctaagaagccctttactattggtaagagttgatcctaaggacatttgttttgaaccttcaggagaggacacagttcagaaggtggaacgtgttcctctcagctagcaccataagtagttgaattgattgaatagaggatattgaggcacaattgatagagagcattaatgagtcactgtggcacgcagtccaggttgatgagtctactggtgttgacaaggcaacaatgcttgtttttgtgcactgtatttttcaggaggatgtgcatgaggatgtgttatgtgcacttttgttgccaaccaacaccatagctgcagaactattcaagtctttgaatgattacatatcaggaaaacggaattggtcattttgtgtcagtatatgcacagacagagtggctgccatgactggacagctttctgatttcactacttgggtcaaagagtttgcttctgaatgtgagtctatgtactgtgtcatccatagagaaaggctagctagctgaaaaatgtcacctgaacttaacattttgcaggatgtgattaaaattagcatccacatttaagtacatgcttttacatgttcacacagctctgtgaggagatagatgcagagcacacacatcttctcttatgcacagaagtgaagtggctttctaaaggtccattgctggccagagtttttgagttatgagagccactccagagatttcttttagaaaaacagtcaccactggcagcacatttcagtgacacagaatgggtggcaaaacttgcttgtgtgacatattcaacctgttcagcgaactcaatctgtcacttcagaggagaatgacgactgtgtttaagtcggcagataaagtggctgcgttcaaagccaaactggaattatgggggcgatgagtgaacattaggatttctgacatgtttcaaacatttgcagagattttgagagggattgagccaaggccttctttctcccagctggtgcatgatcaccaatctcagctttcaaaagagtttgagcattactttccaaccacaaaagacccatgagttgggaaggaatggatctaccacccatttgtgaataagccagtggaatcgactttgtccatgctagaagaggattaactgcttgacatcacaaatgacggaggccttgaaagtatgtttgaggcaacttcaaatctccatacattctgggttaaagtcaaggtggaatattctgagattgccacaaatgcactcaaaagccttccgtttccaacattctttgtgaagcagcgttttctgcagtgacagcaaccaaaacaagattgttacagagtagactggacataagcaacacacttcgagtatcactgtctcccaccacccccaatcctgcaactaaatgggaccatctagttgcaggaaaacaagttcagggctcccactgattatgcattatggtgagttgtgtaattatttcattatatattacagtgtgataataatagaaataaagtacacaataaatgtaatgcacttgaatcatcctgaaaccagtccctggtgccaaaaaggttggggaccactgacctggattatgtatataatctcatagccaaaaacgataatgtaatatccatatatatgtgcatatatctgtgtgtgtgtgatgttataatattaaactaccttgcattcctgggataaaccctattagctcaagatttataatctttttgatatattaatggatttgatttgctaatgttctattaagattgtgtgtttatgaagaattttgtttaaagcttttctctttgagtactgttttaaaatttagcacaaaaattttgatgtgttgcatttcgtcattcagttcaaaatattttatttatttttatttatatttaagtttttttagagatagagtcttactctgttgcccaggctagagtgcagtggcctcaactcctgggtttgagctatcctcctgcttcagcctcccgagtagctgggattacaggcatgcaccaccatacctggctaattttttttttttctctgtagaggcacattctccctatgttgcccagactggtctcaaactcctgggctcaggcgatcctcccaccttggtctcccaaagtgctgggattacaggtttgagccaccccactcagtccaaaatattttctaattaatttcatggtttcttcttgacccatggtttattttgtttttatttttattttttttccaaaccctgcatgtggcatttgagcatggtttattttaaaatattacgttaaatttccaaatacttggggctcttctaggtatcttactgatggtttctgatttaatttcattatgctcagagaacatactctatataagtttacaataaatcttttgagatttattgagacttaccttctgatttagcatttgatctgtattggtgaatagaccatgcacacttgaaaagaatatattttgtgaagttgttagtgtagtatttacaaatgtcaattagattaagttggttaatagtgctgttcacatgatctatgtccatactgattcttttttcatctatttattatttcagttactgtgagaaggatgttagttcacaatcatagttagagatttttaaaaaatctgtttctccctttaattctctcaaattttcttcgttttgttttgttttgagacaagggtctcactgtgttgcctaggctagtctcaaactcctgcactcacacagtcctctcacttcagccttcaaattttcttcttaagaccaggcatggtggcttatacctgtaattgcagcactgggaggctgaggtgggaggattgcttgagcccaggagtttgagaccagcctgggcaacatagccaggcatgatggtgcactcgtgtggtcccagctacttgagaggctgaggtaagaggattgcttgggcctggaaggtcaaggctgcagtgagccattatcgtgctactacactcagcctaggtgagagagcaaaaccctgtctcaaaaaaaaaaggtgggaggtattaaataacaacacattttctttctttctgtttttttttgagatggagttttgctctttttgtccaggctggagtgcaatggcgcaatctcagttcacctcaacctctgcctcccggattcaagcgattctcctgcctcagcctcccgagtagctgggattacaggcatgtgctgccatgcccagctaattttgtatttttagtagagacggggtttctccatgttagtcaggccggtctcgaactcctgacctcgtgatccacccaccttatcctcccaaagtgttgggattgcaggcgtgagccaccgcacctggccacaaattttcttcttaaggttgaagctttatatcagacatatatacatttctgattatgtttttctgataagttatctgttttattatttttttttggagacaaggtcttgctttgtcacctaacaggagtgcagtagtgtgatcacagctcactgcagcctctacctcctgggctaagtgatcctcccacctcagcctccctagtagctgggaccacaagtgcaagccatggcacctggctaatttaaaaaaaaatttttttgttttttgtctcactatgttgcccaggctggtctccaacttctggactcaagcgatcctcccaccttggcctcccaaggtgctgggtttacagtcatgagccactatgcctgtcctgttgtatcattatgaaatgtcagtctttatttctggtaatactctatcttggagtctataactgaaaataatatagcctctccccattttttcccccttaaacattacgccataagaagcttttcaaaaggagctaagttgcctggctggagtgcagtggctattcacaggtgtgattataacccactacagccttgaactcctgggctcaagagagcttcctgcctcagccaccccagtagctaggactatagacacaagctagcctttttatacttactgttttcatcaaatgtctttttccaactagtttccaacctgtctttgtatttgaagtgcatctattgtagatagttcagtgttgcttttaaagtgcttactccatttgtgtttagtatgttgacatggttggatttagatctactattttgctttctgtttttattcctgtttatccttttttacttcttacagcttaatgaattttggggggggaattccattttaatttctctcttgggtttttagctacatctttctttaggattgcactagagattacaatatacattcttaacgtctcacccttttgcctggggcggtggctcatgcctgtaatcccagcactttgggaggctgaggtgggtggattgcctgagctcaggagttccagaccggcttaggcaacatggtgaaaccctgtctctatgaaaaatacagaaacattagctggttgtggtggcacacacctgtagtcccagctacttgggaggctgaggtgggaggatcccttgagcctgggaggttgaggctgcagtgagctgagatcataccactgcattctagcctgggtgacagagtgagatgctgtctccaaaaataaataaataaataaaacaataccatttcatttaaatttcaggaattatacaaccacagaattctgtttatgactcttcttttatgcagtagttgtcatggttttttcttaatgtggtaacccgtatttcaatattataacttttgctttaagtagtcctatgtatttccagtagatgaggagataataaaacttagtcttatatatttaaccatatatttgtccgttccactgatcttcatttctttctgaagatctgttctgccatctagttttgtttcctattagtttgaagaatttcctttagcatttcttgttgtgcaggtatgttgggcagggagttggcttagttttcacttatctgaaaatcttgttatttcatctttattcttgatggatatttttgatgaatatggagtttcagccaaacaacagttttgttgtttgtcttcagcaaaagacagtttttgctcttcccctttttcttatgagaatccaattatgcagatgttaatttttttaatactgcatcccatatgtttctcaggctctgtttttttcccccaatctttttttctctcttttcaaactggataatttctttccatttatcttttagttcactgatccttccgtcatctccaatctgctgttttgaccttttagggaattttttcttttttacctcagatatattttttagttttagaatatcaatttggttagtttatagtttatttctcttttgagatttcctatctgtgtgttaattttcaaatatcctttttatttacatccttaatcatagttatcactgtagctttctcttctaattccgacacctaggtaatttcaagtttggtctccaactgtttcttttgagtgtgtcatattttcctgtttattcatatagctaataattttgttttgtatactggacattgggaatgctgcattgtagatatatggattctgttatgattctctgagaaatgttgatttttttgtgttcggaggcagttaacttgactgagtctaacaccagcccctctcttgccttcagtgggtacctgctgaaacttctgttcacatattttagctttatctgggcttcttagaatctgtcctgtacattcagagtttacttgtcagccagaaatctcagtagagtttatatgcagagtgtgggtttatgtgtggctgtctttctttcttttctttttttttttttttttttgagacggaatctagctctgttgcccaggctggagtgcagtggcacgatctcagctcactgcaagctctgcctcccaggttcaagcgattctcctgcctcagcctcctgagtagccgggactacaggcgcccaccaccatgcccggctaattttttgtattttcagtagacacagggtttcactgtgttagccaggataggatggtctcgatctcctgacctcgtgatccacctgctttggcctcccaaatgttgtgtctttttaaagtatctacagtaaccttgtatcaacttagtttgtcagtctattaatactaaatttagctccttcaaagcagttggaactatgtgctacataaatttcagtttcacccaagggaagaagtgaaattagtgaatagacagttacagcaaaaaaaaaaaaaaaacagaaacaaaaaaaccataaaaattaaatagctggctctagtgaaatgagcaaggactgtggagtcaaactgacctggatttgaatcctgatcctactgtttgtagctgtatgatctggacaaatgacattaactctttctaaccttgattttctcatctgtaagacgccaattgtaactcctaaggatactgaggtggttgtttttgtttttcggtttttttttgtttttttgtttttttttgagatggagtttcgctcttgttgcccaggctggagtgcagtggcatgatctcagctcactgcaacctgccactcccaggttcaagcgattctcctgcctcagcctcccgagtagctgggattacaggtgcacgccaccatgcctggctaattttttgtatttttaatagagacggggtttcaccatgttggccaggctggtcgccaactcctttcctcaggtgatccactcagctcggcctcccaaagtgctgggattacaggtgtgagccaccatgcccggcctagatactgaggattttttaaaatgcatatacagttcctgaccagtggtttttgcctaataaataacttattacaaattgttacccagtaaaaaccctgagacgagtgaaaaaataaagctaattaatccattacttgctagtaagaaaataaaaaaaaaatctctgttcatttatgtcttaagatttatcagtatctccatatagctttgcatagtattactattataggaggtgctttttataaaatgtcagatgttaggccagacacagtggctcacacctgtaatcttaccactttcggaggccaaggcaggaggactgcttgagcccaggagttcgtgaccagcctgggcaacgtagggacaccctgtctctaccaaaaaaaaaactttaaatattagtaggctggccaggcatggtggctcatgcctgtaatcctagcactttgggaggccgaggcgggtggataatgaggtcaggagatcgagaccagcctggctaacatggtgaaaccccatctctactaaaaatacaaaaattagctgggtgtggtggcaggtgcctgtaatcccagctactcaggaggctgaagcaggagaatcgcttgaacccaggaggcggagattgcagtgagccgagatcgcaccactgcactccagcctggtgacacagcaggactccgtctcaaaaataaaaataaaataaaataaaagaaaatattagcaggttgtggtggtgcacgcctgtagtctcagctactagggagcctgaggtgggaggatcacttgagtccaggaagttgaggcatgtgccaccacgcccggctaattttttgtatttttagtagagacagggtttcaccctgttagccaggatggtcttaatctcctgacctcatgatccgcccgcctcagcctcccaaagtgctgggattacaggcgtgagccaccgcacctggcttaatatttcttaaatgagtgaatgagtgaacaagacagattttcttatagtgtaatcaaaatacaaattccagagcatgggactgtatttcttagagtagcgttgctacattaactactgtaattacttttcggtaaaaaattacttttgggtacttttgacctgcatgtttctataatgttctatgcagaaattaaactcttttgtataaacaaaaacagtgtgggcctttttagcatttttctttgagattggagacttcaatatagtgattatattttcatttcaagaaattctatttcgcttttttttcatatctggtcatttaaagtaatatattcttccagactggacaacatagtgacactgtctctacaaaatatatatatatatatatatatatatatattagccaggcatggtggcatatgtctgtaatcctagctactcaggaggctgaggtaggacaatcatttgaacctgggaggttgaggctgaagtgagtggtgatcacaccactgtatgccagcttgagtgacagagtgagaccctgtctcaaaaaatagaacaaaataatttttattctgtatctgattattccattttgtaaagttcttacaggtctaaatgctgttatttgtttctgctgattatcacacatagtagattttttattcttattttttaactttttatttattttgagacagagtttcactctgtcgccaggctgtagtgcagtggcgtgatctcagctcactgcaacctccacctcctgggttcaagtgattctcctgcttcagcttcccaagtagcagggattacaggtatgtgccacaacgcctggctaatttttgtatttttagtagagatgggtttgcaccattttggccaggctggtctcgaatgcctgacctcgagggatccacccaccttggcctcccaaagtgctgggattataggcatgtgccaccatgccgggtccatagtagcttttttattcctgtgttttataatttttgattgagagctcatgtgatctctttgttatcttctaagtagatttttgacttgttcattcttttgctgaggagaaagctctctgaaggttacagtttcatacagaagtctcaattccctctctggcttgtatagccctcaggtattgtcttctgtcttgtgtaatcagtaaaatccattgattttcaactccctctttgttcttggccctcttgctttttttgtgagtttagccatttatttcaaaagaggtatttatttatctaacctttctaaatttttaaaagttttttaaaaagaatatttgtgtaccatgttcttagaaaccatttagcctttttgtatcaatatttggcatcataaaaatctatgctgtgccaggtgcagtagctcatgcctgtaattccagcatttttggaggccgaggcagatagattgcttgaatccaggagttccagaccagcctgggcaacatggcgaaaccccatctctactaaaaaatacaaaaattagctgggcatggcggcaagcacctgtaatcccagctacttgtgggattacaggtgctgaggcaggagaatggcttgagcccaggaggttgaggctgtggtgagccaagattgtgccactgcactccagcctgggtgtcagagcaagaccctgtctctcaaaaatatgtatatgatatattttcctgggtaagtaggcgatgaagcttgaaattctatcaatagcctgcagagattcagaacatatgaacaaaactaattataactccaggtcaccatgactcagtaaagtacaatagtgacattttatatgtacttacttttttttttttttttttttttttttagatagggtcttgctctgttacccaggctaaagtgcagtggtgtgacctcctgggctcaagcaagtctcccatctcagcctcctgagtggctggaacaacagccatgcaccaccacacctgactactttttttatgtgtgtgtagagacacagtctcatatgttgcccagcattgtctctcctgggctcaagccatccccctgcctcagcctcccaaactgatgggattacaggcatgagccaccacacctggcccttatatatacttactttaaaggtaactggaaatttaattgttgctttcatttcaaatgctttaccagaaatagtaccatttagatcatgaaggtatgatgtttattataatcgttcatttgtttttagtaaaagtcttcagggtgaaacttttgatagattatacctcaaagcaaaaattaatgtagatgtttctgtgtaatttaggaggaaccatttaattggaaacctctgtgatgatttgaattgttatgcagtttaattgttaaattagaatcttgaaagctatgaaagaaaaataagagaaaaagagagaaataagagtgggaaatagctagtcacaatggaaggagtgtgagacagactcaggtgtagaaattgggtctttccacttagcaccctagaggtatattagaatttcccactcaatctggctgattttacgcagtgaaactggcattactggggtttaatttgaattgactaagggtacttgtccttatttcttctgaaagataaaattggagagaggacaactggattcttgaattatttgtcatttctaatcttaccgttatttcctaaaatgacccacagatactccctaccccactttttttttcccccactactgtgctctagcccttaaaatgatctttgtttagcattcagatacctatacttaggttgagggaggagaagagggcaaagtgataatgaaaatgcctaaactcccagggaaaaatgaggggaaattttgactacagccgcttcacttctgtaatgactgatcagggatgcaaagcaagatcaaatctttttttttttttttttgagatggagtctcgctctgtcacccaggctggagtgcagtggtgcgatctcggctcacggcaagctctgcctcccaggttcatgactacaggtggctgccaccatgcctggctaattttttgtatttttagtagagacagggtttcaccatgttagccaggatggtctccatctcctgacctcgtgatctgcccgccttggcctcccaaagtgctgggattacaggtgtgagccaccgcgcctggcctaaagcaagatcaaatgtatatagatttttttttttggtttttgagacacagtcttgctctgtcacccaggctggagtgcagaggtgggattgcggctcactgcaacctccacctcctgggttctagcagttcttgtgcctcagcctcccgagtagttgggattacagatgtgcaccaccatgcctggctaagttttgtatttttagtagagacagggtttcaccatgttggccaggctgatcacaaactcctggtctcatgtgatctgcccgccttggcctcccaaaatgctgggattacaggcttgagccaccgtgcccagcccaaatctatatagattgatgggctatttgttattgttaaaatcctaggttccggccgggcatggtggctcatgcctgtaatcccagctactaaagaggctgaggcaggagaatcgcttgaacccggaaggcggaggttgcggtgagcagagatggtgccactgcattccaccctgggtggcaagagcgaaactccatctcaaaaaaaaaaaggaaaaaaaaaatcctaggttcaagtttcaatgttagatgtggaaaaaagtacggaacttggtccttataagtacttaaaattagttttctaaatgaaaaatcggaacaaatcttctatttgtatagttcattctaggtattttcctgtttgcttacttgatctttaacactcttttgttgttagacattattttccccaagccccatagagttgtatgacttcaagttaaaggggagaaaaaagtttatggctgatgcttcataacaagacagagtaacaagagaaaagcttgcaaatttatttaatattagttttacatgacatggaagccttcaaaaatgaagacacagagacccagggaaaactattttttatgcctagttttgatgaagaatggacagttatttagaagtatgattggacaaaagtagggatatgatcctatggtaataaactgagggtaactaagcaaggcctgtttgctcggattcttcttggcctttctctgtaagattcctttcctttgcatatagggcaggacacctgtcactttgaggatcttctagagagagatcagagacctttctgcttctaagcttttcacagtttctttcagcttaaaatactcagtatgccaaggtgccgtattttgaggtacagtgttctgtgccctgacaaggtcattgttgatgggacttttactagaattgatttttattaattgttaatcccattttctatttatagaatgctgattaccctatcaaattcccactaatgaagaaacacactgatcacagtgtagccaccagataaagccattcagttcgtggtcccagttaactgagaaaggataaatacctaggtcactataatactatatagagtccagagctagacctacagatatttggtcaattgattctcaaccaagatgattccacgaggaaaggatatatttctttcaagaaatagagttgggacaattagacatctgtatgtgttgaggggagcaggagaccttgaaccacatacgaacattgactcaaaatggatcataaaactataaaacctctcccagatattttctcccagtgtctggcttttcattcttttaacagtgtgctttgcagaacaaaataagaaagcagaaaatgtttgtgatttggagttaggcaaagaattcttagatataacaccaaaaacatgatccataaaagaaaagtaataaattagacttcatcaaaattaaaaacttctgctggagttcaaaatgactgctgaaagttactacaaggatagtagttacctctaaggataagattggagaatgcaattgggaaggaaggtgcaggggcttcaaagatagtagtagtataatcttttttttttttttttttttttttgaccgagtctcactctgtctcccaagctggagtgcagtggcgcgatctcggctcactgtaacctccgtctcctgggttcaagtgattctcctgtctcgccttcctgagtaactggtactataggtgcatgccagcacacccggctgattttttattttattttattttttattttttttagtagagatgggtttcaccatgttagccagaatggtctcgatctcctgacctcgtgattcacccgcctcggcctcccaaagtcctgggattacaggcgtgagccaccaggcctagcagtggtattataatcttaagataggtgaaaagatactaaagacctttttggagaatgagaataccactgtcaatcaataaatccaactatattaaatagttttgtctagagctataatatagaggatttacgaaaactttgctttgtataacaaaggcagatattttatattctggttctatttttactttttctgatattaacttcagattttttattttggctttttttttgttttgtagagacaaggtctcactgtgtttcccaggctggtctcaaactcctgggctcaagctatcctcctgccttggcctctcaaagtgttgggattacaggcttgagccaccatgcctggtcaacatcaagttttaacatgatgttaattctatgtgttttaggactttgtagaataaggaaagaggcaaatatgggagatttgaagattttcagtgagacaggcaaagtaagttaacaatctgataggaaataatgtgacagaaggagaagttttcattgattagggccaggcactttatttgacttaaaataattagagctcagatagtattaggagtagcaactcaggtaggatattaattgaaggggacagaattgatgtgggtggtgggtagggcaaggacttaaaattgaccaaaaatacgtaacaatacgtatttctggggcctgaaggacaaaccctcactggttgtatttcttggctggcaggcttataacaagaagttttcaagggagactacatgttagttttttattttgcttgaagagagagatcatttccaagttgacttttgtcttctcagtgtaacatttggcacttcttttcctaaaattatcacttgtggctgagatacaagctgttgaattcagactataagctaaattgttggctctcgattattcttgagattgaaaatctttctggcatcaacaatttagatctatcaaaatgtgttaatagcagtaaatcttcaacttagagacttagaatatactgcaatatttcaattctgatgctaaccactcaaaagttagcatagaccccacaagttagaggcacagttcccaaaaagactgccctcacttcagatgcctgttgcaagttggggttgggggtcccaggccatcttcatttctgaccaactggctataaattggagggatcccttaagcctccttcaggctctataattagaacaactcacagaactcaggaaagtactatacatttgacccttgaacaacacgggtttgaactgcacaggtccacttactagtgattttttcccaacaaaaagtaaatcagaaatatagttggctgggtgcagttgctcacgcttgtaatctcagtactttgagaggccgaggaaagaggatcgcttgaggtcaggagtttgaggccagcttgcacaacatagcgagaccctgtcaccaaaaaaaatatttaaaaattagccaggcatggtgatgctttcctgtaatcccagttactgtggaggctgatcacttgagctcaggagtttgaggcttcagtgagctatgatcatgccactgcaacctagcctgaatgacagagcaagaccctgtctctaaaaaaaaaaaaaaaacaactaaaagataaaagaaaaggaaacaaagtatttgcaggatgtgaaacccatgtatatgtgttaccagaaagggctcctgatccagaccccaaaagggttcttggatcccacgcaagaaagaattcaggatgagtccatagaataaagtgaaaacaggtttattaagaaagtaaagaaataggccaggtgcagtggctcacgcctataatcccagcactttgggaggccaaggcgtgcagatcagttgaggtcaggagttaaagaccagcctggctaacttggtgaaaccctgtctctaccaaaaatacaaaaaattagctgggtgtggtggtgcatgcctgtagtcccacctgcttgggaggctgaggcaggagaatcacttgaacctgggacatggaggttgcagtgagctgagattgtgccattgcactccagcctggatgatagagcaagactccatctcaaaaaaagagaaagtaaaggaataaaaaatggcgactacataggcagagcagaggcatgggctgcttattcttattgttacttcttgattatatgctaaacaaggagtggattattcgtgagttttccgggaaaggggtgggcaattcctggaactgagggttcctcccccttttataccatagatggtaatttcctgacgttgccatgggatttgtaagctgtagtgttgctggtgagagtgtcttttagtatgctaatacattataattagcacataataagcagtgaggatgaccagaggtcacttttatcaccatcttggacttggagggatttgtctggctttttcaccacatgctgttttgtcagcaaggtctttacgacctgtatgtcctgccaactttttatttcatctctatttcatctcgtgactaacaatgccttaacttcctaggaatgcagcctggtaggtctcagccttattttacccaggccgtattcaagatggagtcactctggttcaaatgcctctgacatatggaggggccagttctacttatgattacagtttaaactactgtgttccattcactggaagaaaactttttaaaaaagaaaaaataattataaaaataaactattataaatcaaaaataaaatcctaagcctccctcaccccatgatcgactgagcagaccctcttttggccatgggaaccccagagccacctgaaaaactaaattcccagccatgataggaaggaaggttgaacacacctcattataccccctcccttttggagtttaggcacaactgattagcattaagtttaaaatggagatcataagactgaccaaacagactctttatggcagtaagataccaaattataaataagacctaagcccatgcaaggcaagtgttaagtcacaccctcaaactgtaaaaatcttgttaaattgtttttttttttaattaacccagtataatgtggcttattttccagcctcactctagtatagtatcacatgacaggtagtagaccctgaagaaaataaaaatattttactacactatatatatttatatgtatatattcttttatgagccacctccccatgctgctgatagtgacaggaggtagacaaattcctaggcagacaggggcgggtccctggtgaaacccaaccttcaaaccaaagacaaattaaagcctgaaaaccaagctgccagttctgggtaaagtccctgaccagagtgagaacttcctcgatgccttttaaccaatcaaatggtgctgttctaggcccacccatggaccaatcagcactcactcccccattctgagcccataaaaaccctggactcagccacacattgggactacctgccttcaggtaggggttacccacttaaagtccctctctgctgagagctgttctgtcactcagtaaaactcttctccaccttgctaaccctccggttgtccacataacctgattcttcttggacacgggacaagaacctgggacgtgccgaagggtgggtatgaaaagcgctgtaacatgttcctggccagctcaccaagctgcaggcagtgacacactcttgtctgccagaccacaggagtgaagactggcaatgcttctgctcccttggggctccatgtttgctggcatctctgagttttcgggcaccaccgcattccccacatctagatgctggtgcccaaggcagaagctgcttgaggcacacctggtccagccacacccttgtacggggctcatgcctgtgccagagtctggagctgtctgccctgccacagcagccggtgtgcctggctgtgcaccatggatggaccctgtgcttacttgctcacacaccccttgccactccatgtctggcttacttgtggtgggcatgggatccaggctgatagtgctagctgagtgcagtccgccaggccgagtggggaaagcaagcccagtggtaagcccagctggcaaagtggcactgaaagaattctgtgtcactgccctgtgtggaccgccacatgggttcccacccagcagcacagacaggaaacagccccacagtatatttctttgacgtattttcagatggctgccacagtgctaacctattgaaatggccctgcaaagccatcttttgtgggggaaatttgcatttgtagagaatctctgttaatgcaactgggccttccctttctaggcctttcctgcatctaggagagattaattgagagtctgatgactttaagttctaaaaagagacatttaccatcattctctctgaggcctgctacccatgaggctttatgtatataacaagaaccttgacctccaccatcctctaatcttcacctaagcattcctttctaccaacctcgtctttagacagtagttttactctttcaactaattggcaactaaagaattcctaaaacatacccatgacttgtaagcccttacttcaagatgtcctgcctttttgggctgaaccaatgtataccttacctgtaatttctatttccctaaaatgcttaaaaccaaactgtaacctgactgccttgggcatactttctcaggatctcttgagactgtaccctgagccatggtcactcaaatcggcccagaataaacctatttatttatttatttatgagacaaaatttcacttttgttgcccaggctggagtgcagtggtgcgatctcggctcactgcaacctctgcttcctgggttcaagtgattctcctgcctcagcctccgaagtagctggcatcacaggtgccgccaccatgcttggctaatttttgtatttttagtagagtcaggatttcaccttgttggccaggctggtctttaaccctgacctcaggtgatccacccgccttggcctcctaaagtgttaggattaaaggcatgagccaccgtgctaagctagaataaacatcttcaaaatactttacagtttattttttctcttaacactatacaaaccagggccagccaaatgaggaaacaggtagggtgaagtctagaaggattccacagagcttccatgcactcttcctttggaatcagggcacatcaccctcccatcacatcaatgtgttaattaaccaggaagctccattgagactctcatgtccaaagatttttattgagatttcattacataggcatgattgattgaaggttggccacatgattgaactcagtcttcagctctcctctgtcccgaggttgggctaatattaactggctcaaagccccatccctgtaatcacatggttggtctttctggcttggcccacccctcatcctgagttatctcattagcatgagctccctgggggcccacaatgaattgcctcattagtttaaactaccagggcccaccatgaataacaaacacactcgtggtcacttgggaaattccaaggtttagatgccttctaccaggaacttgggacaaaccagtcaaattctgtattatacaacactctgaacccaggaggctaaacagtatgcagggtttctgctttctgtgtttgggatggtctctgaacagcagtgtctagtttgtcttctctatcttgtctattatcattttcacagcacaggaaaaacaaaaactaagtggtaaaatcataactaggcattaacttccactctaaccaagtctttggagcttctagcaggggaactattaatatatttgccatttctcctttccctcttagccattaaggcatagattgcaagctgatggcttacaaatttaggctgacagatgtttcatttggtgcacattttgtttgtgtggtttttttttttttttttttttttgaggcaaagtctcgctcttgttgtccaggctggagtgcaatggcgcaatctcggctcacttcaactactgcctcccgggttcaagcgattctcctgcctcagcctccctagtagctggaactacaggtgcacgccaccacacccagctaattttgtatttttagtagagacagggtttcgccatgtagaccaggctggtctcaaacccctgacctcaggtgatccacccacctcggcctcccaaagtgccaggattacaggcataagccaccatgcctggcctggtgcacatgttttttaaaaatttcaattacatgtcagtgttcaaaaaaacagaattcatattaatgtgaactttctgacttctctttaaaaaaaataaaaacatcactgggcctgtgttcctctatagcagtaattggctaaggtggaatagtggctcttcccttttaaaggcaatttagaatgtctccagtttatcacagtcgctacccccacttcctcactcccatcctgcaacttgatctttaaggaatctctgagtttaagagtaaaattttaaaagcccatctataatgtatcaccctctggctagagcctcttatttatgctgtctcaattatctctggatataatcatatgaggtaagcattgtaactcctcttttgtagttgaacagaatgaaactggattcatgagtttcccaaatgaatttcccaaggcttcataattcatgaggaactagaactcaaatcccattcatagttccgctaccctggccctagacctctggctcccaccccgttctgagagctacaactcacaattcagacactaacaacacatgttttaagtgtgtggcacaacttcttgctcagtatagcagctcaataaatgctaactgacataaaaattaagcacatttcttgacatctgatttgtatgaaccatatgttgtcacatggcaatataatggtttggaagtcttagagaaagaggttttccagcagaattgcaagaatatctcagtctgagaccactctgttgtaagttcctagacctttttctctgaattctgtagggggagaacataataaagggaatggaaaagaccttgctgttgcaatattcctttcccagtgtcttagccaccctggctgcatttgggagctttgcaaaaggactcagcttctctcattttctctgactctgcctgactgtggtacaaagtctcatcctttcatcccttaacagatcagtaatttgttgaatgcttactatgttcaaaacactgtgtagatgcaataatgaatcagattcctgttggaggaaaagagctgtgatgtacataatgttgtctttgttaggaaaggatgattgtcagacgagtggacagataaagtgctgagagggaccaagatgaggcaagaggtggtgaggttggcatctgagagggatgcataaaagaggatgtctttggcctaagccttgaagaataggtagataggagacaacagagatgggaaagaggtcaagttgaaagaacagtaaaaacagcggccgtctgcagtggcttacgcctgtaatcccaacactttaggaggccaaagcggctggatcgcttgagccctggagttcgagaccagccttggcaacatggtgaaaccccgtcgctactaaaaacacaaaaactagccgggcatggtggtgggcacctgtaatcctagctactcaggaggctgaggcatgagaatcatttgaaccccggaggcggaggttgcagtgagccgagatcacaccactgcactccagtctgggcaaaagagcaagactccatctcaaaaataaagaaagagtagtaaaaacaaaggaaaggaaggagaaagcaggggcatataccaagacaaacaagtggcttgttgagtatttattaagagtatttaggtcaggcacagtggctcctgcctgtaatcccagcactttgggaggccaaggcgggaggatcatttgagcccaagagtttgagactagcctgagcaacatggcgagaccctgtctccataaaaaataaaaaattagcctggcatcgtggctcatgcctgtggccccagctacttgggaggctgaggtggcaagatcgtttgagcctgggaggttgaggctgcagtgtgctatgattgcaccactgccctccagcctgggtgaccgagtgagaccctgtctgaaaaaaaataattattagaagagattgatgtaacttggcagagtcaaatggaaagtgttcagttacttactgtaaacagacttgctctgttaaatttggtttaagagaaggaagaaatagtatttattgttccaatttataataaaattacacatttattttgttaggtatacttgttagaattaatattataaaaggaacaaatagtgaattttaaacacagggttaaccacattagttgcctccttctattttgagaagtgactgatggaagggaaaaacacgtcatttgaaggtatttttatctctcaaattgggattttctttttctagagtctgccaaccaaacagcgttgacattgttacgcatgtcataggcaacttgtatagcctcccacacatccctattatcatactttacttcacattgtggacaggatctatttatatttctctctcttctatgggattgcaaatttcaggacagggacctaatctttgtaacaaaaagagccaaactctgtaaaatattttaagagatttataaataaataaataaatatatttattctgagccaaatgagagtggtcatggcccgtgacacagctctcagaaggtcctgagaacccaaggtggtcggggtgcagcttggttttatacattttagggagacatgaagcttcaaggaaatacatttcagaaatacattggtttggtacagaaagatgggacaacttgaagtggggtggggcttccagcttataggtagatttaaaattcttctgtttgacaattggttgagtttatataaagacctgggatcaacagaaaggaatatctgggttaagataaagaattgtgggactgggcatagtggctcaggcctataatcacagaactttgggaggccgaagcaggcggatcacgaggtcaggagatcgagactatcctgactaacacggtgaaaccctgtctgtactaaaaatacaaaaaattagctgggcgtggtggcaggcacctgtagtccctgctactcgggaggctgaggcaggagaatggcgtgaacccaggaagcggagcttgcagtgagcggagatcacaccaatgcaaaaaaaaaaaaaaaaaaaaaaaaaaaggtggagccgggcacggtagctcatgcctgtaatcccagcactttgggaggccgaggtgggtagatcatgaggtcaagagttcgagaccagcctggccagcatggtgaaactctgtctctattaaaaataaaaaaaattagccgggcatggtggcacatgcctgtaatcccagccactcgggaggctgaggcaggagaatggcgtgaacccaggaggtggagcttgcagtgagctgaaatcgcgccactgcactctagcctgggctacagagcgagactccgtctcaaaaaaaaaaaaaaaagaaaagaaaaaatggtggggccaggcacggtggctcatgcttgtaatccgagcactttgggaggccgaggtgggtggatcacaaggtcaggagtttgagaccagcgtggccagcatggtgaaactctatctctattaaaaattaaaaaataaaataaaagtagccgggcatggtggcacatgcctgtaatcccagccactcggtaggctgaggcaggagaatggcgtgaacccgggaggcggaggttgcagtgagccaagattgcgccactgcactccagcctgggcaacagagtgagactccatctcagaaaaaaaaaaaaaaaagaattgtggtgaccaaagtttttatttgcagaggaagccttcaggtggtaggctttagagagaataggttgtaaaatgtttcttttcaggcttaaagtctgtgttgatgttaatatcagagaggtataatgaggcatgtctgacccccacctcccatcatgtcctaaaccagtctttcacgttaaattttaaaagtgcccttgttacaggaaaggggtcccgaaccagaccccaagagagggttctcagatcttgtgcaagaaagaattcagggtgagtccacagcgcaaagtaaaagcaggtttattaagaaagcaaagtagtgaaagtacagctactccatagacacagtagggcgttcctgaaagagaaggaaagcatccaccctgggtacagtgcttgtttatatacaggataaaaagatcatggggggatgtgctctgctacaagcattcgttcttaattactgtattttgcaagaatcaatattattatctttaaagcaaaattaggaatgcctttgctctccatatattgggatattaggacagtcccaagtctgggtctgtttagtaaatattatcaatctgttcccttcaccggaaacatctagaggctagatgctgggaaggcagcccagcaagtcccagcctcattttccttgccctcactcaagatggagttgctctggtttgaacacctctgacaccctggctgagaaggaagtccattcagatggttggagaggtgttagaagtttattttgggtttacattttttgtgtttttttgggtagcatagttaatggacatagtacgtacttagaaacaaaccatttttccttcagactttattcctggagacatcactttaaacaacatctttccaagctcaaggcaaaattctctctgctggtgtctgtcagatgtcaacagaaaaaaaatggattgaactggaaattcactaagaattggtataataaggcttttatgtagcatttaaataaatagggagaggtggactgtgaagcactggaaagtattatctctgaatataatctttccaaaaggtctggatataatctttccaaaagttagcacccaaagaattatacttcctggaaaatgtaaatagttttgcacctcagatttcctcctgtagtaatgactggcattctgtgtgacttgctcttgtacctacctatggtaagaatcatataaacaatatgcttccgaagaatgtccacaaagaaaaccagaatgaagatgaagacttgggccaggagtagtggctcatgcctgtaatcccagtactttgggaggctaaggcaggagaatgatttgagcccaagaggttgagaccagcttggacaacatagggagaccctgtctctacaaaaataaaaaataaaaaaagagatgaatactggcaatgtgcctgccttattcactgccctgttcctagtacccagtagagttggctgaaaataagtatactttgagtaagtggataacattatctgttctgtatacttggtgtttgttcgttggtgcctgagatgtacatttgggccatgttgtggtcaggggagaaatcactgggggagttgttgaatgtaattgacttccagcagagaaacaggagttcatagtcccaattctctttaaacagtcactaaatgggataaagaactctcaagtaaattttatttgtcaagctccttttcaaaaattacaaaagactgctactgataaaactactgaaaaatacaaaaatatacaaaacttaaataagagatccccatttctaccaatattagtattctttgacatcatttctcctgcaaatacaaacataatcatacttatggagttctggatgatagttggaatttttttttttttttttaccaaaattggctatattatatatattactcaggcaagttgctttactgaatagatcatggccaactctctggctcaacagatacaaatataacattgtttcttttttaatagctgcataatacttattccatattctggggaaggttctgttaatgacatttaagatgtttctactttgttgtttttattggtgtttttgctactacaaaccagaaaaaaaaaattctatatgtatatatacccttagatactggtgcttttgttttttgattttaggattaggatttctgttgcaaaaggtatacatgcattaattttaatagctactgctggatcacttttcagaaggttgtaatagttcacacttctgccagcaacatatcagatttttcctttgtctacatctctaccatccctgaatgttaccctctagtttttctcaatctagattttttttttttttttgagacagagtctcactgtgttgcccaggctggagtgcaatggcgtgatctcggctcactgcaacctccgcctcccgggttcaagcaattctcctgcctcagcctcccaaatagctaggattacaggaatgtgccaccacacccggctaattttgtatttttagtagagacggggtttctccatgttgtcaggttggtcttgaactcccgacctcaggtgatctgcctgcctcagcctcccaaagtgctgggattacaggtgtgagccaccgtgcctggcccaatctagattttttttttaaatgatatcccttgttgctttactctacatttccttgtccaccagtgaggttgagtctgttgtcatgtctactagctatctagatttcctcttagtaattgcctgtgcacatcctgtacctcctttttctctcggatgatttatgatttccttatcgatttataaaagctttttgaattacaggaatttaaaatctattatgtattgtagttgattgctttttttactttgttaatgatttttttcttcagaaaaaatttcaatttgtatatattcaaatatgtcaatcttatgcttttatttgaggtttcctgctttttttagatctctaaaaccattctgttttgggtttttatgtttgttttggcattaacattaaatttgtaacctactaggaatttgtacagagtgtaagtcgggaatctaatttcccttttttggtagttagaaaatgtcattgaaatatatatactacatttatcgttggaccacagaattaaccttgtatccattagtttgacatttatcactggatggagggttaggaattagatataggacctctctcacctgaaaagtgaccaaattacaaaagcttgtatacatttctgatttgtgatgctgaattttttatgtctctgtgatgctgaacaacagaacatagactttttccagttctaaatgcatacatactttgctgatacctgaaccagaatctcgtaaatgttctcatactgcattatttctgtatccttttaatctctgttaatttgaagcagggagaccttagaacactcaagtggtaatcctggcactagcaggaagtaggagctgctggaggacctggagccaggttgtcccccacacctctgtctttcccttagatgacgcaccccatggtctgtgggcagtgactagctctcccagcgacgttggaagctttcatttcttcactttctattcctgtccagctttgtaaccaaaacagttttaaaattttaggctgtcttggccgggtgcggtggctcacacctgtaatcccagcactttgggaggccgaggcaggcggatcacaaggtcaggagttcaagaccagcctgaccaacatggtgaaacatcgtctctactaaaaatacaaaaattagctgagcgtggtggcacgtgcctgtagtcccagctactcaggaggctgaggcagaagaatttttttgttttgattttgaacatagattggttggttttaagctttagctttttaaataggtaacatatatgcacatgtaaaaaaatcaacaattagaaaaccatatacagtaaaaaaacaagtttccttcccttccttgatatcagctatccaattcccctttttagcatctctcatttttaggagacatctttgttaaatttggccaggcacagtggctcacacctgttattccagcactttgagaggctgaggcaggaaaatggcttgagcccaggagtttgagaccagcctgggcaacatactgagaccccatctctacaaaaaatttaaaaattagctaggtgtgctggcacatgccagtagtcccatctactcgacataatgcctaacgtgggaggtttgcttgagcctaggaggttgagtttgcagtgagccatgattgtgccactgtgctgcagcctgggtgacagaataagaccctgtctcaattgagaaaaaaaaaaaagtcctggataataaatatttcaggctttgtgtgccacattgcctctgccacagctatgcaactttgccattgtagcctgaaagcagccacagattacgtgaaaatgaatgagcctctctatattctgataaagctttaatgaagaagaagataggagcaagccagacttgcccatgggctgaagtttgccacgcacttctgatctagaatagtcctgctcatttacagtagtcttttctctctgtctctctctttctctctctctgtctctctcgaagtgtctaagtcagtgttcttatagaatgccttacttcctacttattcattttgtcattcaactttttttgttcctctgtttcctgtaagatgaaaggtaagtctagagatctcattagattcacattaaacatttttggcaagaattgtttgtaggtgaattttttaacaagttttgcccaaggggcagaaggagagatttttagaggatagagatttatggatgatactcaagtgtatagtataagggatccaacatctgagaaaggtgtgaccaaaacaaagggagtgacagaaaatattcttagttcctagagactagaagaattttagttttcatggagcagtgcctgtctgttgaccactcatcaatgaacacattgcactcagagtactcagtctgattggctactgaaattctggcttctaaaaaatttaactaaacatctttctgttttctcctaaataaagcaattcttaaaactctggttcctgggttgtttttgtattgttttgtttttcttcatagggtcagctctaaacacaacttccattgataagtcaggggagcacatggcttacacaatgacttctcaattcattattaaatacagttgacctttgagcaacaaaggggttaagggacaccaactcccccacgcccagcatagtcaaaaatctacatataattttgacttctcaaaaacttaactactaatagccagaagtagttaagttctaaccagaagccttacataacagttgattaacacatatcttttatgtattatgtattatatactatattataataaagtgagttaaagaaaatgttattaagaagatcataaggaagataaaatatatttactattcattaactagaagtagatcctcataaagctcttcatccttatcctttacactgaggaggaagaagcgttgatcttgctgttgtaggggtggcagagggggaagaaaatttgcgtgtaaatggacccatgcagttcacactcatattgttcaagggtcaactgtattctgttttatgatttctgaaaaaggctcatttggtctttttttgtaatgaggtaaaaatatgtcaccatcagttgctttctgaatggttttttgttctctacatggggactattatttttataacatgtctagtcttagtagtattcttttaaatgctctacataggctccatcactgttataactggcctacatctagattaaacaagctgagacttacatttaaagggttgtttttttggtatccttttccaagcacagactttagggaaacctaagtaggaaaaatgacatcagaataattccactagtcacctgccagaacacaaaagaaaaaggaataagtctactggtcattggtaattagggcctttcatctgtgcagttaaaagagctataaaaacattatctcataattctcacatggccctctgaagtgagcaggcaaataactataaccctaattatagaagtagtttgtggtctttaaagaggttagaatctctttcacatagagttaaaatcaaaggtggggacgaattttaaaaactgtttctgaatctttctaactctcttaagtccacagttgctgttttagaactataaggattgttacagtttgaattttttttttttttgagacggagccttgctctgtcacccaggctggagtgcagtggcgcgatctctgctcactgtaagctccacctcctgggttcacaccattcctctgcctcagcctccccagcagctggaactacaggcgcccaccgccacacccggctaattttttgtatttttagtagagacggggtttcaccatattagccagaatggtctcaatctcctgacctcgtgatccacttgcctcggcctctgaaagtgctaggattacaggcgtgagccaccatgcctggcttatagtttgaaactttttctagacgaaagataaaaacatggctgggcatggtggctcatgcctataatgccaaaactttgggaggccaaggtgagaggatcatttgagcctaggagtttgagaccagcctgggcaatagagtgagaccccatgtctctataaaaaatttttaagaaaatgaggctgggcgtggtggctcacgcctgtaatcccagcactttgggaggccgaggcgggcagatcacgaggtcaggagatcgagaccatcctggctaacatggtgaaaccccgtctctactaaaaaaatacaaaaaattagcggggcatggtggcgggcgcctgtcccagctactcaggacgctgaggcaggagaatggcgtgaacccgggaggcggagcttgcagtgagcccagatcgtgccactgcactccagcctgggcgacagagcaagactctgtctcaaaacaaaacaaaacaaaaacaaaaaaatttttaagaaaatgagccaggcgtggtggcacacacctagtcgcatctactggggagggaaaaggtgtgtgggggttgaggtgggaggagcgcttgagcccaggaggtggaggctgcagtgagccatgatcacactgctgcactccagcctgggatacagagcaagattctgtctcagaaaacaaaaaagataaaaacatgaaattaaaatttctcttctgtggccgggcgcggtggctcaagcctgtaaacccagcactttgggaggccgaggcgggcggatcacgaggtcaggagatggagacaatcctggctaacacggtgaaaccctgtctctactaaaaatacaaaaaaaattagccaggcctggcggcgtgcgcctgtagtcccagctgctgggaaggctgaggcaggagaatcgcgtgaacccgggaggcggagcttgcagtgagcagagatcgcgccactgcactccagcctgtatgactgagcaagactccgtctcaaaaaaaaaaaaaaaaattgtcttctgtttctgttagtgcctttcatgttcgactaagcatttctggtaggtgcttaataaatacttaatgataatggcccctctcatcaaaaatatttaagactttacaaaaaacaatggacacactaccatttattatttataacctaaatgtcctcaatgtgaatagtgctttgttcttaaatgttccccagaactagacagtgaacctaggatccagaacttattttgggtgcagtttacttatactgttaactctttaataaagacaatttctatatgcaaaacagcaatataatattggaagaatttcttttttgtttttgtttttttttttaatttgagatggagtctccctctgttgcccaggctggagtgcggtagtgcgatctcagctcactgcagcctctgcctctcaagtagctgggattacaagcatgtgccaccatgcctggctaatttttgtatttttagtagagacagggtttcaccatgtaggccaggctggtctcaaactcctgacctcaaatgacctgcctgccttcgcctcccaaagtgctgaattacaggtgtgagtcactgcacctggctgatattggaagaatttctgaataatgttctccaaacagcaaaatgtgtttttaaagcttcaacaaaattattgaatgataatagatttcagtttttctgaaattcttcataatttttgttcatataccctaaagtcttaatgatttggaggtagagtccgtgagggtcacatggctgcttcaggatttatcaaagaaagacctgaatgcaactggagggtagataacaaatcctcatattagaaaactctacttggcatacttttagaaaaacaggacacaatgttattttcaaacagtcttctgagataaaggtattttcctcattaaaaaccttgataagtgggggcatggtggctcatgcctataatcccagcactttgggaggctaaggcaggtggatcacctgaggtcaggagtttgagaccagcctggccaacatgacgaaaccccgtctctactaaaagtacaaaaattagtcaggcatgggtggcaggagcctgtaatcccagctacctgggaggctgagtcaaaagaattgcttgaaccagggagacggaaattggattgagctgagatcatgccattgcactccagcctgggcaacaagagtgaaactccctctcaaacaacaacaaaaaccttgataaatttcataaaaatgccttctgatgcatccaccatgtgttagtccatatgttagtagggagataatatccatgttttctaataagaaattggagacgctttgccttaccctcaaaattcattaaaatgtagtctatactcactgtctctactttttcacttccatttactcctgagtctcaggggtaaccatcttcttcctcacactgtttttcttgaactgttctggcaaaagtcatgaataacattttaactaccagagtccgcatcctcttttatttctcatccaattcacttacatttgaaactttgacctctccttcctactttgactttgatactactctctcctgtttcctcttcctttctttttttctgtctccttcattgatgtcttcctcagtacttcattacttgtcttataaatatacttccagccttagctttcttcttttttctctggactttcacttgaaaatcgtatccatcctccatcccccactatctttgctttcagttccttgtgagctgcttccagattcatgtctttagctctccctttttctcaaaaactcagatctacatgttttaactgcatcgtaagcactgatgaataaatgtactgtgggcactttcagctcaatatgacatttttacttcaaatatgtttttccccatttcttgtttcagttaatggcattgcgatcaaacttataatccaggctggaaatataaatggtcttcattacttctctctcccttatctacagtccatttgattacctagtcctatatgtctacagtattttgtgtacctacccatttactcccatggctactaccctagatcaagtcctcttttcctggtttctaatcatttacctctagtccttcacattgctttctgaaatatatacctgaccatttgacaactctttaatgatgtccacgaaaagagccaaactctgtaaaatatttgaagagatttattctgagctaaatatgagtgatcatggcccctgacacagccttcaggaggtcctgagaacatgtgcccaaggtcgtgggggtacagcttggatttatgtattttagggaggcatgagacttaatcaaatacatttaagaaatacattggtctggttcagaaaggcgggacaactcaaagagggggagaagggggttgcaggctataggtaaatctaaacattttctggttgacaattggttaagtttatctaaggatctaggatccctaataaggaaatgttcaggttaagataaaagattgtggagaccaaggttcctttgaagtcttatagtggctgctcttagagacaatagatgacaaatgtttccaaaaggtactagacttttagctaatctcttcaggattgggagggcttggaagaaaaagatctagctatgttaatagagattctttacagatgcagattttcccctacaaggatgactttgcagggccattttctctttcttttctttctttcttttttttttttttttctttttttcagtcgagtctcactctgttgcccaggctggagtgcagtggcgtgatcttggctcgttgcaacctaagccccccgggttcaagtgattctcctgcctcagcctcccgagtagctgggattacaagcgcgctaccacatccggctaatttttgtatttttagtaaagatgggatcttgccatgttggccaggctggtctcgaacttctgaccttaagtgatcacctgcctcggcctctcaaagtgctgggattacaggcatgagccactgcacctggcctgcagggctgttttcaagatatggcagggaaacatgtcttggggttaaatattttttaggtttttccttgtctcataatgttatgccagagtcagattggaatttaagtcacaatatatagggttaaataaaacccatctgatgagaattcatggtttgtagggcgtgactcccaagactcctttgaaaggaatttgggcaagataaaaaaatgagagctttgtcctcggtctcccctcttggccaaaaagcattcctcagaatgcatatgcaggccaactaacagcagcaggtcccacagcgctaagaaggctcattcctagagttgtctgatttggtcatttggcaaggtcccacagcactaggaaggctcattcctagagtagtctggttggtagcagtagttttaaatacctgtgatttggatcactgggagaggacacagtctaacctgatgtaatagccaatagtttaaggggtgagatggagtcaggcctagggtttagtctaaaaaaaaaatcccaggtcatatttattttgtgagctaccatgatccagttctttaattgtgccttttccttttgctatatctggcataacatttacaagagatatataatcctaatacagtgacaaacaccataaagatagcaaagattaggcatccaaggttataggtagagtcagagggcagtaaacaacctgaccagccaaaaaaaccactgcatgctttatcatattctttgattagactcacaatgtgattagcctccttatcaagggtcatttgaaccctatgatagatcttatttgaggattgtaggactgacactaaatcagaatccaatacatttaatgtctcttctggccaatttgtctccatagatataacatcctgaggagggtataaatcaaatgcaaggaacgcctggtcctcaatgtctaaattgtcacaggacttgttaacagtggacaaatctatttttccaaccacttttgtattgcaccatatactggtatttggaagagaaaaggaagttttgttacaggagaagtcatataattctacaatgttgtttttttgtccctcccaacagaagcggcccttccccgtataccagatgttatgtcccgttggatattagaggccaagtttgagaagaatcagggttccaggtagtttgagggcatagccattctccttttctgttttcacaatctgaaagggagatgggatgccatgtgttattatcggctaaaatagcccacctatttcccagggggagtattcttgtattgtttataatagtcccaatgcctgccagttggacaacggagtacctttgagcctcatttaacttcggtgcctgtgctctgagaatacaatgtttaaggtcacatttaccgtccaaaaatctccataagcgtggtggaccatatgttttccacaggtgtttggattgtgcctcagaactgaggattgtaggccattgcttcatagccacctcagattccatttgtagtacaatagacatgagcccgtgttgggtaagagtacatgtttgttcccatctttgggtttggaagtatgttttcatggtttgtctggtttcttctatccatttgatgagtgctgtattatcttttaaagcagcttcccatccttttccctcttcctggaatagcattccttcaatgtggcctatttttgatagggaatttttttctaaagaatgtctctcctcattagtcatgaactcggcttgccccaatatgcctaacccagctccaactcctccagtgaggtcacactttagttttttgggtggccaattttggtgtatccaccaggaatgctgttgccattgtatactgatggcatttgtacaatttggataaatggagtcaatccagaactgctgggtatcccagacaattgttaggtgagtggagggtacatctaagtatgcccatgtctgggtattccataatgcttcccagaggcgccctggtcttagggtggaatttgtgctgtcagggacctctgtccaccacttgaccataaatagttctttaagggcagtgtcagtgtggttggtgctggataggaggatccagccacaagcacggggctggtggttatttgggcaggccatgctatggcagtttatacaggaggcagctagatttttcccattgtaaccaggcagttgtctcaactgataatccccaatatctattgttatgcagtgttctacctggttagaccccctcagtgatcatttgggaggcattgttaggcaagtattcctgcagggcatcatatttggttgcagccctataatagaggtaccctaaaaactggacacctcggggaatgtttagaatggtgctgttccatataacactcttcattacatcctgatctgtatcataccaaatgatatgggctttgcctgcaggaagattgctgaggtttgcaggggaccaggagaaattttgaggtctgaagagagaaggagtgtggggtaggcagacagaagagattgtggaaatgagaatgaacaagtaaaacagtttcctggctttagcaagggaatgtatagctgcacccatttagaaagttataccaaggaagagagtgcatcgatcccaaacagcttcttaggggtctcagttaaaacattcagggttttagcaatattctatagcaaggaaagtaagaatgggagttatttgagggttcatgaggactgggcctggtccagcgtctctggaagtatgtctgctttcattgtagctctagagactggctgagcctccagtgttctcttgatttgcaggcaggtgtcagagactggttcagaagtccaggggcggtcaggaaagtggtcaagtgcttgttttaggagtgaaatgtgaatccaagaagtgactccctttaactttgcagtacgagagttgattgaaagcccctgataaggtcctttccagtggggttgtagggaatccttcagttgaagtcttttccaatatacaaagtcacctggctgtaatccgtggtctttggggtcgtcagcccccgggagctcactatggaaagattgtgttaacagctttgttttatttgttaaggttttgaggagcccttgacaataatgcagtatttcccctttgagtaaggccagtttgtataagcccttagccaacctcataggtctccctgttacgatttcacagggcgataaataatgtttttgaaaaggagcggatctaagactaagcaagaccagtgggaggggttttggccaagggaggttaaaagcctctgtcaacttagctaattgagtttttattgtgctatttgtccgttccaccaacccagaggattggggatggtaggcacaatggaaatgttgtattataggccagattttgcaaatggattgaacaacttgtccagtaaaatgagtcccatggtcactgtgcatttcagaaggaattccccaaactggaatgattctaacaaaattttcccaactgttaaggtggtagccctccaacaaggaaatctttctactcaatgagaaaacatacaaactaagaccagcatgtatttgaaattttgtgatggcggcatctggataaactccaactgccatactttaaaaggtcctattggcaaaggaaaatgaccttgggagccatgtaagggcttgctagggttaggttttgggcatatagtacatcaagcgtataccttttgggctaccatgggggatggtttccaaaagtattgttttcccatgatactattttttcaggggcccaatgagtcattttgtgaataaactgaaggaaaggcaattgtgcacctatgggaactatgggttttttgttagaccctatccataattacttacttgggtcaaacataactcccttctgtttctcttgaggggtagatgcttactgatattgtaaaaaaatgttagtgagggtatttgtaggacgaaaggtacattgccgtacaggacaggccatctttcctagggcagcattctttgctgcagcatcagctagattatttcattttgcttctcgagtgttatcctttgagtgcccagaaacttttatgattgcaagttgatttggcatctgaattgcttctagtaactccgagacttggtgcccatttcatatgggttattcagatgaggtaagaaatcctctctgtttccatagcatgccaaaatcatgggctactccaaaagcatattggctctcagtaaatatatttgccacttttcctttagctaatttacaagctctagttaatgctattaattcagccatctgggctggtttgattccttggagttggacacttttgattatgtctgttatggaagtgatggtgtatcctgcccagtaatgcccctggttgtcccttaaataagaaccatccgtgaaccaaattaactcagcattctctatgggagtttcctgtaatttttccctaggggagagtaagatattagttagtagattgcagtcatattcgtcttcctcttgttgttcacctggaagggggagccgggtagcagggtcaagagtgttacagtgctttaaaatgatgttgggggcagaaagcaggagtacctcataagaggcaaagcagctaacagaatagtgttgagtgtagtgagagcttagaagagatttcacagagttgggggcatagacggtcagaggggaccctaggacaaattctttgatgtttttgcataaggtggctgcagccagtatagccctcagtcaaggagggtgccccccttgcaactggatctaaccgttgactgaaataaccagttggtctgtgattgtcaccatattttgttgtcgttgttgttttacaaaaggaaatttatttcaaaagcatgaggggacatttacatttaaacaaggtgataaacaggtgtgttgcaaaagaaaaaaaatccacagcattaggttttttattcaaattcggaagcaaaaataacctaaattgtgcactattaccttaggaaagggaaggggaagagtgaggggtaagggaacagtcaatcaactgagtatcaaacttgagagaataaagtcacttctgctcagctttgagtttacaaatatgcttataaaaaggaaaagtggaaaaatgatacttaatgttcaaatttatttggctgtagtctcaatacaatttctgtacttgaaatggctttgggccactggctgatctatctctgaggtccagattagctggtcagttttcaaatggcaattttatatttcttttctgttcagattccaagggagtttaggttcagctcatagtcttttggattgtttagagattattgccaccactccatagtcaagctgaccaacttcttttgctcacttgtatcattctagcctttcggaactaatttccccatacacatgtgcaataattctcacaaaggagttttgcttcttctgcagtgtagaggaaatggtaatgaagacacctgcattggaatcacaaacttttcctcaaaaaatacatcaaactactagaaatgtctttcaggcatttgatttgaatagcaaacttgggagggaagattaactgtgaaacaaaaatatgcgaaacattcaaatgcagaacaaagggtctatgctactaaaaatgcccatgacattaaacactccacaaacctcccatctgttgttttaacctaaaaattctattggctaacttatacaataattttgattaataacctgagaagtcaaaatcttgaaagtagcaaatgcaaaccgagagagcatcccgtacttattggtaccatgttatcaagtcactttttctgggtagccctggttattaaatctccaaattctaaattacactatccctgcctgtagcaacctatatgtacatcagattcagtattttggctgtatgtcatcaatagcaatctccaatttatctttgaaaatgcagcctttatttttagttttaaatgacaataatcgtataagtgcaactgactcagaatcccttgctactgttagtgaaaacctaaataacaagataataatggattcagcctcaaaaggataatcaccagatcagactacccattcctggaattaaaaaaaatggtttatgttgtgtagtcaagtttcacagcatgcatatatatatatatgcatatcagggttatatatacacacaggtatatataaccctgtgtgtatatatacacatacacacaggtatatataatcctgtgtgtatatatacatatatatatatatgtatacatatatgtgtgtgtatataaaaatctgggttatatatacacacacatgctcgtgtatgtatgtatattatacatgcacatttctattcaaatagtaagattccatattcaaaagtttgtatcacaatatatggaaaagagttaagtaagtagtgcaaagcaactaactttctcctaaaaatgtaatgtcattcctacattttaagaaagctatgtaagtattttgcttttatgacattaggtaggaatgctgcaccgctgcctagcagctttattaaaaaacaatgaaaacaaaatgttaagattgactgttactcttctccatatattgggcaaaaaactaagagggaagagaaaaatcagtaacctttcaaaactgatgatctttatcagcagaactagactgaatttcactacattttagaatgaacagctttcaccaacaagtcaccatgtttttgagttaatattcctagagcattctcatttatttcatgtacaaagagggtaaaaggaagactatgattgggatggcctagaacaggtgcttgggtgagagcctgttttagatcttctgtgtgttgtttttttcccccctcttcccagtggattgggtccagctgggtctgttttagatttttatataggggttgggcattaaggagtagtttggaatccaactcctgcctgtcaactctaagaatcctattaattgttttttagttttgggcaggggaaaggtcgtaatagcagagattctctcagagtttattaatagcccccttggggaaatcatatgtcccaaatacttaacttggggaggcaaaattgtaatttatcttttgacactttgtgtcccctaaaacgaagccattgtaataggtggacagtgtcttctctgcattttggtagggaggataagcacaacaataaatcacatactgaattagagtagattcatttggaaattcaatgtcatctaaatctggctttagtatttgagaaaaataagtaggactttctgagtagccctggggtaagactgtccacatgtattggtgatttgcccaagtgaaagcaaaaagatactggctattttgctccacaggtatactgaagaatgcactacataaatcagtaacagagaagtggctggcagtgataggaatattggacagtaaggtgtgggggttaggaacaacagggtgtctaggaattattattttatttatagctcttaggtcttgaacaagtctccagcttgtcccatttggctttttaactgggataattggtgtattccaagggctggtgcagggtattataagtcctttgtctaaatcgtcctgaatgactgatttgattcctagtaaggcttcaggtcttcggggctattgccttacgtttggcaggggtttggatttacttagggttggctctatagggactgctgactgaattctaccagtatctgtggaagagtttgcccatagggagtctggtaccttaggtaagaaaggctctaattcttcctgtccagaatcttgattaactttcacaagcataatgtacatgtgggcttttgtaagtctgcatctcccaagttgagaatcatttctcccttctgtgaaaatgagatgtgagcattatgggtctctaggaaatcctgttgtagtaggtgtatgggggtactatctactataagaaaaaggtgatgcctcactagtcctcctaattaaaattgaaagggatttgatttaaaggctataataagagagtttgaaacccctaccatttggactttttctttactccaagggagagggtttttaatctaggtagggatgaggaccgacagtatagcgctggtgtcgacaaaggctctggtattttccccatttatggctatttctacttctcctaaagcattagttagaagtaggggggaaaccctctctgttccctcagagcatccctattctggtttttgagttgttctggtgccttcctctggggccctttgccccctttgtgcaagcacccgtttaagttttttgcattctttttttaaaatattctttctttttgcaatagtggcaaattgcttcctcttggggtcgcttagatctctggggaccatgggacccttgcaaactcccaacttggtttctaagttgttttagttgtaaactcataattttagagactgtttcctttcctttctttcttttttttttttttttttgagacagagtctcttgcctaggctggagtgcaatggcgcgatcttggctcactgcaacttctgccttctgggttcaagcaagattctcctgcctcagcctcccgagtagctgggattacaggcatgcgccaccacacccagctaattttttatttttagtagagacagggtttcaccatattggcctcccaaaatgctgggattacaggtgtgagccaccgtgcctggcctccttttctttcttaatgattgtgacagctaggtcagctagggttgatgtcagctagggttgactaagtgactggtgggcaaggaagcccaagccacattattcctctttattagggttgctaactccttatctaaaccttgcataaacccagaatttagtaagatgtcacttactttccccaagggtattcctgaaaactgtttgaatgtcttttcaaacctgatataaaagtcaggcacaattttgtttgggcgtattttacattgtttcacctttgcccaatctgtaaccgtggagaatatctgtggtacagtttcacagaggcgattgcagagctctccatttctgtcttccagctgcatctattttgtcaaaatcttctaaaggctgtttccaatctgctactctaaatcattcttcagctttgttctggggaccagtaactcaatcagctgacacatgtcagagaaccctggatcataagtcttaagtgttaattggaattccttagcaaacttaaagggatcttcagtcggactggggaatccaggtaccagggcctttaactctgatttggtccaggggctatacattatgttaggatcccctctgcctgtaggttttaccctaaaaggagcaactactctattattttatccagctatttctggtccccctgtggcttgaggcaagggagtaggggagggagaaggaaaaatgaaattgtctggacaaggaagttcagagagagcagagggtcaggaggagcagaaggggagacagtttctggagccttcctgattttagaagtggcgagacagtttcaaaattttttttaacttcctaaagagaggcaagcttatcgtttcctctttttgatgattctagatgccacctaagtacgattcccattcattttctttgattcgggagcctcagttttctaatctagcacacaagaaaaccaatttagggacatcaaaagttccccattttggaaaccttagacctaggtcatctttagtaagatcttcctatttacataaatactcgcaagtcaaggcaccataattattaaacataaacccagctgtggtgcccactggggaccgctctccttgcctttcctctcttttggagggtttatttgctatctctctcttttttttttttttaagagcaattgacctgtggcctaaggcttttgtgtggtggatcaatatgtgctgcttgtgggcagcactttacagtgtttcaacactgagtcgtttctaccctcttacgtgtctcagtttctctcttcagaggtctgtcacctctgagagggctcaaaacaccaggcgaccagcccttatatgcgtttcctggacaagccttcttaatatttgttggggagtttcctgtagggccgctgcatgttgcggagagtcaacctcccagacactcccacgaggcccctggtcacccaggggcgccttccagctgggaggagcaaaatgccctttctcttcaaagctgaggaactcactctctcatttgcttatgaaaaataatagttcagttcctcacgcaaagtgcacacagacaagccaattgagattaattttgagagaaaaggcaatggagaatgactgttttgaatacacctctgaaaccaaaattaagattttaaccaacttcctaggagaaaagagagagagagaaaaaaaaaacagctcagaataaatcaaggaccatcaaccaaaatgggaggtccaggactcaggaggacttaccagtttcaccagaggagaagctagaacttggtgaggtttcactgggcccctgctagtaccttagctagggttttaggcaactccttcagggtcctgagtcttctctgtggccccacgtgtttgggcaccagattattgttgaagagtcaaacactgtaaaatatttgaagagatttattctgagccaaatatgagtgaccgtggcccgtggcacagccctcgggaggtcctgagaacatgtgcccaaggtgatcagggcacagcttggttttatacattttagggaggtatgagacttcgatcaaatacatttaagaaatacattggtttggttcagaaaggcaggacaactcaaaggcaggaggcggggaaggggacagtaggggcagggaggtacttccaggctataggtaaatttaaacattttctggtgacaattggttgagtttatctaaggacctaggatccacagaaaggaaatgtccaggttaaggtaaaagattgtggagaccaaggttcttttgaagtcttatagtagctgccctcagagacaatagatgaaaaatatttcctattcggatctttaaaaggtactagactttagctaatctcttcaggattgggaggacctggaagaaaaagatctagctatgttaatagagattctttacagatgcaggttttcaccctacaaaggatggctttgcagggacattttcaagatatggcagagaaacatgttttgggattaaatattttgatttttttgcctgtcttataatgttatgccagagtctgattggaaagtaagtcatgacatatagggttaaataaaacccatctgatgagaatttatggtttgtaggacatgactccccagatctcttagataggaatttgggcaagatttaaaaaaaaaaaaaatgagagcttagtcctcaatggcttttctgggcttttattcacaacacctctgacaccaaaagtataggttttttctcccctgcatgccaaccaattctctgattctctgaataccaactggatgttctacaattaaattctgatactacccagagttagtggagaccccacaggtcttaaccccattttggatgccagtcaaaagtattgagtccctgccaggcatggtggctcacacctgtaatcctagcactttggaaggccgagatgggaggatcacttcagcccaaaagtcaagaccagcctgggcaacatagcaagaccccatctctacaaaaaatttaaaaaattagctgggcatagtggcagacacctgtagttctagctattcaggaggctgagacaggagaatcacttgagctcagaatgtctaggctgcagtgatccctgattgcaccactgcactccaccctgggtgacagaacaagaccctgtctctctctctctctatatatatatatatggtccccaggttacccacacttatatctagctacaaattgggtagtctcatgatccctaccccccagttcaataatatgctagaatggctcatgaagtaaagttctttacttaccaaggtatggaggaggaactccaaaagcttccatgccctctccaggtacaccaccctttcagcacctcagtgtgctcgtcaccttggtagctctctaaacactgttgtttggggtttttatggtgtctgtctcatgtaggcaccattgattaaatcattggccattggtgattaacttaatctccatctcctctcctctccctgaaggtcagcctatagtactgaaatttctaacactcaaatcatgctttggtctttctgactaccagccccatcttgaagctatctaggggcccccagccaccactcatctcattagcgtacaaaagacactcttatcatgagattccaaggattttaggagctgtgtgtgagaaaccataaacaaagaccatacatatttcctattgtatcacagcttcccatcacctgaagtatgaagtcctaatgccttatgacatctcacgttgactataaatcacctggactcctcttccatgagactagacttaaatttatataaacaccctctgtactatttttgtacttttgatattccctctgcttcaaaatattcctatatttcttatgaaaatcctagtacagatgccatttccttcatgaaactcttaattcctcctgtcagacttaatacgcactcaaatacctgaactaaacattttctcttttttctgtgtcacttggactgtctgaattaaaccttttctattatatctttgaccttttacttcaaattgtagttcattgtgtattgctgggtctcagaaaacaataccccaaaatgaaagcttcaaaagcagaagtttttctgaccttctgccccctgctctcctgtctctcagtctcattctcccctaaggctaaccatagcaactagaatccctcttccccaaggcaggtcatagaaaccagaactccttgtccccaaagccaggcataaaacctaagagtattactctaacattccctctgcctttgtgtgtaaaaactggccataaagaaattatctgacctcccttatttgactgtaggccataacaccctggttccacagagggtcctgtcccacacccagaaggaaggaatgcatgctcagagaggccaagaagagtttagacagacaggccttgctgggtttctccacttagtctattagctttagattctttggtgttagaccctttttatccaatcatatttctttttctttcttttttttttttttttgagacggaggctcgctctgttgcccaggctggagtgcagtggcgcgatctccgctcactgcaagctgcgcctcctgggttcaggccattctcctgcctcagcctccagagaagctgggactacaggtgcctgcaaccacgcctggctaattttttgtatttttagtagagacggagtttcaccatgttagccagaacgatctcgatctcctgacctcgtgatccgcctgccggcctcccaaagtgctgggattacaggcatgagccactgcgcccggcctccaatcgtatttctatacctcttccatagtttgttgaacctacacacaaaaatggaaaatttcccctgtatctttggttctccattgtaaaggcttctgtgaatacaggttaaatagatttgtctgccttttcttctattaatctgccccatgtcagtgatttttttcagtgaactttcagagggcccttggcccctacagtatgtggcccctacagtatgtacatctcttccacactatcatgagtttattttaggtgtagaccgtatatagaacacaggcacaattttataacttagcatgtagtcatctttgctttcaacttttagttaaattttataattcactgggcagaccaattgagcattttcaaaaattgctcagttcatctttatactacccctaaaaaatgactagaataattttgcttcacagatcataaaagcacaggaaaaagttgcttctttatacatgtttcctgaaatcagcaatgtaaacagaaatggaaccttatatcatctatagtaaattattctcaataattagaactgtaatgtgtgccgtcagtatttttttttttccaagacagggtctggctctctcacccacgctggagtgcagtggcatgatctcggcttactgcgacctctgcctcccaggtttaagtgattctcccacctcagcctcccaagtagctgggactgcacacacatgccaccacactcggctaatatttgtattttttgtatagtcagggtctcactttgttgcccaggctggtcttgtactcctaagctcgagggatccactcgcttcagcctcccaaagtgctaagattacaggcatgagccactgcccagcccattagaattctttttgatgaagcttgttataggatagtaatatgggttagcaatattcactgcatcccttaggctgggcacagtggcttacgcttataatcccaacactttgggagaccaaggcagaggatcacttgaggccaggagctcacagtgagcctgggcaacatagtgagaccccatctctacaaaaagtttagaagaaaacaacaggccaggcgcagtggctcacgcctgtaatcccagcactttgggaggcggaggtgggcagatcacctgaggtcaggagttcaagaccagcctgaccaacatggtaaaaccccatctctaataaaaatgcaaaaattagctgggcgtggtgatgggcacctgtaatcccagctactcgggaagctgaggcaggagaatcacttgaagccaggaggcagaggcagcagtgagtcgagatcgcgccactgtactccagcctgggcaacagagtgagactccgtctcaaaaaaaaaaaaaaaaaaaaacaataacaacaacaaacacatcccttactttgttccattcttatgttcttcccaccagccagtaagtcatcatttagaagtgcctgttatgtgccaggcacaatgctaggtgctagagataaaactataaacaaaacagaatctgtcttctaggttcaagaaacagccatgtaaagaaagcaaatttatgactgggcgcagtagctcatgcctgtagtcccagcactttgggaggccgaggtgggtggatcacccgaggtcaggagtttgagaccagcctggccaacatggagaaaccccatctctactgaaaatacaaaattagccaggcatgatggcacctgcctgtaatcccagctactcgggaggttgaggcaggagaatcgcttgaacctgggaggtggaggttgcggtaagctgagatcgcaccattgcactccagcctgggcaacaagagcaaaactctgtctcaaaaaaaaaaaaagaaaaagaaaaaaaagaaaattttatataacataatagtagattgaattataaacaaatgctaagaaaacagaaaaatctcttattatggttgtcagaatctgggcttaattgcttgctatgagttttaatttctattgaaatccttgcttgtctgtcaccttccttgcctatactaattttgtttggggttcatattttgggtttcagattatttagcgataatataattattagaagtaaatagcatttattaaacttaaatatgatttattaaaatatgttattaatgctacataatatgtaagttcttagaaaatcataagaacatcagatctctgaaacttcaatttttgagagtgagagggagggggagggattgccacttttaaatgaccagattgggctgggtgcggtggctcacgcctataatcccagcactttgggaggccaaggcgagtggatcacctgaggtcagaagttcgagacaagcctgaccaacatggcaaacccccgtgtctactaaaaatatgaaaattagctggggtggtggcaggcgcttgtaatcccagctacttgggaagctgaggcaggagaatcacttgaacctgggaggcagaggttgcattgagtcaagattgtgccactgcattccagcttgggtgacaagagtgaaactctgtctcaaaataaaataataaacgaccagatctctcaagaactcatttactgccgcaaagacagcaccaaccctccaacattggggattacaattcaacatgagatttggacagggacaaatatccaaactatgtcagggattatatttaaaagacctgtgaaatcctttagagaatgaacttttttttttcttctgagacagggtctggctctgtcacccaggctggagtgcagtggtgtgaacatagctcacgtccagcctcaaaatcctgtactcaagtgatgctgttaacctcagacttccaatgtgctgatattacaggcataagccattgtgcctggcagaaaatgaacaattttcacttgggtgaaactaattctttatatatggcactttgcttggaccaaggggcacatgtacatcatttttaatcaaataatcaatttgtttatatcagtaccatttaatcttatatgtgtttgctaatcttaaatggccatcacttctaacattcttggtttttaacattctctgtgttctactcagggtagctttattttctgctctttctgaactacagcaaaagatatgtatctttgtttgtcctaccctgtcatcttacctaaaggaagctactttccctgtacccttgctgtgtgaatagtagagcatgccagcttttcaaccctaccactggcctcagctaattagatcagaggagaccctgaatgggggttgacctatccacactctaaacaagtattttatggtttggtgtgatgagcttcactcagacagagataatagtttttgagacgtagagtcgtctcaggattttcaacgtatagacgtagggaagctgccaggtggtgatgagcaccaaaacagaggtcgcatagaatttgagttagggtagtaattattggccatctgtatactgcagaagttttctggaaaggagaaaagaaaaaaattggtaagcagaagcagagactgtgtggaaagtgcacatccgtgtgtgtgagagactgtaaatcaagaaacaaaggaagggtggagaaaaatattaatctacatgcttgcaagagtagcaacagttcctggtgggtccctaggccctatgaggcccagacttgccttctcactattctgcaggtctaccatgctcattcattcccagctctacatttgcttaccttggtcttcctgcttctgatctttctcaccacttcaagccatactgagtattaccaccaggttagtgttccttaaaatccttaaaattttaaggatcatgttatttacctaggcaaaattcattaatggttccctcattgccttataggaaagtttaagttatttagcaatctgtatattgctttttcaactctgtcttctaggatgttttctttaaaagaacaaagttcatttaatttggtattttagtattgcaggtaatggtgagggtcactagctctattctcctggccatttgtctctaggaatttttcctgagagtatcaactggactggtagccccagaatcatttgttgcagaagaaacaaaaatgactctgaggttgaaacatgagctggtggaggcatatctccacttggtgaatatggatggcagtgcattctggggctgttgtacctggttgaagacttttatgaggccagccttctccatccagcttcttgccagctttcaggcagattgaagagagctctgcctgatgatgaacctgacaaaatgccaaactgtccagtagccttttctttggggtttacattctaaatgtttttattgattagaaagaaatagcctcttagagatcatttaatttttgctttgaaagccttgaccaccacattgccaacagaatttacttataatgtggttagttaaaccggcattcatttgggaattttttagaactctaagttttatgtgtcaacattcagctttatcttctatttttgaaaaaatggaaagaacagtaacatataacccttgacaagatatgaaatgtagtgatcccttcctcataatagctctccattatctacagactttttcctttaaaggttataaaaaactctagaattcaatgtctttcacattttttcccacctatgccctattccttctcaaaaggaatcctatctttcagcaaaatgagtctgtttatcccccagcatgccagcccataattctacctcagtatttttgcatatcatgtttgcccagcctgaactgtcttctctcccatctctagcttgcaaggccctgcttaatatttacttccctatatcagaatgataaagtatacattggcatcacatatattggcatcacaatgcctaaaagtattttaggcaaatactttttaaatacataactcatcctttcacaggcagagaattctgcactatgtttgtaggagaggagaaaacttttccctctgccctctagtttcagtgtctggggccctgtcaattaaactgacagaagacagattaacaggagaaacagtttattacatgtgcatatggaggacttcatagaaaaaaaaatgaagacctaaagtggttaggcctgagatcttatataccatttttaacaaaaagtggtaaattgtagagatgtacaagacaaaaaaggggtttgagctttctaggggtggtaaattgtgggaaggtaaatataggggttgttttagggaggtttttaaggcagatttctctcttgccatctatgggctaataataataagactctagaatcatctcaggtgattaagagtcattttgcccttcctgtataaaaggtagggacacttccacaaaggagatttatgttctgcttttaggcaaagcatttctcctgtttatcaattgccttcagttaaaaaaaatcattctgcgaaggtggcatattttggggtggtgtgctctgatatccttccatttatagtagacctagataactgtaagcattgtgcaaataaaataaaattgggtgtgtgtcacaaaatgtagtttctgtagtcttttgaaatagcaaagatctggcaacactgggcccacttttctataaataacaggctagagctgagaagttattatccctttagatgatactgtactcagcacttcagtcctaccactccttactctccccatattgccccagcaagctgtaactgtctacttggcctgtctgccccagaggcaattgaatttaagatagagatacccaaaagggcagtattccaagaagaacagagattatcaaggtgcttgataatgacttaattgctgagagaagtgacttcatacttatttcctatctcttaattgaaagaattagcataccaagaaatgaaaacctttcagaaagtaattttctgatctggcttggtgaggttgagggcaatcactaaaaagcattctgtaaaccctgatatcgttttttgggatccatttcctccaaagctcttggggacaatagaatggaagctaaggttttaaaacagctaatatacaggagcaggaactcattttggtcttaaatgtagctacgcccatctcttctcttttgagtcttcttataaacattttgattaggcagttatagttagcgtttgtccaatgctttaaatattttcaggtgcttttattatatcgtcttcttaaaactttctaaaaaccctatgaagtgggatagaatagatgaagaaagtcaggctccaagagttttaagtgaattacgtgaattcccatgaggtgatagaattggaagtagatcctataacttcagtcttctgatttgtggtcttgtgctttgtaattttatacgtctgggtcttcatgatctccctgtaaatgatgtcatcctgttgttgtatgttatcaaaggacagaggtgactccactaaccctaacaactagataagaatgtgagaattgaatttggaactgggtcagcctctatctgtaatttattcagttgtctttatccccttgaataaactacctgggaggtggctaatagttgtctcatgacatgaaaagtattaatctaccttatcttgatctttttttttttttttttttttttttggtagagatgtggtcttgctatgttacctaggctggtcttaaactcctgacctcaagtgatcctcctgcctcccaaggtgttgcgattataggtgtgagccaccacatctagccctacataatctactgaaattgcccttttctggcgggggtgggagacagggtctcttgcccaggctgagtgcagtggcacaatcacagctcactgcagccttgacctcctggggttagtctcccacctcagcctcctgagtatgtgggactacaggggtgcaccaacatgcctggctaatttttgattttttttataggaatggtgtctcactatattgcccaggctggtcatctacttctaggctcaagcgatcttcctgcctcagcctccaaagtgttgggattacaggcatgagccaccacacccagctgaagggcagacactattatttaaagctgaatccccattgtctacaactatgcctggcaggtataagacactgaattagttttttatgcctaattcactgacttacagttctgtgattcttacattgacaactgactgccccaagtcaaacgttagctgcttttctgacatcccgtttctccttgagttctgacagaagtgaagagtgatcagctctgtgaggcagtgtggacactgaccctgagctacatgaagttgagacaattatgtttatgtgattaaagtctctgtgttagatggcaaataggtttatctttgtatacctttctctcaattctgcttgtactttaaccttttgtagtatgagggaggaaaaataattttctcctccaccattcacaagttcttatctgggacaccgttcaaaaaatacagattaacaagagaaaaacagatggaaatgtaataagatacctcttgtatatatgagaaataacccagagagatgagtaaatctttagggtagatctcaaaggggtaaacatcaggcttaaatactgtcattctctgaaacaaaaaaagagtggggaaaggcccagctaagatggccacgaaaagcaccataaaacaaaggtaaggtttattaatgcagatttaagtttgtgtattccctattgattgagtctctagtgatttagtcatctttctttacctggtgcagagagggagatatctttacgaatggagattttctttatagatgtgcatttcacttacaagtttctcacaataatccttatgctaatgaggcacattttggggtggcatgtcctgagccttgtaaaggtggaaaaagtataataccttttctcacccatcataagggtcacatctgacacgccaacaaggacaggttaacaagagaaaagcataataaatttatttcatccaagttttatatgacagggaaggcttcagaatgaagatcccaagacatagggaaaactgtctgtttttatgcttaggtttgataaagaatggacagttgcgtagaagtgtacatggggtgtattctaatggtaatagactgaggggggaagcccagcaaggcctttcggttcagattcttattggcctgtctgtatagcattccttcctcccagatatggggcaggaccctctggaataagggtttagaagggagagagtgacctttctaggttttatggcttgctttgagggagaggggttctagtttctgtgacccaccctggggaagaagaattctggtttctatgacttgaaacgggaaagaggggagggagacaggaaggcaggagaaagtcagaggcttggcttctgagggtacttctggggccatccagtcttttagttcaaagtactcaccatgccaaagtgccatgctttgggatattgttttttgagccccaacagtcccattagtagtcatcaatactttcaagtccctttagttcagagctttccaagaggtgccatttttcaaggtctgtctgtaccatgaagtgagagaggttgggaagcactgccttattaaattgtagtcatagtctgagattcaggacttcagtaagaagtctacgtggtaagttctttggtaatgtaggtgaggaaaatacacagatgtgtttgaaccagtacatcaacaagtctgctattttcaagaaaagcaagcacagaaatccagattttaaaaggttaagaagggcttactgtttagtcctgagactttgccagtttcttcatggtcgaacctggccttttctgattccaaatatttgagtgcagtgggtggtcatgttgaataaagacctctcttaagggaaaagagggcaaacagtgtgcctgatccttacagggagaaaaagactcttggaagagcacaaagctctcaggatgttaagtaacactgtaaaaacatgcaggaagagatttatgttttggggcttgtcatagcctgaagcagttggtactgttccctaacatgagaacttttttgtttctccggaacaatgtcaggccccaggagtctttcacatgactgtttgtcactattaagagccaagtgcctgttttgaagaaaacagagctggtagttaaaatgtttagaactccttataaagtgtcaagggacggggtatgtgtaacaaggtaggaagaaggactaaacaaacatttattgagagtctgtttcatacctgacacaatgttgggtgcttgtacatatgccatcttatttagtctttttaacagtcctacaagataggtattatttttccattttttagatttggaagccaagactcaaaaaattaatttttttccccaaggtcacacagctaatagtagtggggacatatctaaacctgtatagtcagactcttaaatcaatgattttttctctcttaatactgctttgggttccatgggtaatgatggagaaggctcacttcctgattttttttttaagtaaagagaaagggaaacagtataaaataacagcatttacatgcaaagactcttttctaaccctaatcttcaaaatgttctaaatatactgaacttttaagcattatattaagatctcatgagtgatgcggtggagtgaactgagaagagatttttctccttgaattaaagatgtctacaaaagcatatatggactgggtggcccatgcctgtagtccccctactttgggaggcagaggtgggaggtcgcatgagtctgggagttcaagactagcctgggcaacatagcaagactccatcactacaaaaaaattaaaaaaaaaaaattagctggatgtcgtggtgagtgcctgtagtactagctactcaggaggctgaggcaggaggattacttgagcccaggagatcgaggttatgatgagctatgattgtgccactgcactccagcctgggcagcagagcaagacaccgtctcaaaaaaatatatatatatgtatatgattttctggaaatttctgatagagccattatggtttttatttttatttttgagacagagtctcgctctgtcacccaggctcactgcaacctccacctcccaggttcaagcgattcccctgccccagcctcctgagtagctgggatcacaggcacccaccaccacacccagctaatttttgtatttttagtagagacggggtttcaccatgttggccaggctggtctccaactcctgacctcaggtcatccacctgccttggcctcccaaagtgctgggattacaggcatgagccactgtgctgcctggcctgagccattatattctaagaaatagatgctaacataccttcaggatatagtatgtccattgtcatcacattgatttagcctgcagttgtttaataagtatttctcagaggcagactaaaacttagggcctttgctctataaatggcagaattattggaagtttcattttatatttgtgttacagtatttttactcttcattgatgaagagaaatataaaggctttgctttagaattttcttttctcttttcagatggcaaatgtaaatactcatcacagcccatttatgaggatacaattttccgttagctttgcaggaggcctgtcctctcagtttgaaatgagggattcagggatttttctggtttgtttcattttatatttttatccataggtagcattttactttcatttgaagttctaattgacagaaggaaaaacagaaaaatgatagaatatttgagtagtaacatagaaaaccccaaattatatttgatcccaaatctcgaggtgggtttgtacttctgtactttgaagaattgatgcagctgctgtatttcttgttttgttttgttctaatctcttacacagaggattgactggatataagtagaataattttattggtattttctcagaggtggagaggatgagattattatactaaaacaatagattggaaatgttctgcatactacctcccttgctcttatcaagagggcaagggaattatggaaatgaagtatgaatggcatcttaactgtggacttcctgatttttcagtgttatttttgaatattaaaattatctcccaatttgattataagaaaattgcttgatttgagtactctcctcttctttcttaggattgccagtgatgggcagacaggaaagagagttcgcacctgagctctggaccctgcttttagtcagtgctcattagcagtcccctaagcaggctcatgttcttggctgctccagactggagtcttgtttgtgtttggtgccctgtcatactcttccactctgctgcactggccagtgtcacgcccagagcttggagggaaggaacacacttgactctggtgcctctggtattcttccactagccgatgcatgtgtacaaggcagcagcaggatatcaggaggtagccattaggaagatcgaggaagcaggatactgctgcagatttcaggctggcagcgaggttccttggtcagactagattgctaggggtgcagtgagttactgtcagagtgaagcacttttttttccctttgggaaagtaaatagagatagtgcttaactggccaacattttttaatattgttgagtatgagatattatggtaaaaaatcagaggtgtaagacacagttttaccaccaaaaaactgtgaagttgctttaaatgcattatcattaaattctcacaactaccttatttgttaaatcggttaaaacgactattttgcagattaggaaactaaaacctagccaaccacacagctagaaggtggtggagtctttatttagatttctgtttatgtctgtatgatttcaaagcccatgttcactaatcactggggagaggaactagtcaatagattaggcacacgcacacatagtgtgcaatatttctcacatttttaagatcattaaattttccactgattcagaggagggagaggcctgtttggctggaatatcaggaaaatcttcattaagaaaatggaacttaatctaggccttgaaagatacatgagatttagaagtagtgagaacattcaatgtgggaataatagtgtgagtaaaagataaaagagttatgacatctaaatccagtgtgtgattatagatttgattctgggaaaaagtctagttagggtattactggggcatttgataaaatttgaatatagactgtattagatagtatttatcaatattatataactgtggctatgtgagttaggaaatatacactaagctaaatagagataaaggggtatgacatcctgtacttacaagtggttgtgtgtgagagaacgattgacaaagcaaatatagtaaaatgtaaacaatggaacaattggtgaatctgggtagaatatagataggaaagtcataattttggtgggttttttttttctttctttctttctttctttctttcttttttttttttttttttgagatagggtcttgctgtcacctagacaggagtgcatgatcttggctcactgcaacttctgcttcctgggctcaattgattctctcacctcagcctcccaagtagctacaggcatgaggcaccacgcccagctaatttttgtatttttttgtagagatggggtttgccgtgttgcccaggctggttttgaactcctgggctcaagcagtccatctgccttggccttccacagtgctgggattacaggcgtgagccactgcacccggccctgttgtattttttatgtgcttgaaattatataacaacagtatttcagatgtcttatgttttataagtgtggctaaaattcttcagaaaccagcaaaacccaactaaggcatctcagccaggaccatattctgttcttgcttcctccattggtaaaaaagttgccaaaccaagttgatgagataaacagagactgtaattttacagagaaactatgttaagttgtagttaagatgtttttcttggccggttgtggtggcttatgcttgtaatcccaacactttgggaggccgaggcaggcggatcacctgaggtcaggagttcaagaccagcctggccaacatggcgaaaccccgtctctactaaaaatacccgaattagtcgggcgtggaggcatgcgcctatagtcccagctacttgggaggctgaggcaggagaatcacttaaacccaggaggcggaggttgcagtgagcaaagatagcaccactgcactccagcctgggcgacagagcgagactctgtctcattacaaaaaaaaaaaaaaaaaaaaaaaaaaaggccgggcgtggtggctcatgcctgtaaatcccagcactttgggaagctgaggcaggcagattacctgaagtcgggagttccagaccagcctgaccaacctgaccaacatggagaaaccccatctctactaaaaatacaaaactagccgagcatggtggcacatgcctgtaatcccagctactcagaaggctgaggcaagagaatcacttgaacccaggaggcggaggttgtggtgagccgagatcgcaccattgcattctagcctgggcaacaagagcgaaaacttcgtctcaaaaaaaaaaaaaaaaaaatgacaaagatgaaccttgcctacagttctgctgctgatggtaataagtagctatatactggatcctccctgcctccctctttgcccccacacatacccacagaaagatagaaggaataagagaccaccttgcctcataagaggaactgagtctctttttaacatgcttctctgcctgggtcacatgcacatattaactcagccgggctgctgccccatcacactactacattcatgctagaaatctaccaaaatgtatgtactcgttgcctgtacataaagtggttttcataggctacttaaggttgactctgagtgttagactggcaacaccctgctttcctttgagtctttcttaaagttaactgaatcttagaataacatttacatgtgggtaattagtgcctattaatgatggcgtttatgttctatatgaatgtgagtcaggattgtgaaacagttaagtgctcaggtcctgaagccagatagatctgggtttaaaaccagctctgctacttactacttgtgtggctttgaacaaattactccttatctttcctcactttcctcatctgtaaaatgggataaaattattctcaccaactgaaataacacatgtacagcacttcacataatgcttggcattttgtatgtgtggaataaatgttagccattgttggttatcattatcattattttttgttattttgtgtgatttctggctccccctgaatttgctaaagtgttccgatttgtcagacttttcccacaatctctcctacttctgtcttccatgctgatttttctttagtggcttttcattttttaggcatttcgtttttcccaagggtccagaaatgatccctgcaccctgccccgcactccccgcccccaacttttctattctctccactgctttcaaagaatgagtgatgtccaagtaagaaagtctgtttcttccctagttaggacctgactcctactctgcgttttgtaaaggacggaacttttaaaccaagtttatagaattgtgtgcgattttaagtaaatgaggtcttactttcttttcctccctaacttagattagaagtatatcaaagcccttaaaatccattgcattttctgataaaatctttctgccaaatatgactggaaggatgtgctttgggttagatgggcaaattctgtcatttttacagttattcaaaatgccttaccttctggcttgatctcttcctgtttaacagttctgttctaaggatcagatgagatcatgcatgtgaaagggctttctaaactgggaaacacattgttaatgtgagggatgattattgcatttgaacaaaggccccagcaacccaagtgatgtcagaattcaactttagataataaagcaacctcctatcttcctgtctgtctaacaccacctccagaagtttgcatgaagctatttgagttagagagatttggtgactaacttcatgcagtgactgcaatcctttctcctaatccctcatccccatattattctctctcaggatggtgtgccagatcctgagttagtcttcagggctagactttgggatatagcatggcaggcaagacacttaataggatctagttgtggggtaggagagatttcttttgtgccattttctaatccccttcctcacaggttttatcctggcagtccccgtaaattaaattacatttcaaaatcaagttcaatgagggtgaggccagatatggcttctgccaaaatgggctggcagacctgggcaattaagcagatagctttggtctgttgtgtttttcttatttatggactaaataccagaaattattatttgtaccatgtgggcagcaaatcaggaaataggtgtgagatcatcaccatcaaccacaaacacttaccagatgcttgataagcacaggaccctctaagcactggggagtattttgttgcatcctcccaaaattcatatgttgaaattccaactcccagtacctcagaatgtaactgcatttggagataaacacataaagaggcagttaagttacaatgagactgtggggcagggggagaggggctcaaatccagaatgacttgtgtccttacatacacacacacagaaaagacaccagctgtacctgcacacaaagaaaaggccgtgagagaagatagctgtctacaagccaaggagaggcctcaggagaaaccacacctgctgacaccttcatcttggacttctagcctccagatctatgagaaataaaatttctgttgcatgagccacccagtctgtgatactttgctgtggcaaccctagcaaactaatacagagaataagaggctaccttgcctcatatataaacagagatataaacagataggaagagcttttgcagtgggaaacccaataaaattaatcctcacaacccatacaactccaccccagccaaaaaaacaaaatccaaaactttttttccccaaatcagcattttctgaaattgaaagtcctcttatccttggtcatttcaacatttgccctccttacatagctttatttgctttctctagagaagggtcaagagaaagactgctttctaactatgcctatttctccctaatggtgctgtcatgagttaacttagagaaaccacattgagaaggctgggaatagatagatggcagagtaagttggtgatcccttttgttggagaagaactgcaatcccagaattggtttgattagtaccacttctgctttcctcctctgccaaggagtttcaaattcattgctgatgctgtgttcctgtttttgtattagatgtattatgatatttccccatcttaatctgtagattatcatccttagaaagcaagtactattgcatattttgttcagcctgtagtgatgtgcagatgttcaggcaactctggatgactttgtttatttattttttttattattattctttttctttttttatttcatttcgagacagggtctcactctgttggccaaactggagtacagtgacccgatcacagctcactacagccttgacctctgggctcaagcagtcttcctgcctcactcagcctcctgaagagctaggattacaggtgtgcgccagcacactggctaatttttgtatttttagtagagaatgggtttcaccatgttgcccaggctagtcttgaactccccagactgaagtgatacacctaccttggcctcccaaagtgctgggattacagacatgagccactgcacccagctgtgggtttttttttttttcttcaattcctctctgtttctttcatgtaaatatattgtagtttgtttatcaaatttgtttgcaaatgagttgttgcaaatggaatgaacctcatcaggaatgatgaggggccctaatctgaacttcaaactaaaatcaacaacactctttttttaatgtgctaagagttttgtcattttggtttctttgagatttaagtgaaatttatttctccttcagtgtgatctgcctttcagcttttcagtggttttcttcaggtatgctgtccattgtcatatgggaactagttctacttagccaaaaataagatgatttcccacacatcaagccagaacacctaaaaataattttttaaccaaatttctttcagtcaaagtttttcaaaatacagaaaattcttttttcttttctttctttttttttagagatggagtcttgccctgtcacccaggctggagtgcagtggcgcaaacacagctcactgcagtcttgacctgtgctcaagcagccctcctgcctcagcctcccaagtagctaggactacaggcatgtgccaccatatccagctaatttttgtttttgtttttgtttttctttttgtttttttagagacagggttttttcatgttgcccaggctggttgtgaactcctgagctcgggcaatctacacaccttggcctcccaaagtgctgagattacagatatgagccaccacgcccagcaaaatacagaaaatcttaacaggtaaccattaaatcctccctaaaggccaggcacagtggctcacgcctgtaattccagcactttgggaggccgaggcaggcagatcacttgagttcaggagttcgagaccagcctggccaacatggtgaaaccccatctctactaaaaatacaaaaattaactgggcgtggtggcatttgcctgtaatcccagccacttgggaggctgaggcaggagaatcacctgaacctgggaggtggaggttgtagtcagccaagatcatgccactacactccaacctgggcaacagagtgagagactctttctcaaaaaaaaaaaaaaaaaaaaaaaaaattcctgcctaaaatgaaaagttgtaaaatgaactagggtgtgatgttttgagaaaacaggactgggcgtgttgcctcatacctgtaatcccaacactttggaggccaaggtgggtggatcacttgaggtcaggagttcgagaccagcctggacaacatggtgaaaccccatctctactaaaaatacaaaaattagccaggcgtgttggtgtgcacctgtaatcccagctacttgggaggctgaggtaggagaattgctggaaccggggaggtggaggttgtagtgagctgagattgagccactgcactccagcctgggcaacaggagcgagactccgtctcaaaaaaaaaaaaaaagagagagagaaagagaaaaaacatagaaattagccatttgtttatttatttattttgagacaggatctcactctgtcacccaggttggagtgcagtggcacaatcacagctcactgcagcctctatctcccgggctcaggtgatcctcccacctcagcctcttaactagctaggactacaggtacccaccaccgtgcccagctaattttttgtattttttgtagagacggggttgccatgttgcccaggctggtctcaaactcctgggctcaagtgatccgcctacataggcctcccaaagtgctaggaaatataggcgtgagccaccgcacctggccatatttatttattttgtacagccctttaatgcatgagaaattagccagttatttaattgcatttaactttgagtgtttatataacttggctacattttattttattttgttggatgtttctaaaatccctttgtaaatgcttaagtgctggcgcttacgtaaatcaatacggaatcaggtatttctaattagttcccattctaccctgttcaatgtttaccagttgggtttgaaagtatcaaaactcgggagtcagatgtgagtcaggggttagccagtgataggttgaatcaaagagctgggaattatggacttcacataatgaaggaaaatctctaagtttctttcttttctttttttttttttttgtctagtagtgaaacaaagattggtggtacctctaccttttattatccactggcctataacagggaacagagtgtatgtcagactgctttgaaatctctaggaaaaaaagaatagtgattactcttggtttagctgtacataattcatccaaccaaagaaccactcattcttgcaagatcaaaactgttttcttcctttcagaaacaaggcagggtggcctgggccaaaatacatgttccttttgaccacatattggcaggacaggaatatctatctagctaaattatggctctagcttttttctaaccaagaaatctcaaaccaaaagaagaacctctgggtcctattcttggcacattcccactttctctcttcttggaaagttaaacaactttgagtggatagtgtttttagaatctcattgccttgttaacgcacaggccctgagcctgcagataaaaatggaaccacagcagtaggagggtatgtgtgtgtatgtgtaaattcagactttggtttttattgagattatcttgctaatgccccctttgtaaggttccctaggttttcttgatgtctagcagccttggtaactgagtgattagaaaggcatggaagccaggtgtgttggcatgcacctataatcccagctacttgggaggccaagccagggggattgcttgacccaaagaattcaagaccagcctgggcaacataccaagaccccatcagaaaaaaaatactttttaaaaagaaaggcatgggccaggcacggtggctcacacctgtaatcccagcactttgggaggctgaggcaggcagatcatgaggtcaggagttcaagaccagcctggccaatatggtgaaaccccttctctactaaaaaatacaataactagctgggtgtggtggcgcgcacctgtagtaccagctacttgggaggctgaggcaggagaattgctggaacccgggaggcggagggtgtagtgagccaagattgcaccactgcactccagcctgggcaacaaagcaagacatgtgaaaaaaaaattaaaaaaaaagaaaaaaaaaaacaggaaggaaggaaggaaggaaagaaggaaggaaggagaaaggaaggaaggcatggagggtatggatcagcaaatctgaataactgaaaatattttacctatggatctgtgtgtgtatcttataggaattatagagtaaggagaaggatttgcctttgttacttttctgattcttttatatcttgtgctttgcagggtttggtcctacacccactagccccagtccctcttaatgctttaaggcagactacatggttcattcttcctgggagaaaataaatctcttgatttttaagtaatagaaaggtgttaatgacctctcctgggagtatttatgtgtttaaaacataacctaggctgagggcagtagtcctggtcatcaaaggaagggaaatatttgggaataaaaatatttttctgccttaattgcaccatagggtatgattttccaaagtagtgtgaagtcacagttaaagttcctcccagccaggcacggtggctcacacctgtaatcccagcactttgggaggccaaggtgggcagatcacaaggtcaggagtttgagaccagcctggccaacatggtgaaaccctgtctctattaaaaatacaaaatgagctgggtatggtggcacacacacctgtagtcccagctacttgggaggctgaggcaggagaattgcttgtacctgggaggcggaggttgcagtgagctgagatcgtgccactgcactccagcctgagcaatggagcaagactccatctcagtaaataaataaataaataaataaagttcctgccaatagtcctaatctccttttccagaaaatgttttgcagagctgctgtgatatggtcacattaaccagtttaagttcactttatttttccatcttgtggaaatatctaaaagatggagcaacacaggtggcagaagagaagcagcagaggacctggataatctctgaataattaagatctgatgttattttattttaaaaatgccttttgtttgtttgtttgtttgtttgtttttgagacagagtctcactctgtcgcccagcctggagtgtagtggtaccatctcagctcactgcaacctccgcctcctgggttcaagtgattcttgtgcttcagccacatgagtagctggggttacaggtttgtgccaccaagcccggctaatttttgtatttttagtggagatggggttttactatgtgagccaggctggtctcaaactcctggcctcaagcaatccacctgccttggcctcccaattttgccattttatattaaacctgtgtgtgtcccttggaaagttgatcacttagatttgtttagcagtcacttacatcagtggtagatctgaaatttcctagataccaaatgtctctttcttccttgagtttctagtaagccatttgaaagttcatgtttcccgtaaagtttatttttgaatacaagaatttatgggaatgcaggctttttaatttttaagcattctaacactgtcatcaggttgtcgtcacaaaaatcctttgaaatgcctgaatgacatctccaggaaaatcactaattgtccagtgatgattaatgtttttgtattacactaatactgtaatacttagtccttttctaggagattgtgagaatatggataaacacttcctctagaagattctgtgactctgaaagcacctggtaggtgctgaggcactgctctgttcatttattagagtaaattctgttacttcctgcagactctatcttagtcccacatagctctcatcacgatatgggtatctattgagtttgggggtgagtcattttaatttaattgctcagtaattaagttgcagtcctagactgactgatgtcagtcctttttcagcctcagtaggatgacttgcgttgtgatttgcagtatgattttttttctgttttgttagcatgctctctgaacatagtagatgtgggacttattggctattgtgtttgaaatgaggctatgtctagataaaaatggtctgaataaggaccattggtagtaatagttattgtttaaaaaaaaactttgtcaaaggctaaagaaaaaatattatgtcacaaattttctttttgtaaagtattgttttaagatacagcataaactatccattgtataagaacaggttatagcaacaaggccatgtttcagttgtccaggacttttgatgcaaattctctcttttttttaatttttattttaagttctggggtacatgtgcagtatgtgcaggtttgttacataggtaaatgtgtgccatggtggtttgctacctatcaaaccatcacctacatattaagcccagcatgcattagctatttttcctaatgctctccttccccccacttcacccccgacaggccccagtgaatgttgttccctccctgtgtccatgtgttctcattgttcagctcccacttataagtgagaacatgtggtgtttggttttctgttcctgcattagtttgctgaagataatggctttgagctccatctgtgtaccctgcaaaggacatgatcttattcctttttatgactgcatagtattccatggtgtgtatgtaccacattttctttatccagcctatcattgatgggcatttgggttgattccatgtctttgctgttgtgaatagtgctgcagtgaacatatatgtgcatgtatctttttaatagaatgatttatattcctttgggtatatacccagtaaggggattgctgggtcaaatggtatttctggttctagatctttgatgaatcgccacaccgtcttccacaatggttggactaattttacattcccaccaacagtgtaaaagcattcctatttctccacaaccttactagcatctgttgtttcttgacttcttaataattgccattctgactggcatgagatgttatctcattgtggttttgatttgcatttctctaatgatcagtgacattgggctttttcacatttgttggctgcatgaatgtcttcttttgagaagtgtctgttcatgtcctttgcccactttttaatgggttttttattgtaaatttaagttccttgtagattctagatattagacctttgtcagatggatagatggcaaaaattttctccaactctgtaggttgcctgtttgctgtgatgatagtttcttttatgagagccattcatgacaaacccacagccaatatcatactgaatgggcaaaagctggaagcattccccttgaaaaccggcataagacagggatgacctctcccaccattcctattcaacatagtattgaaagttctggccagggcaagcaggcaagagaaagaaataaaggtattcaaataggaagagaggaagtcaaattgtctttgtttgcagatgacatgatcctatatctagaaaaccctatcatctcagcccaaaagcttcttaagctgaagcaacttcagcaaagtctcaggatacaaaatcagtgtgcaaaagtcacaagcattcctgtacaccaacaacaggcaagcagaaagccaagtcatgaatgaactcccattcacaattgctacaaagagaataaaatacctaagagtacagctaacaagggaaatgaaggacctcttcaaagagaactacagaccactgctcaaggaaatcagagaggacacaaacaaatggaaaaacattccatgctcatggataggaagaatcaatattgcgaaaatggccatactgcccaaagtaatttatagattcagtgctattgctgttaaactactattgacattcttcatggaattagaagaaagtattttaaaattcatatggaaccaaaaaagagtttgcataaccaagacaatcctaagcaaaaagaacaaagccgaagatatcatgctaccagacttcaaactatactacaaggccacaataaccaaaacagcatggtactgacacaagaacagactcatagatgaatggaacagaatagagaacccagaaataagactgcacatctacaaccatctgatcctcaacaaacctgacaaaaaaagcaatggggaaaggattccctatttaataaatggtgctgggagaactggctagccatatgcagaaaattgaaactgaacccattcctcacgccttatataaaaattaactcaagatgaggccagggggccgggcgtagtggctcatgtctgtaatcccaacactttgggaggctgaggcagacagatcatttgaggtcaagagtttgagaccagcctgaccaacatggtgaaaccccatcactactaaaaatacaaaaaaattaggcatggtggcacatgcctgtagtcccagctactcaggaggctgaggcaggagaattgcttgaacccaggagacagaggttgcagtgagccaagattgtgccactgcacttcagcctgggagacagagcgagactctatctcaaaaaaaaaaaaaaaaaaggatgaggttgggcatggtggctcatgcctgtaatcccagcactttgggaggctgaggcaggtggatcatttgagatcagaaattcaagactagcctggccaaaatggtgaaaccctatctctactagaaatgcaaaaattagccaggcatgttggcatgcgcctgtagtcccagctacttgggaggctaaggcatgagaattgcttgaacacagcaggcagaggttgctgtgagctgagatggcacttcttcactccagcctgggcgacagtgtgagactctgtctaaaaaaaagaaaaaaaaaaaacaaaaaaactcaagatgaattaaagacttaaatgtaaaacccaaaactgtaaaaaccctagaagaaaatctaggcagtaccattcagggcatggtcatgggcaaagatttcatgacgaaatcaccaaaagcaattgaaacgaaagcaaaaattgacaaacgggatctaattaaagagcaaattcttaatgaaatctcatcttagttgttgatgttgttgttcttcctcctccttctcctactcttctgcctacctccctccctccctccttcccttccttgcattcttaagatatcaaagtgctaccatataagatatttcaagaccaggcacggtggctcacgcccgtaatcccagcactttgggaggccgaggcaggtggatcacgaagtcaggagattgagaccatcctggctaacatagtgaaaccccatctttactaaaaatacaaaaaattagctgggcatggtggcacacgcctgtagtcccagctacttgggaggctgaggcaggtgaattgcttgaacctgggaggcagaggatgcagtgagccgagatcacgccactgcactccagcctgggcaacagagcgaaactccatctaaaaaaaaaaaaaaaaaaatcagtatcaaatggtaatagaaaatatcaaatattggttctagcttatcctattatttaatacttggagggcaaccttcttaccaacctaggcatgatgacaggccttgctctgctcaaccttggagtttgtatttggtgattctatgcttcggcagtctgaagagacttagctttatgtgtgtactgttggctttgtgaaccagaagaaatagtgattgagaccagtaaataaaataggaaatgaagaaacgataccctacatagaaaatattggaaatatcagaagaattaatataataacctctctctcctcttgcctgaacccaactgtaaggagtgacacaattttttgagaacagccccacaggacatggaataagacagagaagggaagataatgaataggaaaggacaaatggaaaataatcagcacagttttcaggaaaatataaaattttaattggggccagtggttccttaggaaggaagttgggtgatcttttgctacagagaagctatttctgggattccaggtctcttgaagtaaaggagcagtatcaatgataattgtaagaaagccacagaaagtgtgggaatgagtggtgaacacaggtttacttatgaagatgttttgaacttctctggcaggcaatgttcagtgctactgggtttcttatttattatttaattgcccttcaaggagccattgccaattttaatgtctgccatatgtgttcattcttgagtgcttgctctccctcttcctctttctctctttctctcccctccttccgctgtggttaaacacagaagacagttgcagagttgtgggtcaaagggttattttaagcatatgaaaggacagcccaaacagaggataggctttatggccaaagtttgtgctcaataaagagtccctttgagccgggcgccgtggcttacgcctgtaatcccagcactttgggaggccgaggcgggtggatcacgaggtcaggagatcgagatcatcctggctaacacggtgaaaccccttctctactaaaaatataaaaaattagccgggcgtggtggtgggtgcctgtagtcccagctattcaggaggctgaggcaggagaacggcgtgaacccgggaggcggagcttgcaatgagccgagatcgcgccagtgagcgagactctgtctcaaaaaaaaaaaaaaacaaacaaaaaaacaaacaagagtccctttgtgtcaacaaatgaaattaaaagaaaaatctggggtaataagctttatgaaacatagccagctttatgtgactttttttttttttttcttttttgagatggagtctcaatctgtcgcccaggctggagtgcagtggcgcagtcttggctcactgcaacctccctctcccaggttcaagtgattctcctgcgtcagcctcccaagtagctgcgattacaggtgcacacctatgtggcctttttgaatcagtattggttagtgaaattctaaggcatcctttcccactctcaccctccatcccccaaatttatcatttttaaaagaaaacacaagacattagagccaacattgccaatgttgtattataatcctaaatatgatccataaattagaggataaagcgttgtgaaaattttgcatgggaagtagtattactgtagaaaatataggactgttgttttattttatgttgaatttgttctaaatggttctattcaagtatttaatatgtgataagtcttttattttctagtttaagcattttgtcactgtagtattgttttgcagaagaattgctcagaacctagttaaggaggtttttaaaatggacaataatactcaaagaggttatttagtgtgtagatggataaaaccaaacatttgcttactaacagccttcagttattctgtaaactaataatcaattatgctctctaaccttgctaggaagtgagttaaagctaaagcattaaagatttaggcttgaccagtaagtttcctgaggagtgttgagtggttaccagggaaggagttcattaggaatatgtgagatggccttgtcaggaggtgttagagctggctcggtttttttgttggtttggagagggaatcctctcacggattttgtcataggattttgtggctttttaacatttgcacttggagagacaaaaatttgaatattttgcctttgctttccattgtaatttggaatggctatttaaaccgttgagtttaatacactgctgtactccccaggatcacaaagtacatgttcttgacaatgatgtgcttgcttatctgctagccacattctgactctactccatactgcatcctttactgaaaagaagctagtttgattcttgactcagatacttaaatacaggaattttagtcttgtcatctcttatttttatcaccagttaagcccaagatgaccatgaaaacagtaacaagtgtttcagattgctcttgtaccttctgcctctggcttgataagcatcacatctgcctgcctgccttcctttcttttcttttctttttccttttcctttccctttccctttcccttcttttcttgagacagggtcttactctattgccaaggctagagtccagtggcatgatcttggctcactgcaaccttgacctcccaggctcaagcaatccttccgcctcagcctcctaagtagctgggactacaggcacatgccaccatgcccagcttatttttatactttttttagagatggggtttcgccatgttgcccaggctggtctgaaactcctgggctcaagcaattcacctgcctcagcctcccaaagtgctgggattacaggcatgagccaccacccctagcccacatctgcatttctaaatacacacacacacacacaaacacacacacacacacatttttttttttttagacagtctcgctctgttgcccaggctggagtgcaatagcgtgatcttggctcactgcaacctctgcctcctgggttcaagcaattctcctgcctcagcctcctgagtagctgggattacaggtgcccaccaccaagcctggctaatttttgtatttttaataaagatggggtttcaccatgttggtcaggctagtctcgaactcctgacctcctgatctgcccgccttggcttcccaaagtgctgggattacaggcatgagccaccacacccggcctggacttctttatttagcctactctttctctagtatttggcatccctcaaaaataaactgagcttcattcatacatagagatccaatcacaaatgagtcctgaaacctacaacaaactaatgatcccttagaaaagatcctggctatttttaaacatgccttactcagttgctcctatctctatgaatattgttcctggtaatttctttgcctacatagaaaaccaggttatttattactgtaacttactttcactgaggtgaaatataggctacatcatcttttttatcaatgtccttaatatatatgttagttactggtaatcactaatttctagaccattgtgtccaaggccagatgttttaaaaattgttttaggtcagacacagtggctcacgcctgtaatcccagctctttgaaggccaaggcaggcagatcacttgaggtcaggagttcgagaccagcctggccaacatgacgacaccctgtctctattgaaaaaaaatacaaaaattagccaggcgtggtagtgcacacctgtaatcccagccactcaggaggctgaggcaggaggattgcctgaacctgggaggcaaaggttgcagattgggccactgtactccaacctgggcgacagagcgagactcttgtctcaaaaaaaaaaaaaattgttttaaagtcaaactaaagccctcaataaaactgaatgaagaacaggctttcacatctgagacctcttctgaattttgccaactgaactgcctaatttgtcataaatctgcttttctttccaaaaggagataacccctcctagagcttgaacacttaattagtattctttctttgtttaaacttggtttttgctttggactaaatgaaaacttggcaaagtttctaagctcacatatgagactgcacttctctcctatccaaatacatgtttgaggacaggactcctgtaggcaaggaaagctgccttccctgtctgtggaagcctttcatccaagaggccccttctttccctttgtacttatttctccttgggagatgttcactgtcatcagtgtagactcagcttagcagcttagcaacagcaaaaccaactcctgaatgttcttttggctgatggcaaagtgacaccctccttctgaagaagcttgttggcctgcctttaactaccactttggagatgggggtaggaaatgccatagtatcgtaggggacgaaaaagtttttctctgccttcttaggttcatgtataaggcctgcaaattaaactgacaaaagattcacaggagaaaaaaaattataaattttgctgatggtaagtatttttaattttatatgcacacaagcttaacagaaaaaaaaaaaaaagaaaatccaaagaggcagttagacttgaaagcttgcataccattttaacaaaggatgataaattgtggagagaagtgactagacataggaagaagggtttggtcttctaaaggtggtaaattatgggaattaagtatatggtgaatctaatagtagataagagttattttactaaggtttgggcagactcatcatggtgtcagctttccatctttttcatgcccataaaacttccccagagagggatttatggcagttctcaccctctctttttttttgagacaaggtctcaccaaggttgctaggctcactccacctcttgggttcaagcaatcctcccacctcagccttccaagtagctaggactacaggtgcgcaccaccatgtctggcttttttaaattttttattttttatttttagagatagagtttcattattattgcccaggctggtattgaactcctggcttcaagtgatcctcctgcgtcagcctcccaaaatgctggggttacaggcatgagccaccatgcctggcctggcagttctcattttttagaagtttctgctcttggccagataagggaaactccaagacttatttttccatctgttgagtctcaattgccttcagcacaaagtaacctataggccaaagtggcaaagttggggctggtatattctgatacttttcagtagttaggaaaatacagagaaaagaacattgacttagtgactgtcatcaacagagggacattaattagccacatcatttaacatgcctggggcttaatttaattatctagaaaacaaggcaattggattatatgctctgtaaggattcatactgctctaaattacttgattattgttctgaaggattttgaatgtagttgctcctagatacataaaatttatccttgtctctcaagataatgcagatgtagaatttgtctagtgtgcatgaaattcctgctgccataactcagagatcttatgactgggcaacatactgatcctccccctacccccatctctacaaaaaaaaaaaaaaatttttttttttagttaactgggcatggttgcatacctgtagtcctagctactcaggaggctgaggtgggaggatcactttagcccaggagtttgaggctacagtgagctatgatcatgccactgcactccagcctggaaacagagggggaaaaaaatcttattttttgatatctaccatctacctaacctaggattgattgaccaatcctaacagtgattgaagggaacgtatttaagggagctgtgaggagggttggcttgcagcaagtggagggaccccagaaatgtttgttgttatttcaagatctggttatctttcagttatctggctcatgtttcccaagcaacttgtcacaatttctggcataaccactaaatccaagttagctcacttcccagactaactcagagtccatcagagtcagtcaaaattctcctttcatttttgtaatccaaggtgctgtggagacagtatggacttcggcgtcatccagagctgagagttcccacagtctgattctgcctttatatggtatttatttttgatacaggttaacctctttgtgcctcagggtcctcatttttaaaacagcactactcaagttcttaccttaaaaattattagaggatccaatgagatgacaaagaggaagagcttctcatatgcctcctagtgagaacatctgacatttgtacgcctcttatttatcaatatgaaacaccatcataaaagcacttttttttttttttgagatggactctcactctctcccccaggctggagtgcagtggcccgatctcggctcactgcaagctccgactttcgggttcacgccattctcctgcctcagcctcctgagtagctgggactcacaggtgcccgcaactgcgcctggctaattttttatatttttagtagagacggggtttcaccgtgttagccaggatggtctcgatctcctgaccttgtgatctgcccgcctcggcctcccaaagtgctgggattacaggtgtgagccactgcgcctggcataaaagcacttttatttagggcattatgtggatatgctttgctgggtaaaatatcacttcgatattaaggtctgagctgggcttgctggattgggaccctgggtattttgagtttggtcatgccagatggccttggctatcttgtggtttccctctaaaatatccttttatgttttccaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcttcctgcctcta

SEQ ID NO: 208 - DNA, 55753 bp, Homo sapiens
aataaacgtgttgggggcactgagtaatgtagccatttctgacccggcagccaggaaaatgtgaaacaatttgcttctggaaacaggacagccggggccgtgttcctgcaacagcagaccaagcaccgcggcggacccaggcaagcacggaacaagctgagacggtgcgtttaagcggcaggtggctactcagtgtcgcatactatgcggaaaataggtttggttcccggtgttgtggggcctgaagttacaaactttgggaagctcactttaagaaaaatagtacaacatttttaatatgaaattgccagggctttctctgggactttagatgggaccaggtaatttggaggccaacggctgaaactgctataatttcactgtaaattcactccttgctcaaaatctcagttagggaagctctcaggttgtttatgtatcaccaccagttctacctagctttgtgtgtattctctgctaattttctccatccgcttctttaggtattgcctttccatagcctttcatattggcctcataactgcttccaaagagacatagaaatgttccttataccttctttaactgtgtttttatgatgttactttagctacaaatatttgctcttaggttcctgaggtctccctaaatcaagtgctttgtgtattttagatggagatagacaggtgggagggaggtgaaccatgcagttgtactcatatccatataattttgaaagattttgtgggccacaatgatttcattggatttgaaaaggagtgcaactttgtggtccatgtaagtgcttctcaagctttcctgtgcacgtggatcacctggggatcttgctaaaatgaagatttggctgcgcgaggtctcgggtgggaactgagagtctgcatgtctaatgatcgcccggatgatgcaagtgcacggaccacactttgagtcacatccaagtatttatttgtaggaaatatggtggcacaaatacacagtcaataagggtatggttcaacctcattttatggtaactcgtctcaggatggaaagtctgcgacaaacctactatgtatggactggtgtttgttgacatggcaatacatgaggaggtcttcctgcctcccattttctcctatacccaggagctggggacagagggatgagaagtaaaattttatcattaaggatcattattatttcactgtctttagttttttaactttttatggtcctttttaaaactttgcctatggagtgatcagaagggacataagcttttagaatatctactagggtgttgggcattaggctgccattttctcttgactacttgtaacccttcgaagtggttattgtttcactgcctttacagatggggaagctgaggtttagctgggttaagtaacatgacagattccatagagacagagcagggattcgaacccagctcggtgctttcacttgcactaaccggcatcatgaaagcagtgttacatgtttaattcagcatgagatgctagctcatggatttattactttttgcttttctcctaaggaagttgcccagagagagtgccctaagcagaggagagggagcagaaagaaagaggttactgaaaagaagaaaagacttagaaaagctctatggggcactgaagattaatctcacacctaaagcaaaacttagctccaaaaagactagcattaagattcttgccttctttgtgagaaaatgatcttcccaaagtgtctggtttttatacacttattttggatcaattaaggtatgatgctccaagatgctgagaatttgactgtcaatgttaaaagatttctgtccatatcatgccaagatcaactttaactttccctctcctgcataacatcatgtgaaataaggatctgtcaggttctgtgaagccagtatttgtctttggccagcatcctaagactttttgaaccactttacttgatcctcagtcaaactttttgttcttgtttaaacctaccatcacattttgttcagttatttagcacgaagataagcgggcctggcatttggacaaatatttgaagatcaagtttgtcacagggccctccagtttcccttccagatcccaccccacttggagcgtcttccctttctttcccacccttcctgctctactgccctcccaccacatgtattattttaacatcttgacacctacaaaatctttagctatatggcatgtaaagtaagagaggataactaaaccaagtcaaagggtaaggaattgctatccttatctctgaattttaaaagataaatctttaaagacaccaccctgagccagtcagggaatacacttcctggttgagggaactatccaatggccacttaactagataaccctgtctcccttggtatcctgtttcctgctccccttctgtaccactgagaatttattccaacttttgaggttgtatgttcttacctattttcagaatgtggtttcaaattttgctatttaacactgcctttcagcaggagattcctatcgaaagattataggtaacatctttctgatatttccaataaaatgtctcttgcactggtctgttaagactcagatttatgggtagtttcaccaaactatgtcccttagcaaagctgtagtatgtttggctgaacacacagatatctcctactctgtttactgccatcatggagtggatggtgtacaggtatgacacctgaagctggctcccagggccatgcctcttaggtcactggttaacagtactggctaagtcacttaggctgctggggctcagtgttacatctgtaaaatgacttctaggtttcttataagatttgacatcctatgactgccttcctgtatttaggttagagcagtctctggtttaggagggtcacacagcaggcatgtccttctctagcattagtagcgtggtcacgaatatgggatgtggagttagactgccgggattcaaatctagctccacccactagcagtgtgacctgggcaatttatttatctattgcagctccataagctataagcagggaatgatgttacaacttactctatagggtgaatgtgtcacaacctatcccatgggctgggagtatcacaaaatatcccatagggtgggggtgttctggcctaccccataaggtggaggtgtcatgagctaccccatagagcagttgtgaccagtaaactctaaacagcctggcacatagtgagccctccttaagcattggctaggatcattatcataaaatcactctcatccttcaaagtctaatttcaatgtgctcccttctaaaataccttacttggctaccttaaggaaaaaacaacttttccttccttggacctttcatagcaaagtgaatagactctactctagcacctacatttttttccccatcttttcttttttaaaacatagttggtacccacaatgtgccaaatactttcaccataaggtttctcatttaagtcccgtaaagtaagagagttgttacctatctcaatttacagatcagaaaactgaaggttagtgcagggaaggggcttggccagggtgacacagtttacaaatgacagttctgtaacctcctccatgccttccgagtctgccaccccacagcaatctttcatattaattagttatgcagcccatctctcaaacttgttcattgtcactcagggccacggacagctgatctttatttctggaaccagtcactcaatgttggacacactgtaggctcaaaatcaagcatgccaaatagaactgccgacttgaacttcttactctcatgacatcatttccttataaatcctaaaaaactatagtgattataagtcatgttaattcaacacacaccttttatgtatgtaagaggttaacgaatggctgctggcttccttataggaaatactatattgatttctgccaggtttttgtgtctcctctgtgccttaatcactttctagtttcatctgtttatggaaataggcagcctgggctatttggtaagcaaattgataggtctattctatgtgggtggtaatatgagagtccacccagatcccactagctcttctatggaaatagatttcttgttaatactgactgggtttaggatctcattttactataaaaggttttttgtttcaccttcccaactgaattttccctaaataagcataagaagagcagggtttgctagttgttggacaggcatttgacttaacagtaagccctgtttatttattgtcacaatacgaggggggaagatattgcatttctaaaaattaatcatcagcaactatccttctatatcaagagagaccacagaaatgttttcaaattagaatttaggccatgtagaggagaaaggagaagtataaggaagggacagaagtaaatagaaggagaaaggcaagcccaagcctgagcagaaaccacatggtttatcttagaagaaactgatctggaaatgaaaaaagcttgagtcatcaaggtggggtccttcaagactgttaggaagcctcagtagcccagcttagggagtggagctttgaaggactgttcctcttggatgggtacctcaaaaacgtgtggcttcaggtgtttgttacacgagaacaacatattacggactcaagtgcacagtatgtgaacccatctttgagaaaataagcatatgtacataaatatttgaaaagaaaaacatctagagatgtgctgtgtttttcttttccctgtctgtatctcttggctttatagaataaacatatattgcatatgaatcttaaaatgaaagcaaaaaatgtataaagggcaggattttgaaatgaacaattatgttgaaatttcacaagttatatttcatcagatgcaacaacgcttgtaaacccttggaggtttactggagaaggtgcttgagggctcaataccttcctttttactcaatgttcttcctttcaatacacagaggcaactttgtgaatttgtcagtggtctctgtgactcatcttattaattttttatataaaattccaaaaattctcacctttagtgtgatgcacataaaagttttatttttcttttcttcttctttctttattattattaattttttttggaagacagggtctcactctatcgcccaggctggagtgcagtggcgtgatcctcctgcctcagcctccctagtagctgggactacaggtgcatgccaccatgtctgctaatttgtcaaaaaaattttctagagacaggatctcactatgtttcccaggctggtctcaaacttctgacctcaagcgattctccctcctcagcctcctaatgtgcaatatgctggggttacaggcatgagacactgtgccctgcctaggtgtgaaagttctatagacagaaaaatatgtataccagcacatagtactgggaaagactgaatagcaccttggacattgggatttttacatttttaatacagtgttgttaatgtcacaaatcaattcagcatctaaaaaaattaaaaagtaaattttctattcaactaatcagatctatttaattagcactctgctttgaggaatgatgtttcagctgtggatataaaaaattgacaagagttttcacagttttctccttctgcttcattagtaaaatacggaaatataaaaggcaaaagtaccctacaaccatgtccaatgtgatattgcctccccaaaggaggctttcactcaaaaaaagtagaccctcattgtttccataagtctccgagcaaattctcttccggccacagactttggatgtagaaaataagcttatctgggcaggtggatatgcagagtttgcaatggaagcaaagataaaaggaaggcatgctactcttacctccataggctctactctaccctgatctctgccctgtctttgatcactgggcaaagaaaccagtgaccatggcaaatagtacccattgtactcagaagaaacccattatacttttgtgaaagaattatcctttttaaatagctaaaacaatatcccagggaaaaagtaaccaagactttattatattgaatggataagatttccactacttctgtctaaaaatcaaataatgcccttggaggacattttaggaattaataaataatcttttgttctacatagtaaataataaaagctggttttcttaattccactttgagagttgtgtggtctatgttaggaggaaagctggctggagccaaccatggttaattcaatgccaggctgtatttcttagtctccctttcatttcactcttctgccatagtgggtccatcatactcccaggccagtgagaagtgccctctagtgattggatgggttcgcttggcgcccgcctccatgcagacagagcaatgcctgtgtgggtgcttcctgatcaagactgatgagtgggatgcaaatatcttctttttaatgcatgaccctggcatagccagagggaatatgagtgatggtgcctcaaagcagtaactttttgcttagagcttgagagtcaaagttaaggacccacatgtatacttcggctctagcgagtctaaggtgagtaaagccttcagattatcaataaagaaagattttaactattgggcatgtgaattcaaataacgatgcaatttcacaaagcaaagaagaacataagaaagtttgtttctctggcctactgctcaacattgctacttttcatgatcagacctgatattagactgagggttgaagtaactgtcttagtagaattagaaaattaatgcatttatttttcagaaataccttaagttttaatgttttacatgattttgggataaaaaggaagagtctttttactttgtaaatgtactcattttttcagttcttttaaatctcttttgatagcatctgttagtgcaccctcatacattttcctcattttatcttatcttaggcatttactttgattttaaattctcatagatattgaaaattatacctgtgtaatttatgttaaagatctggccatgatcaggggctgcaggtgttatttacaataatgtcagtgtctcatagtggtttgggtaatttggtcaaattacaggccgttacttcataaattgtgagctgtctggagttaaattttctgaagttttattatatccaattcaattcaaccaacacatatagaatgtttaaaaagtaaggagcattttgataaggtggtctggagaatggggcaaagatgatgaatttattatccacagtgggaggagtcaaaagtataaagtgctttttaaaaatcaacatatttataaaacccaaagcaaaggcagcagaaaaactgtagctattgtgtaatttattctataatcctacatcagtctcatttattaaaatcagcatttatattatcccttaataggaaatcgttgaggaaaagatatgaaggttaaagagaacttacctagatgctgcaaatactcattttaattatttattttgtttaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatggtgagacatcatgtgttccattatttttatactatttattatttttcctaagtctccacaaagtacttgatcataatgaaagaatatcaggtttcttaacttacactgtgaagatcctcttctatccacttatcacatgaccttttcttaatgaaagtataatgaattcaagataaaggattttaaaacattagttaactttactaaggcaaattataactttagaacagtggttctcaactgagggcatttttgctccccaggtgacattgggaaaagactggagatattttgggttgttccaactgggggataggaacagtaagtgttaaagacatctagtgagtagaggccaagaatgcagctaaccatcctgcagtgcacaggacagtcctcacaacaaagaattacccagccttaaatggcaatagtgccttaaaacaatgctagaaataagactattcctgtacagttgagaattctactatagtaaaaacactgaaatactgtcataagactgagccaaaatgaagatgctttgcagaagttaaatcttgattttcctgagtatattaaccacatggtaggtgatttgaaacacatttcaagataatcaaacaagattattaaccactggaatatatgtgtttgtgtccagactcaaggaatagattatgttgtcattggattttgactattacggggtaataggaagtgactctccattgcccaccccccaccccaatctccctctcaggcataacttgggctttatgcctttccttgtgcaccatgatgtattgcaggaagtatcttacattttgttttttaattcagaaaaggggcagcagaaaaggatccattgaaattaagaaaatcagatgtgtggagaaagtaaatctcgaggagcagacgcctgtagagagacagtacccatttcaggtaaagggaagaacgacattgcattgggtggatagttcttccttcaatttttctatcgtgaactcaatatatctaggaaaaataatgatatttcaaaataatctaaacaaggcttggaatattcccacatgggagttgggcattttgctaaaattctgtccaccaatctgccttccctggagggaagggaagggaagcaagacaggagcgtaagtcgcagtgacctgacctgcctcaggtctgatcatctcttttaacaaacattgctgagtatctccgatgtggtacacagtagtaggcatactatggggaacaaaacactgcccctaccccaaggcatttacagggaagtggcaaaatagactaatacacagaccattacaaagcagtgagggtgagagttaaggtggaggtcagcagaatgcatccatggagtcccaggatgtggaagtttcattcctcactccaagaggctagagagatattctattggaggtgacactcaagttgagaaggacaagtaaaatttaacccagcaaatatgagaaggacagtggtacaaaggaagcagcaggtgtcaaggcactgatgagtgaaacagtatgacacatttagagagcactaagtagtccctatgaataaagaagcccatgtgacagtgaaagagatagcctggagaggtgaccatgctaaggagttttcattttaccctgaagtattttaaacaatggtatggtatgtagtgtatgctggtagtaccttttggaagtggcctaatctaagtcatgccctacttttcttatagcataaaatcttacatttctgatccaaaggtagatggattgtctttcagatggcctgactacccagtgctagtattaggaacctgtggccaaaaatgaaatacaataatccagttgattaacaacccatacttcccatttggaaaaaatattaccaggccaggcacagtggttcatgactgtaatcccagcactttgggaggccaaggagggaggatcacttaaggctgggagttcaagactagcctgggcaacatagcgagacctcatctctacataaacattgttttcattaaaaaaattacccaattgggggaaaccaggggagggcatgctcatggaagatgctgcaaactcacctcatagaggcatagtgctcaaaagatcacaggctttggagcccccagagagttcctagttccaccacttatacttgtgcaactgtaaacacatactcaacttctatttctcacagagttgaaataagattaaaatactgaagtagctaggaaagagcccagcaactagtaagtgtttaacaaatgctgtgtatatttaccaacaagagttgaataaactagagaaggatctggagaagatattgtaatcttcaaacgtttaaacatttgtcttaagaaacagaaaagtatatattctggagattcctggggtgccacatgatgaaatagatgaaagtaacagggaaacatatttttactcaatgtaagtatgaactgtataatgatcagaatatatggatattggcagagatgacatagcagagtaaagaacattccatccctgaaggtatttttaaagatagagcagttaaacattttccagtgggctgtaaggaaatcatgcactgggtaggcaaatggaccagaacaatactaagacacgtgtaatgtctaacatattaatgtccatagtccagggtgtccctgatgagaactcagtgttcaccactactatgaggtacatcatcgctgtaattttccaaagtataggagtgtctgggataaaacaaattgataactggaggattttttaagaaaatttttttcatctaattccagagctgatgtatactgtataagcaaactcaaggtttcttttggatgacaaaaaatttgcaggtgcaccaaagtgaagtatggtgcaattatatataaacacaccaaatattttcctttccagattgtctataaagatgggcttctctatgtctatgcatcaaatgaagagagccgaagtcagtggttgaaagcattacaaaaaggtaattcaaaaaaagaaatgttgaaagagaaaggtcaaaaaaagccataaaagagagtcgttttttgaggcttggtggaggaaagacatggcagtaaaaagactcaatgccaagagacaatctactgattttcctaccaacctcagggaatgtgtcagactcatcctcatttttgctttctcattgttacatacaggaagcctgtggattggattccctggcccacacaaagccagtattgtgccttcccagcagcttaggggaagccaggccacctgctctccactcagtatgcttgcctttaccaggggaaagtctaggtcatcatggggctatgtcaagtcctgtagctaccacacttttgatgtttatagaaagttacatctaatacttatactgagcatttaccatttgccagctactttatcaaatgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatgggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaatataataatgattttaaaatttaaagaataatacatatgtacagagagaaagagatacagcagatgtggcaatcagttaataattggtgaatctaggtaaaaggcatatggatgctcattgtattaatcttattcttgcaacttttctgtacatttgaaaattttcacaataaaaagtagatggaagtgtatgtttattcaggccttttttttagaaccttttgctaaaatttagccccacccttccccttctgccacaagaaaacaccatgtgttgtaacccactcactttctttacagatatatctctaaaatcctaacatcaagctgatctgtatatgcattttactagttattttttcttcaaaaatgatatgtaattgtgttgttctcaacatactcatggttagacttttcttttttctttttggcttattaactgttgagtgaaagacctatatccttccggaaccatttgctcttaccttggttgctggccaaatggggtttttattgttctgtgataacagcacttactgaatgtttctcctcttggatcaacgtttgctaacgtcttgttttcttcctgtctgctcctcagagataaggggtaacccccacctgctggtcaagtaccatagtgggttcttcgtggacgggaagttcctgtgttgccagcagagctgtaaagcagccccaggatgtaccctctgggaagcatgtaatgtgtgattcctctgttggactggacgttgggtggatagtgctccattaggctaaacctgccagaggccagaagagcttgccagaaaacaagatgtgccagattggttggcatcatgaaaattcagccttgcagatgctatgtgacaaatgaaatctcattctagggtcaattgagtcatggccattaagataataacaatattaacatctgccattctttcatttcatgagaaacattttaaaaatttgaatcattaatcaagcaatgagctgttatttcctcccataatttttcttggttcaagataaactccaaaaaggtagaatatgttagatatgtcatcatagttcaaacagctaggtttccagtttggtaagaaaaccagctcgctcttcgtataaataacgaaaatcacaaactgaaaaaacaacattattaaaaaaaaaaaagatataacttaagtaacacttttcatcaccatgtatactaaaatgatggtcaaattttaaaatatatatttaaagcagttcgccattctctatatgtgtgttaatttcttaatgacatgagagaaggggctgctttacgtgaaatcagattctatccagagttgtactcccagggaaacaagagggacttatatgtatttaaagtttataattatttaacataaagttgttgataaatacaaaataggataacttattttggtaacagttttaccagcctggacaaaatatgcctggattacaatggctttaaagaattgaatgagatcagctacaaaatagaacttcatgaaatggaaaagatacaggcacataaaatattttttaaattcacttcatgacagtattgatacccaacaatcatgttaatgttaatactggtcattttacccccaaaaaatcaattaataaatattcattgtgttttccatcttaattagactatacagtgaatatttattaatctcaactagatcacattgctctatatactcatgaattatagttatttaatgaactatacagattggttgcacatgggtcttcgctccactgtaagggactgaggagtaatgtctccttatggtattaatcattttccccagtggttttgtctatggtctatttggtctattatcattacctagcaggtcagattccagctttgacaatgccctaactttctggaaggagcaggaaaaaggccagagagagcactgccttgggattgccttcctaggctctgtctggatgacactcaccatgtgttctgggtgccacaggtgctgtgcctctgaggaaaactacagagtgtagaggtgttgcagctcctgagcagctgtaatactgtctatctgtccaagtataatttattcccttggcttcttctgctgagctactgggaagtccatgggcataacaactaaaagagaaaaagttaggtgtctttatttctttttgtccaagatgccttgatccatcctctttccaggatacatggcctacataggagttgggccttatataggaaagctacagaatcactccagatgttgtgtctggattcacttaatctggagtattgctcacacaagctggttcattcttttaattcataacattgagtgtttctctttgttttgtttaaagttccttctgatattactttgttttaatgttcagatgctaatctgcatactgcagtcaatgaagagaaacacagagttcccaccttcccagacagagtggtaagtcaacattttaaaaatgtttttcatggtcaggatatattaaataaaccaagagttgccagattcaagactagaaaatgtggaattcatttagacttctcagcaaagagagaaaaaccatgagctctagataatagctatgggtggtattgaatagcggattcaaatatagaaccattgtaatatctcatatttttgcatttcattgttgtgtcttttcctagccagtaagcccataaatagtcaccaaaaaaaaaaaaagaaaaaatgggtgcatgcgggagatgtccttaagatggcatcacacataacaggcagctgttattagctgtcattctttccttaccatcaacatggccaagactgctttgtggaagtatcctggtgttgaaatgaaactctataggacaaaagcagaaaacaacataattctttccctccattatcccttcaaagctattcagtgggctttcttccctgcttccaaataaagtctttgccaaattccatagttttgcagtcattctcaaatgataaaaatgtccccattacttgtaatcataagaacagcctctgaattgttccatccaatgttattatcacatgactgcaaacatcattccaagttaaacatctgtcacctagcttgggcctgcatcacctggcagcatgcttttggggagggattttgggggggctgagattcatggccctttcagagttagttccaaggaagatgaggtctaattaaaaaaagacacacatagctgtttctatcatgatttggtggtggtggtatcggagtgagttttccagcactgattctttatctcatgggagacttttaggaatttcctactgaagggcagatccatatgtagttttatgacaggggagagatcttgatcctcagttcttggattttcagccctcaatctttcaagatggctgtcagccaactttttcccaagagtggagttggcctataagaaaacaaacaaaaccttgattgctctggttaattaagctgtatgtagctctctctcgaagtacaggctactgctgtctttttgctctactctcttgggttcatagccacagccttctgtttttagggttcccaggcaggtgtgagcctcctcaaatgccaggatacacaaaaaatggcttcccattggttctctggaagttcacctgaaagcaaggggacatctccgcccatctattggatctatggtgtcttgggtacttattttcagctacacacattcgcacacacttctctctttctaagtaaaagccacataattttcatgaatcaacatgaaagacaaaaataatccattattgtagtagactgaataatgtcccccaaatttcatatccatgtagaacctcagaatgtgaccttattggaactaggatctttgcagatgtaattagttaaagatcaagatgaaatcacacgaaagatgagagtgggccataaatccaatgactagtaagatgagaggacacagagagatacacagaggagaaggccatgtgaagacctaggaagagattggagttatgttaccacaggccaaggaacacctgtttcttagtccatttgtgctctactaaggaatacctgaggctgggtaattgataaagaaaagaggtttatttagctcaccgttctgcaggctgtacaagtagcatagcactggcatcggcatctgatgagggccttaggctgcttccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcaacataaaatttggaggggtcgaatatccaaaccatagcaacttggaaccaccagaagctggaagaggcaaggaaagattttatcctagaggcttcagaataagtatggcaatgctgaaatgttgattttgacttctagcctctagaactgtgaaacaataaatttttgtggttctaatccaccaaacttgtagcaatttgtcatggtagccctaggaaacaattataatcgttaggagttttactttgttattagcaacattgctgtttgggtttgaaaatatgtttcagtcctgaagcttgaaaagtatggccctctaaaacacctaggagaaacgcccagattaggcaaatctatagaaacaaagggtgatcagtggttgcctgggaccagagtagggatgagaattgactgcaaataggtatgaaggatcttattggagtgatgggaagactgggctgtggtgatagttatacaagttgataaatttacaaaagtcactgaattctgcactttaaaaaggatgaactaccaataaagtttgttttgacaagtctaagagcagaagataattaagagccagaaaccattgcatctagtctccagcagggaactttttggccaatatattgaaaattatcagctaggcaaatcagtggctaagggttcataagcctgttttgattataagcttcccaaatgaaccagggatcagagggtatcatgtaaagtatgtttttctttgttttgttttttatcagagtattcagtagagggcttattttctgaatggaggaaataaaaatcagctctctagttgttctgttcaaagagatttccttaaatgatttccatttaaggaacttcctagtgcatttttctttggacataacccacttcacagctcataaataacactgtcctgcataattaaaatttccagaatgtcaaagccttaactccaagtaaatgaaatttctgaaaaactaaaatatagcatgaaaaaaatattaaatgcatctctttctgtcacacacgcacacacagacacacacacacatattgtgaatttttaactgaaatataacattaacatagaaaagcacacaaatcctaagtgttcagcttgatgaattttcacaaactgaacaattctgtataatccaccctcagataaagaaacacaacatcacagaaccccagggacaccctgatgttccctttcagtcactactaccctccaaaagtagttgctaacctgatttataacatcatagattgtttgcctgattttgacttttatatgactggaattataaagtgtgtagtcatttattgtgtgtcttcttttcttcaatttgtgagattcgcttatttttttagtatgtgattatatttaccgtcatcattgtatagaattcagttgtgtgaatatacaactgttttggtttcttattactgttctaacaaattactacacaaatttagtggcttaaagcaacatacatttattctcttatagtttggaagatcatatgtctaaaatgggtctgcacagctgtgtttcctctggaagctttagggaagattctgtttccttgcattttccagttcctaaggggtacttacatttattggttcctggctccttcccctgtctgcagaaccagaaggttgcaggacctctactctctaacctctgcttccatcctcacagctctctaatctctgaccaccttatctcccttttataaaggccattttgattacatcaggcccacccccacaaaatccagaatagttgccccatctcgaaatccttaattacaatctgcaaagtctcttttaccacgtaaggtattcacaggttctgggaattaggacatgaacatattcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcatacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaaggtaatccccagctttcagacgggctgcccagcatgtagagtaaacactaccccggctgccctggacctcagcctcaaagctgttgatccaggtcttaggctgtcctctcagaaaatgttcagtgcttgagccagaagtctggggaagcagtggccccactggggctgagaagcatagattttccatttagattatccaatctaatgatctcagtaatgcctgatcattgtattcccttccctttctcctccttctccccccaaatatctccacattccagaatacagaatctttaaaaatctatcctttatatgaaagagcttaggatgggcttacttttgtaatgtgcttcagtatcactagccaaatggcaaatagcatttcaagcaaggccatggcttgccttcttggaatgtacaacctcacctctcctgacctgattagtcttctcacagtttttagcctaaagattctatctaaagccagaattgaaaattccttgaaggcaacatgtaaattgtgtatgtatgtatctcttggtatggcactgaatttgccctacacttgatgcccaataaatgttgaattgaattgcaagatgaccatatggaaagggtcaagtgactccccttccttatttcctgtctcagacctccttcctatcatgttgtctactctctgccatcttctcactcagttatcagcatccctgcagggaagtcatgtctgcctttccccacaatggatacagagcatctctctgactcaccatgtatctcttttcttagttatttttcccatgtccttttattcctttgttctttccatcttcatcatttttgcctaaagccaattactgaaagtttcaataatacagggccatatggaatttgaaataatgtaagtgtgttcttcttgattttttttcagtataataagccatggtccctttcattccaaagtggagctagaatcctagtgtattaatctatacctggtgcccaaggtatggggttacatttgtgcgcctgcagcccaccattcttgtggaaggagaggatcagtaaacccagttgcaaggagagtgaaagtcatgttaattgtgttccaggtccccttcctgacagaaactccagtgattcattgagagaggtgtgaggtgaagctgactgccctgttttcaaataaccaggaggaactgtcgattcacatggggttgctgccattattgagtttttgacactcctttagatttgcacctccttaggtttagtcccaactgtggattttccctagaacttcaggaagctagttattttaacaaaggattgattgatcacctcttagcatgagcagcattgcatctgcaagtaaattataataattgctaaaaggtcttcatggagcttgactttttaaagtgcagccatgattcttatctcatatatgggataatactttttatcaactttctgtcattcttacaatcttccctgagcttctttttaatctactttctgtttagtaagataatctatgcccccattaaatcattcaaatattacagaatattccatttacattcccctaaaatgttttctatgcacatgtggccatgtgcatacaaaagcaagtaagttctcacgatacagtctttgtcatttgttcttttcacttgacatcttcagcatttttcctatttgaatacatgaggatacacctgacttttaaaatttcattttcatttaattttggtgaaatatacataacataaagtttaccatcttaattatttttgagcatacagttcagtagtgttaagtacatttacattgttgtgcaaattgcctgattatttttaatgtctgtaagtaccagttgtatagatactaggtaaacctaagtgatgcactattgatggacattctctaagtgtttttagaaacaacaaggctaaataaaagctattctagtgggcaaggctctttgggaaggtggagagagaggcattttagagtttaagggctttatctaggcattccttgaaatagagccaggggagcatttccttgctaaggaaacttgtttctatgaactgtggttttgaaaaaagtctggactatgaaggcaaacaggaaataggttccacattccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttaagataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgtgaatcacaccacctcaaagatttcatggtaaatcaaattcagatatctcctacatccagaatatgcttccattttcaggaaaactaaccaaacttgcaataattttgcagctaggctttctacttaaggtaaatataaaccaaaaaagtctatgtagtttgcctctctgaaccctgaatggatggcttttgggttctagtttttcttgaactgactattcctagccagcatccatgacatacaccagtagtagcaccaacattagtatacctgacccaggcatctctagcaggaagaaaagcaacctagagttgaataactcttccataagaatagctatatacacaacccaatttttttttaacttgatactacagccatctctgaaggagtcttcatctatttcgtgagcccactctttggaaaaagtcaaagaaatataagttcttctgggggcctcctggggatctcctgtatcaaagaaccattctttcattaaaacttggcataagcccaacttttgagtgactctctctttactgttgctgtgttgatactttgccaggtgcagaaggagaaacctaacaatctaaatgttatttaggtggataaaatcagggtgggatttgatattgcatggctacgcacttggattatttcttggtgcttttctgcactcacgtttttctcaactcttcttaagggaattccctgagtcaagttcatctgaagaagaggaaaacctggatgattatgagtgagtattgaaagtcttctgggttcttctaaaattagacatagatacttctactctcttcctcaaagacattaaaacagatggctgagaccgtctcaggaggctgtatttacatgggtaaactcacgtaatgttctgggtcatttatctagatgacaggtgacaatgagctgggttgttaccaacgaaaatattttccccaaaactggattatctaaattggatgcaaatacttattggatttatcgtatgtccagcgtcaccttcatttcactttacctttgtagatgtagcatataatgtttctgctcattatttctttcctggagacctctaattaaggtgatgtttgaaagctcttattaacattgagtaatatttttggagaagttattaatgatgcagtaattttacagggtagcacaaatgagaccttgaacatggcaatatttatgtcgacagatctctattcttaggatgaccttgtcattttttttttttttttttgagacagagttttgctcttgttgcccaggctggagtgcagtggcatgatctcggctcattgcaacctccacctcctaggttcaagcaattctcctacctcagcctcccgagtagctaagattacaggcgcctgccaccatgcccagctaatttttgtatttttagtagagacagggtttcgccatgtttgccaggctggtcttgaactcctgacctcaggtgatccacccgcctcggcctcccaaagtgctgggattacaggcgtgagccacctcacccagccaaccttttcatttaacatcaaaattgggatactttagaaagagaaaaagtgcactattaaaaattatacccgttaataataacttaattatacattttaaaataacttaaagagtataattaattgtttgtaactcaaaggataaatgcttgaagggatggataccccataatccatgatgtgattattatgcattgcatgtctgtatcaaaatatttcatgtaccccataaatatatatacctgctatggtgagccgagatggcgccactgcactccagcctgggcgacagagcaagactctgtctcaaaaaaaaaaaaaaaaaaaaaaaacaacacaaacacacacacacacacacacaaatatatatatatatatatatatatatatatatatatacacacacacacacacacatatatatatacctgctatgtactcacaaaaattaaaataaaaattacacctggacatttgacataaactggacttctgggcaaataagaacgtgtggtcaccccaactatactgagaaggttggcctaagtggctattaaggttctttccaaaatctaagggtctatcattctacaaatagggacaaataattgtctcctagatgtaaagattagtgttaagaagaggtgggaataatagagcatattgcatttctcagacacttgataccaaatggcacagaattcacttgaacactaggattatgcatatttccagttctgtttttgtacaagtgttgtattattgatttattgattacatgtgaaacgagagcttttacaaagtacatgctactgttttcactcctcctctcatctctaacccagcctggtcctagccatacctgttgcattggggaagatgtgctgtaccctccacatctttgtggcatggtctctttatcaccttctagctctctttcggctttactttcttccctaacatctattctcaggaaagcattgatggaataattcatactaagacataaaagactgagaatgaccaacgcatggtcatttccaaagataattgcactttaatgaaacacaaagacttaaaccaatgggagtgaacctctaattgtggattgtactctttagcatttaaataaattagaagtctttccctgattgggtaagcccagatatgaccatttaaacagtctctattcccatcttttctgaatgcaagtggtgtgtgagagacagacattgaggaaattatcagggaagacttgtcctcttcaaaatcaaaaagataccaaaaggagctcgggattatagggctataggatctgggactcagtcacctcacattgtgcttaatgctcccagcttcctattctatcagtgtcatgggagtttttgttttatggccataacttcatgagcaattccagtcaattccattaaagacagaagcactaagccctgagatttagatagaaaatcgtgtgttaagactaggcctggccaggtacagtggcacatgcctataatcccagcactttcagaggctgagctaggcagatctcttgagctcagaagtttgagaccagccggggcaacatgacaaaacctcatctctacaaaaatacaaaaattagccaggtgtggttgcccattcctgtagtcccaactacttgggaggctgaggtgggaggatcacttgagcccgggaggtcgaggctgtagtgagccgagatcataccactgcactccagcctatgtgacagagtgagaccctgtcaaaaaacaaaacaaacaaaaaaaaaccttaggcctaggactctgctgctctgtcattgaatactgaaatattatttaaaacaataagaggcaggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatcctgtatcacagcccctgaagggccttttgattagctagtattaccttaaaatgttgactaataagaaaaacgatcagttaaaatttcaagtgttagttatacagtatccataatggtagagttaaaagagactttcaaacttatcaagatcaaccctctccctagttttacaggtagggaagtccaaggtcaaacaaggccaagtggcttgttcaaagtcatacaattacacatagggaagttatgcctagaacccagacctccaagctgggtgacctaaggctctttctattttattgagctgtccaccagctgacatcccttcccaaaactcatacagagattatacaaagaatcacttcccatccattcctgccaagttctgagataccttctacattgaatttctcctataactcctcccttctaccctcacccccctcttgtacttatttcctctgcagatgttatcttctagccagtgggtcctcccactcacccaaacccatgctacatcccacctcatgccctgcttttactcatttcctaagtaggacattctgtctaaagcccaaaggccacagacattattgccctcacatgagaaacagctcttggcctgttgagctccacatataaagtaaaagcatttgatgtgaaaatagatgttataatcagattattacaaggaaattatatgattggaagacaagagctttcatccttggcagccctgactttcctcttggaatattcttcataggtctaatctctagcccttactcaaaatggtaaaatgtaggaaaacttagaagtcacctagaagaaaaccaaagattcctaaatgccagcccatttaaaaattagatgtgcagactccaccccaacatcagaatttagtagtggggacttaagcatttgtatttctgaaaagctcctcaaatcattctctggagcagttaggcttggaaacccctgaggtaagccaatgcctcattttacagattagaaagttgagtgtcaagctatacaatctaaaacttattgattctcacatataatttttttccttttgcagctggtttgctggtaacatctccagatcacaatctgaacagttactcagacaaaaggtaaatagtcttgtctttaaaacagcctcacagaatctctttgcattttggggtccagaggttgatgcatttctcatagaaaccttcctgctaattatatagtcaagtcattgtagtgttgcttgtccagtctgtgggttgcccgactcttcatgtctagccactacttctgtgtccattatgtattgctgcataataaaccactcctaaattgggtggcttgaaacagtgggatttatgatatctcatgattctgtgagtcagctgggccagcagttcttaggcaagttttgcttaggggcactcctgtggctgcatttgggtcgtggattgactgggggcttgggtttagctgaggcagtcaactggagttccacagttcttccccaagcagtctctccatgtgcctcacttgggcctcctcacagcatggtgatctcaaggcagtagttgaagaggacgagccccacagtgcaagcacttttcgagtctctgcttttgttgtgtttgctaaggtcctattggtcatagcaagtcacatggctcagcccagagtcagtatgggaggggactgctcacagcatgaataagagagatgatttatcggaggccgtcaatgtagccattaacctcagctctgtcactgctcgttagcacctagaccagagtatagcagatgtgatacagaacatgtttatctgactttattactaattgatatggaatgccagtagcaaactcttttgatttctaaaaatgacactttgatatagtttaacctgataaaaacactaaacattacacttatttctttgaggggtgctagtgagaatgtaatgacttcatttggcgttttgtcacattcatagtttataatctgctctttctgaactttgatctgcttagaattagcacaaatcattgagaaagacaacttgagtatagaactttatcaactgatttattcttgatctttggttttctaaaaccttccaaaggcatgatacggtgatacacggttctaaattgtatttcttaaagatgaaaacattaggcttgcataagcacaacaccgagaaaagtaagtgatagggttaaatattaattggagaggaagagttcatacacatacacatacacatagagcagatctataaagagattgagtgagaaacctgtgccttttgtgatatataaagtcaatctaaaagatttgttttccaactacctaccatgcaaaatcattttcaagaatgatgaaaatattttctattccttctatattttccttccttttcagggaaaagaaggagcatttatggttagaaattcgagccaagtgggaatgtacacagtgtccttatttagtaaggctgtgaagtaagtatgatacggattaatttcttttctctttctgcgtatattctttgaatatgctggtcacaatcacattttgggataagacatcatctttaaactctggaattttaaatcaaagtatttctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaagcacttaataaactaatagtacttactattattgttgttgttgttgctggggaagggtagttctacctgctccactccctgtaccctaacacttgggcataaaagacaccccacagtcatctcatgcaaatcatcatcaaaatccttctccagagttttacaagccactttcttattggtagttagctctttttttttccttctaatcgtcctccaaagcaaatgggaaagctgtttttatttataccatattgcagatgagaggattgaggttcaaaaagagcttataaagacctacctggagctactaagtgactaatttgaagctgggcttccaatagccaagtcatgtttctttatctacacctctgtgtttacactgaacccccagtgttttggaatgagaatctggtcaaatattgattcggatcttcttttaaatttctatgtgtgcaactcttttttagcagctagattgaatgatcgtctgccttggtgccttccccatgtgccctaccccacagtgcatatatgtatatttataataattaagtaataaaaacgttattttattttgaaattttttacagagtgcctacctacacttgagataataggatgtacctgaattgtcccacagcactttccaatgccagaatccatgtccccagtgtatctcatatattattttgcacatggtaacacctggatgctggctaaagccaacccagtaagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcggttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtggtatctggttttctgttcctgtgttagtttgctatacagcaacaatttattaactgtttcttatatgccaggcataaccatataggtagctagcaagtgatagaactaaactcaaagcctggttcttgaccactatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcctgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatttcaagactgagaaaaacaccagatgccaagcctgagaaaacctccctgacttccctctccaaaatttgcaaatgcacctaaaataattatttaacccttgcttaatcaagctttattgtttattttaaatgttctaacattctttctgttactagtgataaaaaaggaactgtcaaacattaccacgtgcatacaaatgctgagaacaaattatacctggcagaaaactactgttttgattccattccaaagcttattcattatcatcaacacaattcagcaggtaacttattttagtttttcttttatgggcccttgttgtaaaacagcaattttcctggatactactgatcctcctaatattcttaattatatagggaaccatgaaagtaggaaaaaatcctctcaagtcttttgcctatcataatttttagcttacattcccaggaatataacatgattctctccttaatgccagaaagaatgaaattgagtaaactgggtgacttagaaagagaaattctctttataaaaatattcgtagggtttttctgtgtatagaagcaagaggattataaatttaaaatattatagaaatatatacatatcgttggatcatggaccagttgtctattatgacagggttttttgcatgctgccactagcacttactaatcattacatatataaatagaaattatatattatgtatatacattacatttttacagagatgagatcattctacacatattgctcagcttgctttctttactcaacatgtcttagaagtctttccacgcaaacacaaagagcttactttggtctatttaacagctgtgtagaattctatcatagttaccccataatttattcacctagccctctgttgattagcagttggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttctagaatcaccaagaagatcatcaatttgttttcttatcagaccccattattagcctccagcacaccattgtctgtcctatctttttcctggattttgtgcccactgagcagagccagtattcaaccttgtgtgttaggacgatcacatccactgcgatcacagtttaatttttttattaaaaaaatctgacaatgttttaccaatctaaggacatcgagtacattttgatgctaagcctctccaagatgcctctgattggcaaattgtttttactctgagccttcttgttaaataactgtagctacttcaagaatagtgttaccctggtgccattatcacgtagccacaagaccacatcactaagggtttttttttttaacttatcaacttaaaataaaaagtcttgtttatattgtcactgtgaaactcccattggagaagaaatcacttgggaagctgttagccccaaagctttctatgctcgtcctaaagaatgtccgtcttgccttgttaggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgtaagtttttcccaaggaatggctgtttagccctcatcatgggagggcattagcactaataggcctgctgttaactttgcaaggcctagagcaaaagtccacatactgtatcatagacataaatatttagaagttataaattgaactaacagactattaaatcaaatcagtcttatgctcctactttgacaaatataccttcataacaacctgaaaggccatattcaaattgagaattcccaagactctacaaagaaaccagcctctggcctgtggtcttccaaactccacccctcctgcttctcccctcatacccaactccgtcctgcactataaggggcctcagtagttatgtacagacacagcattcagtacacacaagctccctctttgtctcccgcaaacaattatctagtggctaatgatcttggctaggggtagtgtgctttacccttaagcggacagactccttaaggaagagtcagcacaggtcctgaaagaggcctcaggactatatggttgggtgatttcagagtcctggtgctctaagggtggcagagaaagggacatatagggtcggagtaggcatgtctccttggccctgtggcctccttgccctgtggggaggtgcatggtgggatgaagaacagagtggggctaccacccagaactaatgcagtactgaaaattaatgctctaccaacaatatccttttccttcttggtaccttcaatacagtctaatactcttcctaatgtgtctcagctcccagcacaacagccttcaattattggcaatacatatgtgttctctttccctctgtgtcttctctctctctctctcttccccctctctctctttctctctccctctctctccctcttcctctctctccttctctctctctctccctctctctccctctctcagttgtatataattctccctcttcttgtcaacatagtaaatcagactttgtagagtgaccaccattcaggtttgctgaggtctgggaggttttagcactgaaagtcctgtgtcctaggaaacctcccagccccaggcaaaccaggacagttggtcactctacttttagagaatcaatcagtatggtatgaaaaatgatgttatagtaggtctctggtcaaaaatagttgaaataaaaaaattcctagcctgctagagattgagagcactttttaaatttttacttaaacagttatactgtacagtgtttacaggcatttctctaagcactttacaaatattaactcacttaatccccataagaaacctatgagggttgtaccatcgttatcttagatttacaggaaaccgaagcacagaaatgttgaataacttgtccagagtcggcaagctagtaaaagtcgaaaagcagagatacaaacccaggcagacattctagggtccatttctttagttattcttttatgaagaccaaaggaattaggaaagtcagaacaatcacttttaccataattgcaaaattatttggaagcagagatgctatgtgaatataggcctttggccctagctggcttcatgggcatatgagatctgcacagttgcaagggcctagaagtacctagtacctagaaggtacctagaagggcacagtacctagaagggccctgtgcttggtttaatgctctgctgttgtcatcttgaagtaatacttcgtgatttttaaacaaggattcctgcattttcattttgcattggtgcctgcaattatgtaactggttctgccttcagtgattggactgtcataaaactgggaagggggcccctgatattctcctcttgtaggacaggaaaatctggcagaaactttctgccagatttttctcatggttacaggctcatgatgtaacctctgtgtcttggtgtaactttaaaacatatttttgccattaccaagctggtatccataaaaaaatcacaagaagtcatttaaaaacatcacctaatcataaagaaaaacgtcaaactgtgccacaatgggaaaaagtctaatcccaaatgtaggggtcaagctgaagcctatcatgtggggaatatcagttaatatggcgccctcaccttgagccacctgggcagtgactgaatttgttcaaagaatatttctttattgggtgatggacctttgtgccatcacaagccttccctctgaagggagcagtgttgagtaccatgcaggtctccaaaactgctaaaagatgaatactcccaagctcatcaacttgagtgacatgataagcattgtccctatagttaaactaagaaggaagaaaataactaaaaatttaataaattcttattaaaatatttaaaacttcacatgttaaatttagatttctttacacatttgaacattacagaataatcctgtaaattgttaaaattagattaatcatataagaacaagttaatgagcttgtaaaaactgagtgtcccttctcaaaagaagacatttatgcggacaacaaacatatgaaaaaaagctcatcatcacttgtcattagagaaatgcaaatcaaaacgacagtgagataccatttcacgccatttagaatggcaatcattaaaaagccaggaaacaacagatgctggagaggatgtggagagaaataggaacgcttttacactgttggtgggagtgtaaattatttcaaccactgtggaagacagtgtggtgattcctcaaggatctagaaccagaaatatcatttgacccagcaatcccagtactgggtatatattcaaaggattataaatcattctactataaagacacatgcacacatatgtgtattgcagcactattcacaatagcaaagacttggaaccaactcaaatgcccatcaatgttagactggataaagaaaatgtggcacatatacaccatggaatactatgcagccataaaaaagaatgagttcatgtcctttgcaaggacatggatgaagctggaaaccatcattctcagcaaactaacacaggaacagaaaaccgaacaccgcatgttctcactcataagtggaagttgaacaatgagaacacatggacacagggaggggaacatcacacactggggcttgttggggggtgggggataggggaaagatagcattaggagaaatacctaatgaagatgacgggtgcagcaaaccaccatggcacatgtatatatatgtaacaaacctgcacgttctgcacatgtatcccagaactcaaagtataataaaaaaaaaaataaaatttaaaaatcaacttctgcgtggcaacaaaacaaaataaaaaccctatgcaaactaaaagacaaatgataaactgagcaaaattatttgtaattcatattatggacaaaagactaatctccccaaaaaggctaatacctccaaactcattaacaactacactactgcactgtttgtttgtacaatggatcactcagagtcagctcagaatctaagagtaaagtacatgtcaatccaaaaatgtgtccaaattcactgaaatacaatgtagaacagaaaagaaagagtaattggagttgctaagtactttcaaaaggctttatgcttaaccgtgaagacagtaaagagagtaaagcagcagttcgggagcctgtctggagaagtaaaggtgatatggcagcacactgctagagactccgctagacatttagcttaacctatgcatctcacaaatggaaaaaaaaaaaaaaagataggtgagaaaagatatcatgagaaaggtaattaaggtagaagaatcacactttacaagaaggtttgcttgatttcttttaagctctaggctagtacaaaatttaagattgatattacttaaattaataagaaacactaaaggactcttcaattcgcaagattaaacacttccatctggaacatctgattactaaataatagcccatagctacattacgctccattttcttctacttaactttatcattttaaaaagggtgctgggaagaggtacggtaaaaccatctgccataataaaatgaaaattatctcattaaaaaaaaatctgagtgtccatgccatcatgacctaccagaagtgctacatcatatggttagtattttataaatttgttattcaaaaataatgaaaacaataatgtaaaataattttttaaaaaagaaaaaaaatcaaacctcatctgacttcatttagcctacattcttcgtattctaatatacttttttagaatgaaatatttagatgtgaaagttaataaaagagaaatgattgttcttagggtgtggcttcctctaaataagtcatggacgttcccaggatgccatgagactcaacagggtttccagtgcaacagaccattgctaccctgattctctgtaggaaagttgaatacagcattcacaaactgctaaattgctgctgaagtcaccaatgtctgatatgaggcagaaattttttttgcctccaaagataattgtgcttgaaatataagatcctaaacttttccctctctttctctgttcaagtgaaagagggtgggggtgggaattaaaacaaacagaaatctgagagcaactctttttcagtacatgtagaaaatggagtgtggagcattgaactttgaaaatctgttatttccaggaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggtaagcaaagccattggaatttcaaagaaaagaaagcagtccacggctcccacttctggagatggggtcactggtagggaaggcaagaagggcaccatcacttctactttgctcacttgtgacttgtttaagcaaatgacatttttacaaaaatcaatgtaaaaatatttgaagtatggaaagaacagtgagaataaaataagctgttaaggtctacatagctgtgttgtggcaagaaggagaacagatggaaaggaaagacttctgccaatttagtgtctctcaaaaccattaaacccaaattgaccttcatttcaggaagggcttagtgctaaagcagccatttgatacaataactgaacatgaaaaaaaaaaaaggaaatagaatttgtgtgtctttggatcagaatgagagtggggaatgctgtgtttggtattcactgggatttatctttagagattttcttgcgctcaacagtagacctgcattcacactaggccagtgtgttccctaagtcacaggtgcagcgtttatgccttcaaagcatctgtgaatgcacggtatctggtggtggaaagggagattctagaaatttctcatctttccttgataagctaaggttctgtgtttaaagtgtaataccttttcatgttgtttgacaaggatggatgcttggttgaaagtactcatgggagaacatttttattttgaaaaattgaaaattgcaaaggaaaaaaaagacaactttagagcacttgggggttgtgctaggtaatcttagattttgctgagaattctactcaaaaggaggaaaatgtcaggagattcttggtcactttcactacttggtgattttgtttttcctttaaaggctgctcgtaactgcttggtggacagagatctctgtgtgaaagtatctgactttggaatgacaaggtaagccaattccgaaagggcaaccagtgaaagggggatttccattcacatttgaacaccatcataattgaaggctttgtggggatatagaaggtgctctgaattgggggcttagaaacctaagtccctcccatgggattgttcttcagaaattatctgacgtcacttttagttctttcaacaatctgatactttctaaacttctaaataaattccatgaaagatcctaaatttaaatacaacatgttacagccacattattggattgttttactttcttttaaatttttttatttttaatttttgtgggtacatagtaggtatacatatttatggggtacatgtgatgttttgatacaggcatgcaatgtgaaataatcgcatcatggagaatggggtatccatcccctcaagcattttggagtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggcaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagctaccgtcactccaaccaccatacactgagtcccctacactgaccctccaaacatgtagctttctcaagagcaagaaaaaaaaaatctgctgacaggttcttaaagcagggagaagctcccaggtcaagggaactgatccccacctttactctaaaagcaagaatattggctgttatgccagcatccagggaacatgctttcacgttctctgtagctttggaaaagggagacttttccaaaaaaagatccaaagaaaaaagagatcttgctctgagtaagagatcctggaagccatgtaccagccctgttggttatgaagctctgtggccacatcaattagatgcctgtgacttcatttgctcctactagcttgaaggaaggtttaagccatgagcatccccaaaccaggagtgccagggtagtgtctgggtatctggtagtgtctggggagctgaggggttctggggagaaaagtatggaatgtactgtatgtaatcctatgaaagtgtagtttattaatattattgttaatatttagaaggatgatcttcccagccagctattttaaattacagtgagatctctaaaacatttggtgtgtaaattatatccaaaattccaattgccataactcctgttgttctattttctctaattaagagtcattatgtgtttgtttttgttgtggtttttgtgggcaaatatatgatgttctcttttattaatactataaataatatgtacttattataagaaaaatagcattagtgtagaaagtaaaaagtagaattgttagcagcagtgaatccgtaaaggtctgcagcaactcaattcttgcctcctcaaaggaaaggattcatctgaggggcataaggcagagagagagactgaggcaagtttttgagcaggagtgagagtttattaaaaagttttagagcaggaaggaaaggaagtaaagcacacttggaagagggccaagagggcaacttgagagatccaactgccctacttggcccttgacttagggtttcatacattggcataattccaaagtttgcatcttttctcccctgattcttcccttggggtgggctgtctgcatgagcagtagcctgccagcacttgggaggggccgcacgcacagtgtgtttacttaggttgtgcgcatgctcatttgaggcatttttcttttaccagtcgagtattcttagaggaaggtcatataccagttaaactccattattttgcctcttattgcgcatgtttgaccccagttgcccaactcctgagatcatatcaggaagctgttgatcatcagcttcaagtattttctatctattgggagactgccgttccctggcaccagctgcgaccaattattattttagagagacggttaacaactgcctgactattacctgacggtcacctaatattcctgggttgggggtgggggatctctcctgccctgctcatgtctgcctagctacctattctgacagaatctgtccctcattttcagtgctaggagtaaccactgctcagatgtttggtgggtatcctttcagacctcattcttaagtgtatccaatcatatacacaaatatgcacatttactacttgttcccacacacaaaaaatggaatcacattatacacactttcttttgcacataaccatataccatgagcacctttttattttggtgaagagttatctcatttttgaatggctatgtgctattctattgtgtgagtgtgccataatatatttaattactcctcaacattgggaacattgaggttgctttcattttatcattattacaaacaaagagtttagtgaacattcttcaacatgtattttggtcttgatatctccataggatatttttgttcatcattattcataacagcagaagattagtagcaatttacctggttaaataaattatgtttaattccttccataagaagaaataataagagggaatggtattcagccactaaacatgatgctgcagtagaaatgtaaccgtatggggaaatgctcatgatataccattaaaggaaaaataaaagcaaatctcaatataacagaaaccctattttgttcaacttatatatgtgggaaataagatcagaaagtacaaagaaaaatgtattttgagtgatagaattacaggttatctttagggtgggtttctgagtaattttatctttacttttttgtgtttttctatatttaccaaacattttgcattgaggttttgctgtattcagttagatattatcttttaaatgcttacaaaccataagcagcctccagctaagcccacacattgaaaggaaacaaaagttccagaaaactgaggcaatcgactgagactctgggtggcttccgtgtccttcatcagcctgtaccaccacggcttaaggtctgtgttgatgtgttttccctggcaggtatgttcttgatgaccagtatgtcagttcagtcggaacaaagtttccagtcaagtggtcagctccagaggtgtttcattacttcaaatacagcagcaagtcagacgtatgggcatttggtaaggatgtggccacatacgacctggccctgtttcataagcttacttccacaacaggaaaccacaagagtagcaatgtccattttaaaagggcccttgaacacttacgaagttacacatatagcctgagagaagcaagctgttgaagaaggtgatttattttcttgggtttggtattaggatgtcttctacacatcttgtaatttacatcctgctagcactttctcataaaatcaaaagggataaatctactcagaggttgaggtggaaggattgtttgagcccaggagttcaagtccagctggggcaacacagttaagaccctgtctttagaaacatcaaaggggatgaaagtttttccagtgaagatttcaaataattttttaaaaggagtcattgaaagctgaatctgagtttttgctgagccccaaacgttgaaaagacatcaattttctgcatgaaaataatgggatagccattcccttctgcgctgaccaattcttagtgtaaacaccacacatgacttggtactttctttgactcgtgcctagtttcaagtagtctcctctctgttaaaatttatattttagattgggattggcaaaccacagcccaggaccaggtcagttggtttttgtaaataaagttttattggaacacagtcatgcccattcatttatgtattatctatggctcattttgtgctacaacagcagagtagagtagttgccacagatactgcatgtcccaaaaagtctaaaatgctatgtggccctttataggataagtttgctgactcttattttactaaaatatctatattaaaatttagtaaaggtcattagaaaagggaaacaattcttaaattgtgactacattttatgatattttttctatgttgtgagaatatcaaggctattttcaatcactgtcggatggacccaggataagtaatccaaatgtgactgagacctatttcatgccttagttcataagtgtaatttgatttactgcttgtcacctacaagactgcctttgaaaaggggaaaatttagttatttatttctctatgtgacacaatttttaaaactaactattccctttgtaaaagtggcattgttcgttgttaaaaaaaaagataatcaaatacacacagaaaaagaaaaaaaatcacaaagatagcattttggtgaatacttgatgccatgttgtactgattaacttttgtaccttgttgtcaaaattagttttgaggctgagtgcggtggctcatgcctgtaatcccagcacttcgagaggctgaggcgggcagatcacttgaggccaggagttcaagaccagcccagccaacatggcaaaaactcgtctctactaaaaacacaaaaattagccaggcatggtggtgcgcgcctgtaaccccagctactcgagaggctgaggcacgagaatcgcttaaacctgggaggcagagtttacagtgagctgagattgtgccactgcactccagccttggcgacacagcaagaggctgtcttaaaaaaaaaaaattagttttgataatcatgcatcaattataagtgatagcaaaaaatcaatgccctaatttaataattacagcttgtttttgaccaaaaaatagtattacccagcttgattatttaccgtatgccatagaagttggccccagatattttccagctgtttataaacactaaattcattcttaaacaatatatcccagtgaggatacccaaaatgaatcagggcctctgatagcaattcccaaagaagaaccccacagatattttgaaataagtgtgtagccttccaaagagaaagttatgaggaaactgcattcttttggattgttgttttagactgtgtgatttaaaagaaaaaagcagccataaaatttataaggttgctttattataaatatttgaaactggctgactgttgaaattttctgaccttggccagcacagcacaactgccaccatttagagagcacttgaaacatctcagtgctcttttaagtgctttacgtgttttatcctatttaatcctcacagcaagtccatgaggtgcaaataccccattttatagacggagaacctgaggctgagaggggttgagaaacttatcccacctgtaagtgacagaagtcaacttcaaaggccatgtctaactgatcccaaatgccatcctcctgaccaccatgaccagaaccgagatttcttaacctggggactgcaatttcctggatgagttttgggggactgtgaacatcctgaaactgaacacaaaaatgctgtgtattcactttcccaaaggcggccagtggctttcatcagattcccaaaagggtgcctggcccatatgagattaggaaccactgcagcaatagaaaggagaatgttgtcaatgattttatcttgaaatttccactgaagtgtaatctgattgtgcaatgaaattgttgcatgcagctgccaaagccgagagacggaatgggtgaggacatcaaccactcattcataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaactggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcacatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggagacattgtaaaagggtgtccaggtgagaacagcacaagcaaaggtgtggaggcaggaacgagcatggcacgctaggctggtgctatcgttggaagggctggagataagtttggaagagtaggtctggttcaggttctgcaaagtgaataacaaggagacaagtgagagttttggtttttgtaggcgatgaggagccactgaagacttttgagcagtaacatgataaaaggaggcttttgagaacattattctaagagcccatgttcataatcattatatggtacttcctcaatggcaaagggcctaatgctgcattcatttattcactagtaaaaggcaaattggtgtaatggttaagcctgtgggttctggcatcagaatacctgggttgaatcctgtcgtgatcacttactagttatatgaccttgtacaaacctcctattattatctctgtgcttcactgtaatgtaatgcttacctcatagaatttttgggtggattgaatgaattagcattataaaggccttaggacaatgcctggtacacagtgctgtttttctgttattaatattgtgtgtgtgtgtgtatatatatatatatttttttttttttacaaagcatctatgcaccaggcagtacgcttggtgctaagaataaattgacgcacacaacttaaatagtttctaaactcttgtaccggagcctagagtcccactttggaagagttgctgattgcatcacataacaatatttttcgtttagccttaaattatcacctggaatatgagcactctgtaatttcccaccctatggcatttggaacagtatataaggtttccacacctttttctaccccaaatgttgactatgggaactatggatatggacagagatatgcagactacagtggccaacagagcacttatggcaaggcatctcgagggggtggcaatcaccaaaacaattaccagccatactaaaggagaacattggagaaaacaggatgagatgttaaagtaacccatcttgcaggatgacatagaagattggtcttctgttgatctaagatgattattttgtaaaagactttctagtgtacaagacacagtgtccaactgtatatggctgccaattagttttctttgtttttactttgtcctttgctatctgtgttatgactcaatatggatttgtttatacacattttatttgtatgatttcatgttaaacttcaaataaatgcttccttatgtgattgcttttctgtatcaggtactacatagctctgtaaaaatttaaagtaagcaataattaaggcacagttgattttgtagagagtattggtccatagggagaaactgtggtcctttataaatagccagccagggtcaccctcttccccgatttgtagatgtattctatgctcttaaggtttcatcttctccctgttaactgaggtttctaccacacttttgaataatgttctttcccctctggttatctgaagattgtcctgagaggaagacataagtgttgtgattagtagaaactttctagtagaccatgtttcttctggattgtaataaaattgttagtagctccttttgctttgttcctgtctctagaaagccatctttgaatcgttaattactttggctttaatcagtggtcacctagaaaaagctttgtaatcataacaccatgactttaattcttgataaaaattcagatgcacacaggaaggagcactgtaaaactggtaggagctatggtttaagagcattgaaagtagttataactcaaggattttggcagaaaggtatgagtttggtcaaaagttagattaaaatttgaaatagcggcaaaataagatttagttgtattttgttttctcacagccaccacaagactgaacaaaatattttctgtttgggcattctgaggaagctgtattacagttaactgttaatgctgtgtgagtttagaaaaagtcttgatagtaaatctaacttttaacacagttagtgcatgaactgagtagttaaacatttccgtattcagacaggaatagtggaaaaggtatcttaggtgcgttactcaatccaaatgtgactgaatcattacagtggaccctcatggtgcattgaaaagaaactgttttatatccaggtttcagaggacctggataaataaaagctttggattttgcattcagtgtagttagttggattttgggacctttgcctcaatgttagctactgggattggcatatgtgttcacaggcagagtagttgatctcacacaacgagtgctctcacaaaactggtgtaagtttcttatgctgatgagcccccgcttttttttaatttggtgcctacaactttgttacaatgattgtacttgctgggctatcaagttacaatgctcttggtcttttttgctgctgtttcgctatttgtccttacacctaggccaagtaccaatgttagctgttggaagggattctgtttattcattcaacatgcaactatctaactttagggaatggaaggaagttcatttttaagttgtgtgttgtcagtaggtgcagtgtctagggtagcgaatcctgtaagttcaaatttatgattaggtgacaaattgacattgagattgtccttttccctgattaaaaaatgaataaaggctttttaaagaaacaaacaaacaaaaatattgtgtctaagattatcaggcagcactagagggtcagactgggtctgggtagagttggtcacagccaggctgacttactgctgtcacctgtcagatgaagaagagcagacaagggtttttcagttgaagcccagaacctccctggccctccctactctagctcctgggaatatgactgcaccataggatggacaggggccctgagtcgggaggaactgccttcttctcatggttggttcataaaagcatgtgaattgtggcagaatctgtgaagaggggtttgcactgagacgacaatatccagttaaaacattgcacctaatgagcagagcttatagatttgggttttccctccttttttagattttattttgtgactttctcaattcataaagagattgaaagaacattcacaattttcattagattttgattcatccttctggtatttctgtatgcaaaaacaagcatatgtatagatgtgtgttttcttgcttccctttctctcttacaaagaaaaagtagcatatgaacttctcctctccataggcgttgcctcactagcaatgtaagagggtacctattttcttataacctcaccaatggagtgcattgtcaagcttttgaagaattcttgccaatctgataagtgaaagcttgatggcatcttagtgcagctttaatatatatatctttcattatgaggttgagcctcttttcacgtttttaagggtcattttgtgtctttctgaactgtcatgtcttttttcttttttctgtcaggttttaaagatctctttacaaattagggagagtaatactttaagttatcagctttatttgattgagggtgggtgggtttttttttctttttttgaccatgcagaaatttttcttaatatagctgaatatatcaatatttgttttcattgcttctggaaattgtcatagataggctttctcatgcccaaattataatgacttttgccaggattttcctctagtacttttaagattgcattattttccatttatgtttctgatatagtttgtgtttgttatggtatatggtattaaatatggctccaaatatataattttatgtgactattctgttgttggcagccctatttattaaaagaccatcttatcatcaggaatgagataccaccttaatggtggtgaaatgccaccctaatattatactaaatttccatatgtacttgaatctatttggagacttcctcttctgttctttggtctctttgttcatgtgctagcaccacactgctctgattctgtagagactttatgatatgtttgaatactaggtaggctagcacccctcattgctcaccttactgtataatttcttagccatttttacatattttttaattctataaaccaaagaatcaatttgtttagcttgaaacaaactcattcatatttttgaggagattgtatttagtttgtattttaagttgggaaatttgacatctttatgatactgacttgtcctagtctagaacgagggaagctttttttttttttttttttttttttaagacagagtcttgctctatcactcaggctggaatgcagtggtatgatctaggcctactgcaacctccaccttccaggcttaagtgattttcatgtcccaccctcccgagtagcttggactacagttgtgcacaaccacagctggctaatttttgtatttttagtagagacagggtttcgccatgttgttcaggatggtctcgaactcctggcctcaagtgatccactcacctcagcctcccagagtgctgggattacaggcgtgagccactgcgcctggccagggatgcttttttatatagtcaagtctacatttgcatttttcagcagtgttttaaagtcgtccccattttagaggggcacacttttttagtgttttattttggtggcgttgctattataaatggggttttctcttacatgataacttctaagtggttactgtaggtatatgtgaaggctattgattttgtatgttaattttatatcctgctctcctagtgaattcctttattctttaagtctgttctaacattgatactctcagattttccaggtatacactaaaatgcttgcaaataaagagactttttcttttccagttattggggctctaattgttcttgctttccaattgcattggttaacaccttcaacataatgttaagagtgattattatagtgagcgtccttgccttatttctgacctcaattgaaatgtctgttgtgtttccacattttaaaagttgctagctttaggacttagatgtaaatattttatatattttatcattgatcataactctcatcatctaaaacattgggtttcttgttgtttttgtttagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 209 - DNA, 49222 bp, Homo sapiens
gggaatatgagtgatggtgcctcaaagcagtaactttttgcttagagcttgagagtcaaagttaaggacccacatgtatacttcggctctagcgagtctaaggtgagtaaagccttcagattatcaataaagaaagattttaactattgggcatgtgaattcaaataacgatgcaatttcacaaagcaaagaagaacataagaaagtttgtttctctggcctactgctcaacattgctacttttcatgatcagacctgatattagactgagggttgaagtaactgtcttagtagaattagaaaattaatgcatttatttttcagaaataccttaagttttaatgttttacatgattttgggataaaaaggaagagtctttttactttgtaaatgtactcattttttcagttcttttaaatctcttttgatagcatctgttagtgcaccctcatacattttcctcattttatcttatcttaggcatttactttgattttaaattctcatagatattgaaaattatacctgtgtaatttatgttaaagatctggccatgatcaggggctgcaggtgttatttacaataatgtcagtgtctcatagtggtttgggtaatttggtcaaattacaggccgttacttcataaattgtgagctgtctggagttaaattttctgaagttttattatatccaattcaattcaaccaacacatatagaatgtttaaaaagtaaggagcattttgataaggtggtctggagaatggggcaaagatgatgaatttattatccacagtgggaggagtcaaaagtataaagtgctttttaaaaatcaacatatttataaaacccaaagcaaaggcagcagaaaaactgtagctattgtgtaatttattctataatcctacatcagtctcatttattaaaatcagcatttatattatcccttaataggaaatcgttgaggaaaagatatgaaggttaaagagaacttacctagatgctgcaaatactcattttaattatttattttgtttaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatggtgagacatcatgtgttccattatttttatactatttattatttttcctaagtctccacaaagtacttgatcataatgaaagaatatcaggtttcttaacttacactgtgaagatcctcttctatccacttatcacatgaccttttcttaatgaaagtataatgaattcaagataaaggattttaaaacattagttaactttactaaggcaaattataactttagaacagtggttctcaactgagggcatttttgctccccaggtgacattgggaaaagactggagatattttgggttgttccaactgggggataggaacagtaagtgttaaagacatctagtgagtagaggccaagaatgcagctaaccatcctgcagtgcacaggacagtcctcacaacaaagaattacccagccttaaatggcaatagtgccttaaaacaatgctagaaataagactattcctgtacagttgagaattctactatagtaaaaacactgaaatactgtcataagactgagccaaaatgaagatgctttgcagaagttaaatcttgattttcctgagtatattaaccacatggtaggtgatttgaaacacatttcaagataatcaaacaagattattaaccactggaatatatgtgtttgtgtccagactcaaggaatagattatgttgtcattggattttgactattacggggtaataggaagtgactctccattgcccaccccccaccccaatctccctctcaggcataacttgggctttatgcctttccttgtgcaccatgatgtattgcaggaagtatcttacattttgttttttaattcagaaaaggggcagcagaaaaggatccattgaaattaagaaaatcagatgtgtggagaaagtaaatctcgaggagcagacgcctgtagagagacagtacccatttcaggtaaagggaagaacgacattgcattgggtggatagttcttccttcaatttttctatcgtgaactcaatatatctaggaaaaataatgatatttcaaaataatctaaacaaggcttggaatattcccacatgggagttgggcattttgctaaaattctgtccaccaatctgccttccctggagggaagggaagggaagcaagacaggagcgtaagtcgcagtgacctgacctgcctcaggtctgatcatctcttttaacaaacattgctgagtatctccgatgtggtacacagtagtaggcatactatggggaacaaaacactgcccctaccccaaggcatttacagggaagtggcaaaatagactaatacacagaccattacaaagcagtgagggtgagagttaaggtggaggtcagcagaatgcatccatggagtcccaggatgtggaagtttcattcctcactccaagaggctagagagatattctattggaggtgacactcaagttgagaaggacaagtaaaatttaacccagcaaatatgagaaggacagtggtacaaaggaagcagcaggtgtcaaggcactgatgagtgaaacagtatgacacatttagagagcactaagtagtccctatgaataaagaagcccatgtgacagtgaaagagatagcctggagaggtgaccatgctaaggagttttcattttaccctgaagtattttaaacaatggtatggtatgtagtgtatgctggtagtaccttttggaagtggcctaatctaagtcatgccctacttttcttatagcataaaatcttacatttctgatccaaaggtagatggattgtctttcagatggcctgactacccagtgctagtattaggaacctgtggccaaaaatgaaatacaataatccagttgattaacaacccatacttcccatttggaaaaaatattaccaggccaggcacagtggttcatgactgtaatcccagcactttgggaggccaaggagggaggatcacttaaggctgggagttcaagactagcctgggcaacatagcgagacctcatctctacataaacattgttttcattaaaaaaattacccaattgggggaaaccaggggagggcatgctcatggaagatgctgcaaactcacctcatagaggcatagtgctcaaaagatcacaggctttggagcccccagagagttcctagttccaccacttatacttgtgcaactgtaaacacatactcaacttctatttctcacagagttgaaataagattaaaatactgaagtagctaggaaagagcccagcaactagtaagtgtttaacaaatgctgtgtatatttaccaacaagagttgaataaactagagaaggatctggagaagatattgtaatcttcaaacgtttaaacatttgtcttaagaaacagaaaagtatatattctggagattcctggggtgccacatgatgaaatagatgaaagtaacagggaaacatatttttactcaatgtaagtatgaactgtataatgatcagaatatatggatattggcagagatgacatagcagagtaaagaacattccatccctgaaggtatttttaaagatagagcagttaaacattttccagtgggctgtaaggaaatcatgcactgggtaggcaaatggaccagaacaatactaagacacgtgtaatgtctaacatattaatgtccatagtccagggtgtccctgatgagaactcagtgttcaccactactatgaggtacatcatcgctgtaattttccaaagtataggagtgtctgggataaaacaaattgataactggaggattttttaagaaaatttttttcatctaattccagagctgatgtatactgtataagcaaactcaaggtttcttttggatgacaaaaaatttgcaggtgcaccaaagtgaagtatggtgcaattatatataaacacaccaaatattttcctttccagattgtctataaagatgggcttctctatgtctatgcatcaaatgaagagagccgaagtcagtggttgaaagcattacaaaaaggtaattcaaaaaaagaaatgttgaaagagaaaggtcaaaaaaagccataaaagagagtcgttttttgaggcttggtggaggaaagacatggcagtaaaaagactcaatgccaagagacaatctactgattttcctaccaacctcagggaatgtgtcagactcatcctcatttttgctttctcattgttacatacaggaagcctgtggattggattccctggcccacacaaagccagtattgtgccttcccagcagcttaggggaagccaggccacctgctctccactcagtatgcttgcctttaccaggggaaagtctaggtcatcatggggctatgtcaagtcctgtagctaccacacttttgatgtttatagaaagttacatctaatacttatactgagcatttaccatttgccagctactttatcaaatgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatgggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaatataataatgattttaaaatttaaagaataatacatatgtacagagagaaagagatacagcagatgtggcaatcagttaataattggtgaatctaggtaaaaggcatatggatgctcattgtattaatcttattcttgcaacttttctgtacatttgaaaattttcacaataaaaagtagatggaagtgtatgtttattcaggccttttttttagaaccttttgctaaaatttagccccacccttccccttctgccacaagaaaacaccatgtgttgtaacccactcactttctttacagatatatctctaaaatcctaacatcaagctgatctgtatatgcattttactagttattttttcttcaaaaatgatatgtaattgtgttgttctcaacatactcatggttagacttttcttttttctttttggcttattaactgttgagtgaaagacctatatccttccggaaccatttgctcttaccttggttgctggccaaatggggtttttattgttctgtgataacagcacttactgaatgtttctcctcttggatcaacgtttgctaacgtcttgttttcttcctgtctgctcctcagagataaggggtaacccccacctgctggtcaagtaccatagtgggttcttcgtggacgggaagttcctgtgttgccagcagagctgtaaagcagccccaggatgtaccctctgggaagcatgtaatgtgtgattcctctgttggactggacgttgggtggatagtgctccattaggctaaacctgccagaggccagaagagcttgccagaaaacaagatgtgccagattggttggcatcatgaaaattcagccttgcagatgctatgtgacaaatgaaatctcattctagggtcaattgagtcatggccattaagataataacaatattaacatctgccattctttcatttcatgagaaacattttaaaaatttgaatcattaatcaagcaatgagctgttatttcctcccataatttttcttggttcaagataaactccaaaaaggtagaatatgttagatatgtcatcatagttcaaacagctaggtttccagtttggtaagaaaaccagctcgctcttcgtataaataacgaaaatcacaaactgaaaaaacaacattattaaaaaaaaaaaagatataacttaagtaacacttttcatcaccatgtatactaaaatgatggtcaaattttaaaatatatatttaaagcagttcgccattctctatatgtgtgttaatttcttaatgacatgagagaaggggctgctttacgtgaaatcagattctatccagagttgtactcccagggaaacaagagggacttatatgtatttaaagtttataattatttaacataaagttgttgataaatacaaaataggataacttattttggtaacagttttaccagcctggacaaaatatgcctggattacaatggctttaaagaattgaatgagatcagctacaaaatagaacttcatgaaatggaaaagatacaggcacataaaatattttttaaattcacttcatgacagtattgatacccaacaatcatgttaatgttaatactggtcattttacccccaaaaaatcaattaataaatattcattgtgttttccatcttaattagactatacagtgaatatttattaatctcaactagatcacattgctctatatactcatgaattatagttatttaatgaactatacagattggttgcacatgggtcttcgctccactgtaagggactgaggagtaatgtctccttatggtattaatcattttccccagtggttttgtctatggtctatttggtctattatcattacctagcaggtcagattccagctttgacaatgccctaactttctggaaggagcaggaaaaaggccagagagagcactgccttgggattgccttcctaggctctgtctggatgacactcaccatgtgttctgggtgccacaggtgctgtgcctctgaggaaaactacagagtgtagaggtgttgcagctcctgagcagctgtaatactgtctatctgtccaagtataatttattcccttggcttcttctgctgagctactgggaagtccatgggcataacaactaaaagagaaaaagttaggtgtctttatttctttttgtccaagatgccttgatccatcctctttccaggatacatggcctacataggagttgggccttatataggaaagctacagaatcactccagatgttgtgtctggattcacttaatctggagtattgctcacacaagctggttcattcttttaattcataacattgagtgtttctctttgttttgtttaaagttccttctgatattactttgttttaatgttcagatgctaatctgcatactgcagtcaatgaagagaaacacagagttcccaccttcccagacagagtggtaagtcaacattttaaaaatgtttttcatggtcaggatatattaaataaaccaagagttgccagattcaagactagaaaatgtggaattcatttagacttctcagcaaagagagaaaaaccatgagctctagataatagctatgggtggtattgaatagcggattcaaatatagaaccattgtaatatctcatatttttgcatttcattgttgtgtcttttcctagccagtaagcccataaatagtcaccaaaaaaaaaaaaagaaaaaatgggtgcatgcgggagatgtccttaagatggcatcacacataacaggcagctgttattagctgtcattctttccttaccatcaacatggccaagactgctttgtggaagtatcctggtgttgaaatgaaactctataggacaaaagcagaaaacaacataattctttccctccattatcccttcaaagctattcagtgggctttcttccctgcttccaaataaagtctttgccaaattccatagttttgcagtcattctcaaatgataaaaatgtccccattacttgtaatcataagaacagcctctgaattgttccatccaatgttattatcacatgactgcaaacatcattccaagttaaacatctgtcacctagcttgggcctgcatcacctggcagcatgcttttggggagggattttgggggggctgagattcatggccctttcagagttagttccaaggaagatgaggtctaattaaaaaaagacacacatagctgtttctatcatgatttggtggtggtggtatcggagtgagttttccagcactgattctttatctcatgggagacttttaggaatttcctactgaagggcagatccatatgtagttttatgacaggggagagatcttgatcctcagttcttggattttcagccctcaatctttcaagatggctgtcagccaactttttcccaagagtggagttggcctataagaaaacaaacaaaaccttgattgctctggttaattaagctgtatgtagctctctctcgaagtacaggctactgctgtctttttgctctactctcttgggttcatagccacagccttctgtttttagggttcccaggcaggtgtgagcctcctcaaatgccaggatacacaaaaaatggcttcccattggttctctggaagttcacctgaaagcaaggggacatctccgcccatctattggatctatggtgtcttgggtacttattttcagctacacacattcgcacacacttctctctttctaagtaaaagccacataattttcatgaatcaacatgaaagacaaaaataatccattattgtagtagactgaataatgtcccccaaatttcatatccatgtagaacctcagaatgtgaccttattggaactaggatctttgcagatgtaattagttaaagatcaagatgaaatcacacgaaagatgagagtgggccataaatccaatgactagtaagatgagaggacacagagagatacacagaggagaaggccatgtgaagacctaggaagagattggagttatgttaccacaggccaaggaacacctgtttcttagtccatttgtgctctactaaggaatacctgaggctgggtaattgataaagaaaagaggtttatttagctcaccgttctgcaggctgtacaagtagcatagcactggcatcggcatctgatgagggccttaggctgcttccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcaacataaaatttggaggggtcgaatatccaaaccatagcaacttggaaccaccagaagctggaagaggcaaggaaagattttatcctagaggcttcagaataagtatggcaatgctgaaatgttgattttgacttctagcctctagaactgtgaaacaataaatttttgtggttctaatccaccaaacttgtagcaatttgtcatggtagccctaggaaacaattataatcgttaggagttttactttgttattagcaacattgctgtttgggtttgaaaatatgtttcagtcctgaagcttgaaaagtatggccctctaaaacacctaggagaaacgcccagattaggcaaatctatagaaacaaagggtgatcagtggttgcctgggaccagagtagggatgagaattgactgcaaataggtatgaaggatcttattggagtgatgggaagactgggctgtggtgatagttatacaagttgataaatttacaaaagtcactgaattctgcactttaaaaaggatgaactaccaataaagtttgttttgacaagtctaagagcagaagataattaagagccagaaaccattgcatctagtctccagcagggaactttttggccaatatattgaaaattatcagctaggcaaatcagtggctaagggttcataagcctgttttgattataagcttcccaaatgaaccagggatcagagggtatcatgtaaagtatgtttttctttgttttgttttttatcagagtattcagtagagggcttattttctgaatggaggaaataaaaatcagctctctagttgttctgttcaaagagatttccttaaatgatttccatttaaggaacttcctagtgcatttttctttggacataacccacttcacagctcataaataacactgtcctgcataattaaaatttccagaatgtcaaagccttaactccaagtaaatgaaatttctgaaaaactaaaatatagcatgaaaaaaatattaaatgcatctctttctgtcacacacgcacacacagacacacacacacatattgtgaatttttaactgaaatataacattaacatagaaaagcacacaaatcctaagtgttcagcttgatgaattttcacaaactgaacaattctgtataatccaccctcagataaagaaacacaacatcacagaaccccagggacaccctgatgttccctttcagtcactactaccctccaaaagtagttgctaacctgatttataacatcatagattgtttgcctgattttgacttttatatgactggaattataaagtgtgtagtcatttattgtgtgtcttcttttcttcaatttgtgagattcgcttatttttttagtatgtgattatatttaccgtcatcattgtatagaattcagttgtgtgaatatacaactgttttggtttcttattactgttctaacaaattactacacaaatttagtggcttaaagcaacatacatttattctcttatagtttggaagatcatatgtctaaaatgggtctgcacagctgtgtttcctctggaagctttagggaagattctgtttccttgcattttccagttcctaaggggtacttacatttattggttcctggctccttcccctgtctgcagaaccagaaggttgcaggacctctactctctaacctctgcttccatcctcacagctctctaatctctgaccaccttatctcccttttataaaggccattttgattacatcaggcccacccccacaaaatccagaatagttgccccatctcgaaatccttaattacaatctgcaaagtctcttttaccacgtaaggtattcacaggttctgggaattaggacatgaacatattcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcatacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaaggtaatccccagctttcagacgggctgcccagcatgtagagtaaacactaccccggctgccctggacctcagcctcaaagctgttgatccaggtcttaggctgtcctctcagaaaatgttcagtgcttgagccagaagtctggggaagcagtggccccactggggctgagaagcatagattttccatttagattatccaatctaatgatctcagtaatgcctgatcattgtattcccttccctttctcctccttctccccccaaatatctccacattccagaatacagaatctttaaaaatctatcctttatatgaaagagcttaggatgggcttacttttgtaatgtgcttcagtatcactagccaaatggcaaatagcatttcaagcaaggccatggcttgccttcttggaatgtacaacctcacctctcctgacctgattagtcttctcacagtttttagcctaaagattctatctaaagccagaattgaaaattccttgaaggcaacatgtaaattgtgtatgtatgtatctcttggtatggcactgaatttgccctacacttgatgcccaataaatgttgaattgaattgcaagatgaccatatggaaagggtcaagtgactccccttccttatttcctgtctcagacctccttcctatcatgttgtctactctctgccatcttctcactcagttatcagcatccctgcagggaagtcatgtctgcctttccccacaatggatacagagcatctctctgactcaccatgtatctcttttcttagttatttttcccatgtccttttattcctttgttctttccatcttcatcatttttgcctaaagccaattactgaaagtttcaataatacagggccatatggaatttgaaataatgtaagtgtgttcttcttgattttttttcagtataataagccatggtccctttcattccaaagtggagctagaatcctagtgtattaatctatacctggtgcccaaggtatggggttacatttgtgcgcctgcagcccaccattcttgtggaaggagaggatcagtaaacccagttgcaaggagagtgaaagtcatgttaattgtgttccaggtccccttcctgacagaaactccagtgattcattgagagaggtgtgaggtgaagctgactgccctgttttcaaataaccaggaggaactgtcgattcacatggggttgctgccattattgagtttttgacactcctttagatttgcacctccttaggtttagtcccaactgtggattttccctagaacttcaggaagctagttattttaacaaaggattgattgatcacctcttagcatgagcagcattgcatctgcaagtaaattataataattgctaaaaggtcttcatggagcttgactttttaaagtgcagccatgattcttatctcatatatgggataatactttttatcaactttctgtcattcttacaatcttccctgagcttctttttaatctactttctgtttagtaagataatctatgcccccattaaatcattcaaatattacagaatattccatttacattcccctaaaatgttttctatgcacatgtggccatgtgcatacaaaagcaagtaagttctcacgatacagtctttgtcatttgttcttttcacttgacatcttcagcatttttcctatttgaatacatgaggatacacctgacttttaaaatttcattttcatttaattttggtgaaatatacataacataaagtttaccatcttaattatttttgagcatacagttcagtagtgttaagtacatttacattgttgtgcaaattgcctgattatttttaatgtctgtaagtaccagttgtatagatactaggtaaacctaagtgatgcactattgatggacattctctaagtgtttttagaaacaacaaggctaaataaaagctattctagtgggcaaggctctttgggaaggtggagagagaggcattttagagtttaagggctttatctaggcattccttgaaatagagccaggggagcatttccttgctaaggaaacttgtttctatgaactgtggttttgaaaaaagtctggactatgaaggcaaacaggaaataggttccacattccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttaagataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgtgaatcacaccacctcaaagatttcatggtaaatcaaattcagatatctcctacatccagaatatgcttccattttcaggaaaactaaccaaacttgcaataattttgcagctaggctttctacttaaggtaaatataaaccaaaaaagtctatgtagtttgcctctctgaaccctgaatggatggcttttgggttctagtttttcttgaactgactattcctagccagcatccatgacatacaccagtagtagcaccaacattagtatacctgacccaggcatctctagcaggaagaaaagcaacctagagttgaataactcttccataagaatagctatatacacaacccaatttttttttaacttgatactacagccatctctgaaggagtcttcatctatttcgtgagcccactctttggaaaaagtcaaagaaatataagttcttctgggggcctcctggggatctcctgtatcaaagaaccattctttcattaaaacttggcataagcccaacttttgagtgactctctctttactgttgctgtgttgatactttgccaggtgcagaaggagaaacctaacaatctaaatgttatttaggtggataaaatcagggtgggatttgatattgcatggctacgcacttggattatttcttggtgcttttctgcactcacgtttttctcaactcttcttaagggaattccctgagtcaagttcatctgaagaagaggaaaacctggatgattatgagtgagtattgaaagtcttctgggttcttctaaaattagacatagatacttctactctcttcctcaaagacattaaaacagatggctgagaccgtctcaggaggctgtatttacatgggtaaactcacgtaatgttctgggtcatttatctagatgacaggtgacaatgagctgggttgttaccaacgaaaatattttccccaaaactggattatctaaattggatgcaaatacttattggatttatcgtatgtccagcgtcaccttcatttcactttacctttgtagatgtagcatataatgtttctgctcattatttctttcctggagacctctaattaaggtgatgtttgaaagctcttattaacattgagtaatatttttggagaagttattaatgatgcagtaattttacagggtagcacaaatgagaccttgaacatggcaatatttatgtcgacagatctctattcttaggatgaccttgtcattttttttttttttttttgagacagagttttgctcttgttgcccaggctggagtgcagtggcatgatctcggctcattgcaacctccacctcctaggttcaagcaattctcctacctcagcctcccgagtagctaagattacaggcgcctgccaccatgcccagctaatttttgtatttttagtagagacagggtttcgccatgtttgccaggctggtcttgaactcctgacctcaggtgatccacccgcctcggcctcccaaagtgctgggattacaggcgtgagccacctcacccagccaaccttttcatttaacatcaaaattgggatactttagaaagagaaaaagtgcactattaaaaattatacccgttaataataacttaattatacattttaaaataacttaaagagtataattaattgtttgtaactcaaaggataaatgcttgaagggatggataccccataatccatgatgtgattattatgcattgcatgtctgtatcaaaatatttcatgtaccccataaatatatatacctgctatggtgagccgagatggcgccactgcactccagcctgggcgacagagcaagactctgtctcaaaaaaaaaaaaaaaaaaaaaaaacaacacaaacacacacacacacacacacaaatatatatatatatatatatatatatatatatatatacacacacacacacacacatatatatatacctgctatgtactcacaaaaattaaaataaaaattacacctggacatttgacataaactggacttctgggcaaataagaacgtgtggtcaccccaactatactgagaaggttggcctaagtggctattaaggttctttccaaaatctaagggtctatcattctacaaatagggacaaataattgtctcctagatgtaaagattagtgttaagaagaggtgggaataatagagcatattgcatttctcagacacttgataccaaatggcacagaattcacttgaacactaggattatgcatatttccagttctgtttttgtacaagtgttgtattattgatttattgattacatgtgaaacgagagcttttacaaagtacatgctactgttttcactcctcctctcatctctaacccagcctggtcctagccatacctgttgcattggggaagatgtgctgtaccctccacatctttgtggcatggtctctttatcaccttctagctctctttcggctttactttcttccctaacatctattctcaggaaagcattgatggaataattcatactaagacataaaagactgagaatgaccaacgcatggtcatttccaaagataattgcactttaatgaaacacaaagacttaaaccaatgggagtgaacctctaattgtggattgtactctttagcatttaaataaattagaagtctttccctgattgggtaagcccagatatgaccatttaaacagtctctattcccatcttttctgaatgcaagtggtgtgtgagagacagacattgaggaaattatcagggaagacttgtcctcttcaaaatcaaaaagataccaaaaggagctcgggattatagggctataggatctgggactcagtcacctcacattgtgcttaatgctcccagcttcctattctatcagtgtcatgggagtttttgttttatggccataacttcatgagcaattccagtcaattccattaaagacagaagcactaagccctgagatttagatagaaaatcgtgtgttaagactaggcctggccaggtacagtggcacatgcctataatcccagcactttcagaggctgagctaggcagatctcttgagctcagaagtttgagaccagccggggcaacatgacaaaacctcatctctacaaaaatacaaaaattagccaggtgtggttgcccattcctgtagtcccaactacttgggaggctgaggtgggaggatcacttgagcccgggaggtcgaggctgtagtgagccgagatcataccactgcactccagcctatgtgacagagtgagaccctgtcaaaaaacaaaacaaacaaaaaaaaaccttaggcctaggactctgctgctctgtcattgaatactgaaatattatttaaaacaataagaggcaggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatcctgtatcacagcccctgaagggccttttgattagctagtattaccttaaaatgttgactaataagaaaaacgatcagttaaaatttcaagtgttagttatacagtatccataatggtagagttaaaagagactttcaaacttatcaagatcaaccctctccctagttttacaggtagggaagtccaaggtcaaacaaggccaagtggcttgttcaaagtcatacaattacacatagggaagttatgcctagaacccagacctccaagctgggtgacctaaggctctttctattttattgagctgtccaccagctgacatcccttcccaaaactcatacagagattatacaaagaatcacttcccatccattcctgccaagttctgagataccttctacattgaatttctcctataactcctcccttctaccctcacccccctcttgtacttatttcctctgcagatgttatcttctagccagtgggtcctcccactcacccaaacccatgctacatcccacctcatgccctgcttttactcatttcctaagtaggacattctgtctaaagcccaaaggccacagacattattgccctcacatgagaaacagctcttggcctgttgagctccacatataaagtaaaagcatttgatgtgaaaatagatgttataatcagattattacaaggaaattatatgattggaagacaagagctttcatccttggcagccctgactttcctcttggaatattcttcataggtctaatctctagcccttactcaaaatggtaaaatgtaggaaaacttagaagtcacctagaagaaaaccaaagattcctaaatgccagcccatttaaaaattagatgtgcagactccaccccaacatcagaatttagtagtggggacttaagcatttgtatttctgaaaagctcctcaaatcattctctggagcagttaggcttggaaacccctgaggtaagccaatgcctcattttacagattagaaagttgagtgtcaagctatacaatctaaaacttattgattctcacatataatttttttccttttgcagctggtttgctggtaacatctccagatcacaatctgaacagttactcagacaaaaggtaaatagtcttgtctttaaaacagcctcacagaatctctttgcattttggggtccagaggttgatgcatttctcatagaaaccttcctgctaattatatagtcaagtcattgtagtgttgcttgtccagtctgtgggttgcccgactcttcatgtctagccactacttctgtgtccattatgtattgctgcataataaaccactcctaaattgggtggcttgaaacagtgggatttatgatatctcatgattctgtgagtcagctgggccagcagttcttaggcaagttttgcttaggggcactcctgtggctgcatttgggtcgtggattgactgggggcttgggtttagctgaggcagtcaactggagttccacagttcttccccaagcagtctctccatgtgcctcacttgggcctcctcacagcatggtgatctcaaggcagtagttgaagaggacgagccccacagtgcaagcacttttcgagtctctgcttttgttgtgtttgctaaggtcctattggtcatagcaagtcacatggctcagcccagagtcagtatgggaggggactgctcacagcatgaataagagagatgatttatcggaggccgtcaatgtagccattaacctcagctctgtcactgctcgttagcacctagaccagagtatagcagatgtgatacagaacatgtttatctgactttattactaattgatatggaatgccagtagcaaactcttttgatttctaaaaatgacactttgatatagtttaacctgataaaaacactaaacattacacttatttctttgaggggtgctagtgagaatgtaatgacttcatttggcgttttgtcacattcatagtttataatctgctctttctgaactttgatctgcttagaattagcacaaatcattgagaaagacaacttgagtatagaactttatcaactgatttattcttgatctttggttttctaaaaccttccaaaggcatgatacggtgatacacggttctaaattgtatttcttaaagatgaaaacattaggcttgcataagcacaacaccgagaaaagtaagtgatagggttaaatattaattggagaggaagagttcatacacatacacatacacatagagcagatctataaagagattgagtgagaaacctgtgccttttgtgatatataaagtcaatctaaaagatttgttttccaactacctaccatgcaaaatcattttcaagaatgatgaaaatattttctattccttctatattttccttccttttcagggaaaagaaggagcatttatggttagaaattcgagccaagtgggaatgtacacagtgtccttatttagtaaggctgtgaagtaagtatgatacggattaatttcttttctctttctgcgtatattctttgaatatgctggtcacaatcacattttgggataagacatcatctttaaactctggaattttaaatcaaagtatttctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaagcacttaataaactaatagtacttactattattgttgttgttgttgctggggaagggtagttctacctgctccactccctgtaccctaacacttgggcataaaagacaccccacagtcatctcatgcaaatcatcatcaaaatccttctccagagttttacaagccactttcttattggtagttagctctttttttttccttctaatcgtcctccaaagcaaatgggaaagctgtttttatttataccatattgcagatgagaggattgaggttcaaaaagagcttataaagacctacctggagctactaagtgactaatttgaagctgggcttccaatagccaagtcatgtttctttatctacacctctgtgtttacactgaacccccagtgttttggaatgagaatctggtcaaatattgattcggatcttcttttaaatttctatgtgtgcaactcttttttagcagctagattgaatgatcgtctgccttggtgccttccccatgtgccctaccccacagtgcatatatgtatatttataataattaagtaataaaaacgttattttattttgaaattttttacagagtgcctacctacacttgagataataggatgtacctgaattgtcccacagcactttccaatgccagaatccatgtccccagtgtatctcatatattattttgcacatggtaacacctggatgctggctaaagccaacccagtaagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcggttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtggtatctggttttctgttcctgtgttagtttgctatacagcaacaatttattaactgtttcttatatgccaggcataaccatataggtagctagcaagtgatagaactaaactcaaagcctggttcttgaccactatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcctgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatttcaagactgagaaaaacaccagatgccaagcctgagaaaacctccctgacttccctctccaaaatttgcaaatgcacctaaaataattatttaacccttgcttaatcaagctttattgtttattttaaatgttctaacattctttctgttactagtgataaaaaaggaactgtcaaacattaccacgtgcatacaaatgctgagaacaaattatacctggcagaaaactactgttttgattccattccaaagcttattcattatcatcaacacaattcagcaggtaacttattttagtttttcttttatgggcccttgttgtaaaacagcaattttcctggatactactgatcctcctaatattcttaattatatagggaaccatgaaagtaggaaaaaatcctctcaagtcttttgcctatcataatttttagcttacattcccaggaatataacatgattctctccttaatgccagaaagaatgaaattgagtaaactgggtgacttagaaagagaaattctctttataaaaatattcgtagggtttttctgtgtatagaagcaagaggattataaatttaaaatattatagaaatatatacatatcgttggatcatggaccagttgtctattatgacagggttttttgcatgctgccactagcacttactaatcattacatatataaatagaaattatatattatgtatatacattacatttttacagagatgagatcattctacacatattgctcagcttgctttctttactcaacatgtcttagaagtctttccacgcaaacacaaagagcttactttggtctatttaacagctgtgtagaattctatcatagttaccccataatttattcacctagccctctgttgattagcagttggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttctagaatcaccaagaagatcatcaatttgttttcttatcagaccccattattagcctccagcacaccattgtctgtcctatctttttcctggattttgtgcccactgagcagagccagtattcaaccttgtgtgttaggacgatcacatccactgcgatcacagtttaatttttttattaaaaaaatctgacaatgttttaccaatctaaggacatcgagtacattttgatgctaagcctctccaagatgcctctgattggcaaattgtttttactctgagccttcttgttaaataactgtagctacttcaagaatagtgttaccctggtgccattatcacgtagccacaagaccacatcactaagggtttttttttttaacttatcaacttaaaataaaaagtcttgtttatattgtcactgtgaaactcccattggagaagaaatcacttgggaagctgttagccccaaagctttctatgctcgtcctaaagaatgtccgtcttgccttgttaggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgtaagtttttcccaaggaatggctgtttagccctcatcatgggagggcattagcactaataggcctgctgttaactttgcaaggcctagagcaaaagtccacatactgtatcatagacataaatatttagaagttataaattgaactaacagactattaaatcaaatcagtcttatgctcctactttgacaaatataccttcataacaacctgaaaggccatattcaaattgagaattcccaagactctacaaagaaaccagcctctggcctgtggtcttccaaactccacccctcctgcttctcccctcatacccaactccgtcctgcactataaggggcctcagtagttatgtacagacacagcattcagtacacacaagctccctctttgtctcccgcaaacaattatctagtggctaatgatcttggctaggggtagtgtgctttacccttaagcggacagactccttaaggaagagtcagcacaggtcctgaaagaggcctcaggactatatggttgggtgatttcagagtcctggtgctctaagggtggcagagaaagggacatatagggtcggagtaggcatgtctccttggccctgtggcctccttgccctgtggggaggtgcatggtgggatgaagaacagagtggggctaccacccagaactaatgcagtactgaaaattaatgctctaccaacaatatccttttccttcttggtaccttcaatacagtctaatactcttcctaatgtgtctcagctcccagcacaacagccttcaattattggcaatacatatgtgttctctttccctctgtgtcttctctctctctctctcttccccctctctctctttctctctccctctctctccctcttcctctctctccttctctctctctctccctctctctccctctctcagttgtatataattctccctcttcttgtcaacatagtaaatcagactttgtagagtgaccaccattcaggtttgctgaggtctgggaggttttagcactgaaagtcctgtgtcctaggaaacctcccagccccaggcaaaccaggacagttggtcactctacttttagagaatcaatcagtatggtatgaaaaatgatgttatagtaggtctctggtcaaaaatagttgaaataaaaaaattcctagcctgctagagattgagagcactttttaaatttttacttaaacagttatactgtacagtgtttacaggcatttctctaagcactttacaaatattaactcacttaatccccataagaaacctatgagggttgtaccatcgttatcttagatttacaggaaaccgaagcacagaaatgttgaataacttgtccagagtcggcaagctagtaaaagtcgaaaagcagagatacaaacccaggcagacattctagggtccatttctttagttattcttttatgaagaccaaaggaattaggaaagtcagaacaatcacttttaccataattgcaaaattatttggaagcagagatgctatgtgaatataggcctttggccctagctggcttcatgggcatatgagatctgcacagttgcaagggcctagaagtacctagtacctagaaggtacctagaagggcacagtacctagaagggccctgtgcttggtttaatgctctgctgttgtcatcttgaagtaatacttcgtgatttttaaacaaggattcctgcattttcattttgcattggtgcctgcaattatgtaactggttctgccttcagtgattggactgtcataaaactgggaagggggcccctgatattctcctcttgtaggacaggaaaatctggcagaaactttctgccagatttttctcatggttacaggctcatgatgtaacctctgtgtcttggtgtaactttaaaacatatttttgccattaccaagctggtatccataaaaaaatcacaagaagtcatttaaaaacatcacctaatcataaagaaaaacgtcaaactgtgccacaatgggaaaaagtctaatcccaaatgtaggggtcaagctgaagcctatcatgtggggaatatcagttaatatggcgccctcaccttgagccacctgggcagtgactgaatttgttcaaagaatatttctttattgggtgatggacctttgtgccatcacaagccttccctctgaagggagcagtgttgagtaccatgcaggtctccaaaactgctaaaagatgaatactcccaagctcatcaacttgagtgacatgataagcattgtccctatagttaaactaagaaggaagaaaataactaaaaatttaataaattcttattaaaatatttaaaacttcacatgttaaatttagatttctttacacatttgaacattacagaataatcctgtaaattgttaaaattagattaatcatataagaacaagttaatgagcttgtaaaaactgagtgtcccttctcaaaagaagacatttatgcggacaacaaacatatgaaaaaaagctcatcatcacttgtcattagagaaatgcaaatcaaaacgacagtgagataccatttcacgccatttagaatggcaatcattaaaaagccaggaaacaacagatgctggagaggatgtggagagaaataggaacgcttttacactgttggtgggagtgtaaattatttcaaccactgtggaagacagtgtggtgattcctcaaggatctagaaccagaaatatcatttgacccagcaatcccagtactgggtatatattcaaaggattataaatcattctactataaagacacatgcacacatatgtgtattgcagcactattcacaatagcaaagacttggaaccaactcaaatgcccatcaatgttagactggataaagaaaatgtggcacatatacaccatggaatactatgcagccataaaaaagaatgagttcatgtcctttgcaaggacatggatgaagctggaaaccatcattctcagcaaactaacacaggaacagaaaaccgaacaccgcatgttctcactcataagtggaagttgaacaatgagaacacatggacacagggaggggaacatcacacactggggcttgttggggggtgggggataggggaaagatagcattaggagaaatacctaatgaagatgacgggtgcagcaaaccaccatggcacatgtatatatatgtaacaaacctgcacgttctgcacatgtatcccagaactcaaagtataataaaaaaaaaaataaaatttaaaaatcaacttctgcgtggcaacaaaacaaaataaaaaccctatgcaaactaaaagacaaatgataaactgagcaaaattatttgtaattcatattatggacaaaagactaatctccccaaaaaggctaatacctccaaactcattaacaactacactactgcactgtttgtttgtacaatggatcactcagagtcagctcagaatctaagagtaaagtacatgtcaatccaaaaatgtgtccaaattcactgaaatacaatgtagaacagaaaagaaagagtaattggagttgctaagtactttcaaaaggctttatgcttaaccgtgaagacagtaaagagagtaaagcagcagttcgggagcctgtctggagaagtaaaggtgatatggcagcacactgctagagactccgctagacatttagcttaacctatgcatctcacaaatggaaaaaaaaaaaaaaagataggtgagaaaagatatcatgagaaaggtaattaaggtagaagaatcacactttacaagaaggtttgcttgatttcttttaagctctaggctagtacaaaatttaagattgatattacttaaattaataagaaacactaaaggactcttcaattcgcaagattaaacacttccatctggaacatctgattactaaataatagcccatagctacattacgctccattttcttctacttaactttatcattttaaaaagggtgctgggaagaggtacggtaaaaccatctgccataataaaatgaaaattatctcattaaaaaaaaatctgagtgtccatgccatcatgacctaccagaagtgctacatcatatggttagtattttataaatttgttattcaaaaataatgaaaacaataatgtaaaataattttttaaaaaagaaaaaaaatcaaacctcatctgacttcatttagcctacattcttcgtattctaatatacttttttagaatgaaatatttagatgtgaaagttaataaaagagaaatgattgttcttagggtgtggcttcctctaaataagtcatggacgttcccaggatgccatgagactcaacagggtttccagtgcaacagaccattgctaccctgattctctgtaggaaagttgaatacagcattcacaaactgctaaattgctgctgaagtcaccaatgtctgatatgaggcagaaattttttttgcctccaaagataattgtgcttgaaatataagatcctaaacttttccctctctttctctgttcaagtgaaagagggtgggggtgggaattaaaacaaacagaaatctgagagcaactctttttcagtacatgtagaaaatggagtgtggagcattgaactttgaaaatctgttatttccaggaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggtaagcaaagccattggaatttcaaagaaaagaaagcagtccacggctcccacttctggagatggggtcactggtagggaaggcaagaagggcaccatcacttctactttgctcacttgtgacttgtttaagcaaatgacatttttacaaaaatcaatgtaaaaatatttgaagtatggaaagaacagtgagaataaaataagctgttaaggtctacatagctgtgttgtggcaagaaggagaacagatggaaaggaaagacttctgccaatttagtgtctctcaaaaccattaaacccaaattgaccttcatttcaggaagggcttagtgctaaagcagccatttgatacaataactgaacatgaaaaaaaaaaaaggaaatagaatttgtgtgtctttggatcagaatgagagtggggaatgctgtgtttggtattcactgggatttatctttagagattttcttgcgctcaacagtagacctgcattcacactaggccagtgtgttccctaagtcacaggtgcagcgtttatgccttcaaagcatctgtgaatgcacggtatctggtggtggaaagggagattctagaaatttctcatctttccttgataagctaaggttctgtgtttaaagtgtaataccttttcatgttgtttgacaaggatggatgcttggttgaaagtactcatgggagaacatttttattttgaaaaattgaaaattgcaaaggaaaaaaaagacaactttagagcacttgggggttgtgctaggtaatcttagattttgctgagaattctactcaaaaggaggaaaatgtcaggagattcttggtcactttcactacttggtgattttgtttttcctttaaaggctgctcgtaactgcttggtggacagagatctctgtgtgaaagtatctgactttggaatgacaaggtaagccaattccgaaagggcaaccagtgaaagggggatttccattcacatttgaacaccatcataattgaaggctttgtggggatatagaaggtgctctgaattgggggcttagaaacctaagtccctcccatgggattgttcttcagaaattatctgacgtcacttttagttctttcaacaatctgatactttctaaacttctaaataaattccatgaaagatcctaaatttaaatacaacatgttacagccacattattggattgttttactttcttttaaatttttttatttttaatttttgtgggtacatagtaggtatacatatttatggggtacatgtgatgttttgatacaggcatgcaatgtgaaataatcgcatcatggagaatggggtatccatcccctcaagcattttggagtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggcaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagctaccgtcactccaaccaccatacactgagtcccctacactgaccctccaaacatgtagctttctcaagagcaagaaaaaaaaaatctgctgacaggttcttaaagcagggagaagctcccaggtcaagggaactgatccccacctttactctaaaagcaagaatattggctgttatgccagcatccagggaacatgctttcacgttctctgtagctttggaaaagggagacttttccaaaaaaagatccaaagaaaaaagagatcttgctctgagtaagagatcctggaagccatgtaccagccctgttggttatgaagctctgtggccacatcaattagatgcctgtgacttcatttgctcctactagcttgaaggaaggtttaagccatgagcatccccaaaccaggagtgccagggtagtgtctgggtatctggtagtgtctggggagctgaggggttctggggagaaaagtatggaatgtactgtatgtaatcctatgaaagtgtagtttattaatattattgttaatatttagaaggatgatcttcccagccagctattttaaattacagtgagatctctaaaacatttggtgtgtaaattatatccaaaattccaattgccataactcctgttgttctattttctctaattaagagtcattatgtgtttgtttttgttgtggtttttgtgggcaaatatatgatgttctcttttattaatactataaataatatgtacttattataagaaaaatagcattagtgtagaaagtaaaaagtagaattgttagcagcagtgaatccgtaaaggtctgcagcaactcaattcttgcctcctcaaaggaaaggattcatctgaggggcataaggcagagagagagactgaggcaagtttttgagcaggagtgagagtttattaaaaagttttagagcaggaaggaaaggaagtaaagcacacttggaagagggccaagagggcaacttgagagatccaactgccctacttggcccttgacttagggtttcatacattggcataattccaaagtttgcatcttttctcccctgattcttcccttggggtgggctgtctgcatgagcagtagcctgccagcacttgggaggggccgcacgcacagtgtgtttacttaggttgtgcgcatgctcatttgaggcatttttcttttaccagtcgagtattcttagaggaaggtcatataccagttaaactccattattttgcctcttattgcgcatgtttgaccccagttgcccaactcctgagatcatatcaggaagctgttgatcatcagcttcaagtattttctatctattgggagactgccgttccctggcaccagctgcgaccaattattattttagagagacggttaacaactgcctgactattacctgacggtcacctaatattcctgggttgggggtgggggatctctcctgccctgctcatgtctgcctagctacctattctgacagaatctgtccctcattttcagtgctaggagtaaccactgctcagatgtttggtgggtatcctttcagacctcattcttaagtgtatccaatcatatacacaaatatgcacatttactacttgttcccacacacaaaaaatggaatcacattatacacactttcttttgcacataaccatataccatgagcacctttttattttggtgaagagttatctcatttttgaatggctatgtgctattctattgtgtgagtgtgccataatatatttaattactcctcaacattgggaacattgaggttgctttcattttatcattattacaaacaaagagtttagtgaacattcttcaacatgtattttggtcttgatatctccataggatatttttgttcatcattattcataacagcagaagattagtagcaatttacctggttaaataaattatgtttaattccttccataagaagaaataataagagggaatggtattcagccactaaacatgatgctgcagtagaaatgtaaccgtatggggaaatgctcatgatataccattaaaggaaaaataaaagcaaatctcaatataacagaaaccctattttgttcaacttatatatgtgggaaataagatcagaaagtacaaagaaaaatgtattttgagtgatagaattacaggttatctttagggtgggtttctgagtaattttatctttacttttttgtgtttttctatatttaccaaacattttgcattgaggttttgctgtattcagttagatattatcttttaaatgcttacaaaccataagcagcctccagctaagcccacacattgaaaggaaacaaaagttccagaaaactgaggcaatcgactgagactctgggtggcttccgtgtccttcatcagcctgtaccaccacggcttaaggtctgtgttgatgtgttttccctggcaggtatgttcttgatgaccagtatgtcagttcagtcggaacaaagtttccagtcaagtggtcagctccagaggtgtttcattacttcaaatacagcagcaagtcagacgtatgggcatttggtaaggatgtggccacatacgacctggccctgtttcataagcttacttccacaacaggaaaccacaagagtagcaatgtccattttaaaagggcccttgaacacttacgaagttacacatatagcctgagagaagcaagctgttgaagaaggtgatttattttcttgggtttggtattaggatgtcttctacacatcttgtaatttacatcctgctagcactttctcataaaatcaaaagggataaatctactcagaggttgaggtggaaggattgtttgagcccaggagttcaagtccagctggggcaacacagttaagaccctgtctttagaaacatcaaaggggatgaaagtttttccagtgaagatttcaaataattttttaaaaggagtcattgaaagctgaatctgagtttttgctgagccccaaacgttgaaaagacatcaattttctgcatgaaaataatgggatagccattcccttctgcgctgaccaattcttagtgtaaacaccacacatgacttggtactttctttgactcgtgcctagtttcaagtagtctcctctctgttaaaatttatattttagattgggattggcaaaccacagcccaggaccaggtcagttggtttttgtaaataaagttttattggaacacagtcatgcccattcatttatgtattatctatggctcattttgtgctacaacagcagagtagagtagttgccacagatactgcatgtcccaaaaagtctaaaatgctatgtggccctttataggataagtttgctgactcttattttactaaaatatctatattaaaatttagtaaaggtcattagaaaagggaaacaattcttaaattgtgactacattttatgatattttttctatgttgtgagaatatcaaggctattttcaatcactgtcggatggacccaggataagtaatccaaatgtgactgagacctatttcatgccttagttcataagtgtaatttgatttactgcttgtcacctacaagactgcctttgaaaaggggaaaatttagttatttatttctctatgtgacacaatttttaaaactaactattccctttgtaaaagtggcattgttcgttgttaaaaaaaaagataatcaaatacacacagaaaaagaaaaaaaatcacaaagatagcattttggtgaatacttgatgccatgttgtactgattaacttttgtaccttgttgtcaaaattagttttgaggctgagtgcggtggctcatgcctgtaatcccagcacttcgagaggctgaggcgggcagatcacttgaggccaggagttcaagaccagcccagccaacatggcaaaaactcgtctctactaaaaacacaaaaattagccaggcatggtggtgcgcgcctgtaaccccagctactcgagaggctgaggcacgagaatcgcttaaacctgggaggcagagtttacagtgagctgagattgtgccactgcactccagccttggcgacacagcaagaggctgtcttaaaaaaaaaaaattagttttgataatcatgcatcaattataagtgatagcaaaaaatcaatgccctaatttaataattacagcttgtttttgaccaaaaaatagtattacccagcttgattatttaccgtatgccatagaagttggccccagatattttccagctgtttataaacactaaattcattcttaaacaatatatcccagtgaggatacccaaaatgaatcagggcctctgatagcaattcccaaagaagaaccccacagatattttgaaataagtgtgtagccttccaaagagaaagttatgaggaaactgcattcttttggattgttgttttagactgtgtgatttaaaagaaaaaagcagccataaaatttataaggttgctttattataaatatttgaaactggctgactgttgaaattttctgaccttggccagcacagcacaactgccaccatttagagagcacttgaaacatctcagtgctcttttaagtgctttacgtgttttatcctatttaatcctcacagcaagtccatgaggtgcaaataccccattttatagacggagaacctgaggctgagaggggttgagaaacttatcccacctgtaagtgacagaagtcaacttcaaaggccatgtctaactgatcccaaatgccatcctcctgaccaccatgaccagaaccgagatttcttaacctggggactgcaatttcctggatgagttttgggggactgtgaacatcctgaaactgaacacaaaaatgctgtgtattcactttcccaaaggcggccagtggctttcatcagattcccaaaagggtgcctggcccatatgagattaggaaccactgcagcaatagaaaggagaatgttgtcaatgattttatcttgaaatttccactgaagtgtaatctgattgtgcaatgaaattgttgcatgcagctgccaaagccgagagacggaatgggtgaggacatcaaccactcattcataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaactggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcacatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggagacattgtaaaagggtgtccaggtgagaacagcacaagcaaaggtgtggaggcaggaacgagcatggcacgctaggctggtgctatcgttggaagggctggagataagtttggaagagtaggtctggttcaggttctgcaaagtgaataacaaggagacaagtgagagttttggtttttgtaggcgatgaggagccactgaagacttttgagcagtaacatgataaaaggaggcttttgagaacattattctaagagcccatgttcataatcattatatggtacttcctcaatggcaaagggcctaatgctgcattcatttattcactagtaaaaggcaaattggtgtaatggttaagcctgtgggttctggcatcagaatacctgggttgaatcctgtcgtgatcacttactagttatatgaccttgtacaaacctcctattattatctctgtgcttcactgtaatgtaatgcttacctcatagaatttttgggtggattgaatgaattagcattataaaggccttaggacaatgcctggtacacagtgctgtttttctgttattaatattgtgtgtgtgtgtgtatatatatatatatttttttttttttacaaagcatctatgcaccaggcagtacgcttggtgctaagaataaattgacgcacacaacttaaatagtttctaaactcttgtaccggagcctagagtcccactttggaagagttgctgattgcatcacataacaatatttttcgtttagccttaaattatcacctggaatatgagcactctgtaatttcccaccctatggcatttggaacagtatataaggtttccacacctttttctaccccaaatgttgactatgggaactatggatatggacagagatatgcagactacagtggccaacagagcacttatggcaaggcatctcgagggggtggcaatcaccaaaacaattaccagccatactaaaggagaacattggagaaaacaggatgagatgttaaagtaacccatcttgcaggatgacatagaagattggtcttctgttgatctaagatgattattttgtaaaagactttctagtgtacaagacacagtgtccaactgtatatggctgccaattagttttctttgtttttactttgtcctttgctatctgtgttatgactcaatatggatttgtttatacacattttatttgtatgatttcatgttaaacttcaaataaatgcttccttatgtgattgcttttctgtatcaggtactacatagctctgtaaaaatttaaagtaagcaataattaaggcacagttgattttgtagagagtattggtccatagggagaaactgtggtcctttataaatagccagccagggtcaccctcttccccgatttgtagatgtattctatgctcttaaggtttcatcttctccctgttaactgaggtttctaccacacttttgaataatgttctttcccctctggttatctgaagattgtcctgagaggaagacataagtgttgtgattagtagaaactttctagtagaccatgtttcttctggattgtaataaaattgttagtagctccttttgctttgttcctgtctctagaaagccatctttgaatcgttaattactttggctttaatcagtggtcacctagaaaaagctttgtaatcataacaccatgactttaattcttgataaaaattcagatgcacacaggaaggagcactgtaaaactggtaggagctatggtttaagagcattgaaagtagttataactcaaggattttggcagaaaggtatgagtttggtcaaaagttagattaaaatttgaaatagcggcaaaataagatttagttgtattttgttttctcacagccaccacaagactgaacaaaatattttctgtttgggcattctgaggaagctgtattacagttaactgttaatgctgtgtgagtttagaaaaagtcttgatagtaaatctaacttttaacacagttagtgcatgaactgagtagttaaacatttccgtattcagacaggaatagtggaaaaggtatcttaggtgcgttactcaatccaaatgtgactgaatcattacagtggaccctcatggtgcattgaaaagaaactgttttatatccaggtttcagaggacctggataaataaaagctttggattttgcattcagtgtagttagttggattttgggacctttgcctcaatgttagctactgggattggcatatgtgttcacaggcagagtagttgatctcacacaacgagtgctctcacaaaactggtgtaagtttcttatgctgatgagcccccgcttttttttaatttggtgcctacaactttgttacaatgattgtacttgctgggctatcaagttacaatgctcttggtcttttttgctgctgtttcgctatttgtccttacacctaggccaagtaccaatgttagctgttggaagggattctgtttattcattcaacatgcaactatctaactttagggaatggaaggaagttcatttttaagttgtgtgttgtcagtaggtgcagtgtctagggtagcgaatcctgtaagttcaaatttatgattaggtgacaaattgacattgagattgtccttttccctgattaaaaaatgaataaaggctttttaaagaaacaaacaaacaaaaatattgtgtctaagattatcaggcagcactagagggtcagactgggtctgggtagagttggtcacagccaggctgacttactgctgtcacctgtcagatgaagaagagcagacaagggtttttcagttgaagcccagaacctccctggccctccctactctagctcctgggaatatgactgcaccataggatggacaggggccctgagtcgggaggaactgccttcttctcatggttggttcataaaagcatgtgaattgtggcagaatctgtgaagaggggtttgcactgagacgacaatatccagttaaaacattgcacctaatgagcagagcttatagatttgggttttccctccttttttagattttattttgtgactttctcaattcataaagagattgaaagaacattcacaattttcattagattttgattcatccttctggtatttctgtatgcaaaaacaagcatatgtatagatgtgtgttttcttgcttccctttctctcttacaaagaaaaagtagcatatgaacttctcctctccataggcgttgcctcactagcaatgtaagagggtacctattttcttataacctcaccaatggagtgcattgtcaagcttttgaagaattcttgccaatctgataagtgaaagcttgatggcatcttagtgcagctttaatatatatatctttcattatgaggttgagcctcttttcacgtttttaagggtcattttgtgtctttctgaactgtcatgtcttttttcttttttctgtcaggttttaaagatctctttacaaattagggagagtaatactttaagttatcagctttatttgattgagggtgggtgggtttttttttctttttttgaccatgcagaaatttttcttaatatagctgaatatatcaatatttgttttcattgcttctggaaattgtcatagataggctttctcatgcccaaattataatgacttttgccaggattttcctctagtacttttaagattgcattattttccatttatgtttctgatatagtttgtgtttgttatggtatatggtattaaatatggctccaaatatataattttatgtgactattctgttgttggcagccctatttattaaaagaccatcttatcatcaggaatgagataccaccttaatggtggtgaaatgccaccctaatattatactaaatttccatatgtacttgaatctatttggagacttcctcttctgttctttggtctctttgttcatgtgctagcaccacactgctctgattctgtagagactttatgatatgtttgaatactaggtaggctagcacccctcattgctcaccttactgtataatttcttagccatttttacatattttttaattctataaaccaaagaatcaatttgtttagcttgaaacaaactcattcatatttttgaggagattgtatttagtttgtattttaagttgggaaatttgacatctttatgatactgacttgtcctagtctagaacgagggaagctttttttttttttttttttttttttaagacagagtcttgctctatcactcaggctggaatgcagtggtatgatctaggcctactgcaacctccaccttccaggcttaagtgattttcatgtcccaccctcccgagtagcttggactacagttgtgcacaaccacagctggctaatttttgtatttttagtagagacagggtttcgccatgttgttcaggatggtctcgaactcctggcctcaagtgatccactcacctcagcctcccagagtgctgggattacaggcgtgagccactgcgcctggccagggatgcttttttatatagtcaagtctacatttgcatttttcagcagtgttttaaagtcgtccccattttagaggggcacacttttttagtgttttattttggtggcgttgctattataaatggggttttctcttacatgataacttctaagtggttactgtaggtatatgtgaaggctattgattttgtatgttaattttatatcctgctctcctagtgaattcctttattctttaagtctgttctaacattgatactctcagattttccaggtatacactaaaatgcttgcaaataaagagactttttcttttccagttattggggctctaattgttcttgctttccaattgcattggttaacaccttcaacataatgttaagagtgattattatagtgagcgtccttgccttatttctgacctcaattgaaatgtctgttgtgtttccacattttaaaagttgctagctttaggacttagatgtaaatattttatatattttatcattgatcataactctcatcatctaaaacattgggtttcttgttgtttttgtttagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 210 - DNA, 41037 bp, Homo sapiens
gagtgtgtaaatctagcatttattgagtgtctgctttgtgctcagcactgctcaaacactgtgagcaaatacaaaagatttaagagactgggtacccacttcagagggtgaacatacagttggaatttccattcactccacagttagagaacagtagaaatgagtttctatcaggcatgctctgggagttcacggaggcccctggctctagttttgtgttgtcagggagatgttgatcaagcaccttggaagtgaaaaagcaatgtcctctacctgttccctggattcttctctctttagacctgtcaccttgaagaaagcatgatcgattccaaacatcactgtaggcaaatcaccatagtacttgaactgagttactgtgaagaaagcatgtcatccttgacaatggattaaatgaaagtgagctaatgcatgccattctcaatccttgcagctacaccagttcccaggcactgtccttacaagtgatccatccatattccatacaagatccaacacttgctccaatgatatatccttgttttcaacttcagaaattcaacagacatttacatttagattatccctgaacagcctgtgagaccaaatacacactttccctaatatactctaatacaaaatccttattaagaaacagaacagaagtcaaatccagagacagaaataaatactgaaagcaatgtcaatgaagatgctctctccttggccatgttgtctttggacaattttttttctgaacagagtcatagttttgacatttaatgatatctttatcatcttatattttctataccatgaaattaacatttacatacaacaaaatcacctcaagaggaaaaacatagatttttctaaaaggaggtctgaacatcatcagtgttttggaatcctggattattttctcctttgctaatatcgatggaggcataaggattttctccacttcttgctttatttttcctgttaaatagagcaaggttgccttaatatacttatgttaaaatcaatcggactgatgaaaatcaaaaagtttcaggggaatctgtgttaaggaggctgggagggaggaacaggaagtttcataaactgttgatgtgagtataaattggtacagccgctattgagggcaatttggcaatatttatcaaaattagcaattgcacgtatgctttcacccagctttcccactgctaggattcatcttaagggtatattggcatactcaggaaattacctatattaagccatcactttttttaagtaaacacaaatgtttggaaacaacataaaagttcatcaatagatgactgtttatcaaaattacaatccattcgtgaaatgggaaattatactgccagaaaaaaggagaagttttttgtgcaactaatgtgtaatgatctctaaaacacattaagtgggctgggtgtggtggatcacacctatataaataaaaatttaaaaaaaccattaagtggaaaacaaaatatgcagaacattgtttatagcctgctaacatttgtatactaagaaatgagatatacatatgcacatacacacaaatatacacactaaaaaagtatatatttgtatactaaaaaggagatatatatatatatatatatatatatatatgtctgagaaaaaagaaaaaagactgtgtgtgtgtgtgtgtgtgtgtgtgtgtgtgtgtgtgtgtatctccaaggaactgataattttgtttggctttgggaagataacttggaggcaaaaggtaataaggaagactcttcatgttcacctttgtattttttaattttaaccatatgaatgtattacacattgaatgcctaatattttagatggagctattttggagaaacgaaaaatctctatagtgaagaaaattgagcaaaatagactagcaaatatagagattcaatcaagaatatgtttaaacaagctgaggtgtgcatagagttttgttaggtgctataaaatattaaccttcattccataagcccagcaagagtcaatttcttaaggacagaagaaaaacatctagtagcaaagcaagactagaaatcaggtctctggtaatttaaatcctcaatgaactttgatcttcagttcaggaacaaattagaacgtgcctaaccatgaactaagagaatgacatagagtctgagctacccggtgagaaataaagctgagtaaagagtagcagtttgggcagggcacggtggctcacgcctgtaatcccagcactggagggcgaggcaggcggattgcttgaactcaggagttcaagaaaagcttgggcaacatgacaaaaccctgtctccacaaaaaatacaaaaattagctgggtgtggtggcacacccctgtagtcccagctactcaggaagctgaggtgggacgatcacttgagcctgggaaatcgaggttgcagtgaactatggttgcaccactgcactccagcctgggtgacagagcaagactctgtctcaaacaaacaaacaaacaaacaaacaaaaaaccaagagtagcagtttcaaagaaatctcacagcccattcttgaacaatttcacggttcaaacccatcagcaatccagtctccagcaatccagtccccacttttagactgaaaaggattcagcagtgagagcagtgaaaaccattccctgagcccacccatacctgctgagtttgcagtgcctctttgtaggagggaaatgacactgtggctgggatggagtttactagggcatgctaataaatcccaggccagatacttactgtgtgggcttactaggaagatgaactgctgatctattaaatttctagggaatgcatcagagtatttagttgcaaaattgtccaactaagtaattggtctatacaatctaccacttactgaaaattttccagttactgttctctaaatctttctatttttggatagttaagtctaggaaaggccacttacttcttccgatctctgatcccagtgaagatcaggatgacaatgccaaccactatcactcccatcacaactccaaaaacaatcagccatatggaaacagggggctggttaggaggtccaagtgttggctgtatccccagaaactctaggctgttgtcattcagacggaaagcatcattgatacggctccgggacatcctatttgcaaaagcaaaaaacagcaaaggggacacttagacaaaataaaattgtgtgtagttatttactgtttatatcattgttcctgaaaggatataatagagcttatcataagaatatacacctagccaggcatggtggcgcatgtctgtagtcccagctacttgggaggctgaggcaggagaatcgcttgaacccgggaggcagaggttgcagtgagccgagattgtgccactgccctctagcctaggtgacagagcaagactctgtttcaaaaaaaaaaaaaaggaatatacacctaaaatcataagagcaaagtaaataggtctaattaaagatataagtctttgacaattatgcatctttcatgccttgcaacctagattaggttcatcaacagctccattggaaaattgagttgtaagtgtggaaatgtataaatggttggcatttattcatttgtgactgctgtgtttaagggcaaagttatcatatttggcaagaatttcccttctgtcagagtacatctacaatgactttatatcaaataatggaaacggataattggatacacctcttctattatacaaatgaatcaggtcctatgaccaagtctctatagtagtattttccaaataaaaggtattggcatttggaggtagcactggggaggcacataagaaagggacctttgccagtttcttcagcactgggatgggaaatggcttacttttatggaggcaaaaggataaagattgtttaaagaaaaaaaaaaacaatgatatggagaacattctggatcaaagaccaaagtgtctggcatctcatcttcctacccttgggtatagcccaggtcaggaggtcagagtccaccagagagagagagagagatcaacgcagaattagtcaggtaacccctggcaacctcagccagaaaagatctgaaaagagtcatcctggaaacagagagtctgaggtcccctgtagcttgcagctgagtatccaggaaggctgagctttttcataaagatctcagccagaagtttttcccaagacagacacaagtcttctggaggaagtgagtgagtctctgggcacagttgggtcatacactccaaccaagccagattttctaggcacaccctgcccagcaggtcttagatctgcttccgaagttaaacaggactctgacgcagctcgagagggccacctagtgagctgcccagaagcagtaggtatattaagcctttttataatgacaggaaaccatctgcaaggtcaatccattcttcgctcctgctgtctgttgtgggaaacaattgaggcaaattggacaaactgtttcttctaaacattcattgcaagtccctcacctagcatagaggccaagcaatatgtaaggaatcctgtacttgcctaccttgtttcaggatttgggcagttaaatgaatcctacatcaaagtcctgagagcaaatgatggcaatacctgtccacgtcccttctgcacttactattttccatgagttctagccagactttcttcaaccagcacctgctcccctttaccagagagcattctcagaccacaagatctgccctgcctgcagggctgaaatgctggggaattaatgccacctggaagcagttctcagccaataactgatgggaggtggtaaataaataccccagcttcctcagccctctgatgggacaattcaggtgcacattctacacagtctctccacatttcccagcaggactgagctctagttgcccatagtggtaacttgcttgataacatgtaatctatagtttttcttcccttttgtaagagcctacatctggcggaactcaaatcaagattattcccctgctgtgggatccttctggaattacgtggagtttgtagcatgaggtaacacatgtaaatgactcagaataatgcttggcacacaggaagaacacacaaaatactggttattgttgttgtatttggtaaccccctcacccttagatgaaagtaaaatgtcacctgatggccttttcaacttcagttctaggaatgatatcagacacatttttaggtgcagtgacaaagaaattaaaggagattcttggtttcaaattagccactcgcacatcctcctccctgtagagaaacaaaacaaacatcttcacttgtggcacagaggacacaatcaagagaatgaagacttcccctgctggtgaaaaggagattagagagagaatcacaggatagagagacatgggggagggcaaacaatgagaggatgtaattgtcaaaaaaaacattaatgctgcccaaagcacatgaaatcaactacataaaaattgtgatatcaagttttggcactatttgttctgcctttatataaaacccacatctttttcaattatagaaaatttccaaactgaaaacagcaggagaatcaacaaggaataatcggtggcccaggattgtggcaaacaatgtggtgggcagaaatggctgagtaccacacacggatttacacccacaacctggtcctacccagcagaaaacgtcgtgttgcacccatggatgaaggtaatgagtggggtctaccatatgatgtgacaggactgtgctctcacagctgtcaagcgatcctagcacaaaataaggtagatcatgtggctcatagcccttgagtgactactcatctaactcagaataaaagccaaagtccttagaatggccttcaaggcccacatgaccttttgtctctccctccttcctctatgccctaacatcgtcctggccatgtctccacttgtcttctaatctgctccagccacactggcctccttgctgttcctttaacaggctgaggatattccttcctcagggtctgcacctgctgtttcccccagctgagacactttccccattgtctgcattgctggctctcgctctcgctctctcgctctctcgctctctctctccctctctcctgcttcatatacttgttcaagtattagtgacgtcttttctgaccattttggttaaaattgacctaccccctgcccaacacacacacacacacaccagccctccccagacccttttatatttttctcctagcacttagtaccttgtaactctatatttcacttacatattacacacatagacacatacacaacatacatactagaatataggtcaatgaaggcaggaagttctgccttttttttctttcagtgctgagggtgtatgagagcattctgagaagagagtgacagctgtttagtaagaacaatactcttgcaatttaccagtcaaataaggcacgatcagccctctatggagtcacccaaattccacaataccaaagaagtataagttactaggagatttttatcaatttcacttgaagaaaagtttaggcagagtatctcctcagactcaagagtaagagaaatcctagttggagtaatttgagaacccagcaaatcaactcacccaaaaagaatcatctgattttttacttttaaaaagtactgcctcatagcatatgcaacagatgatcggaacaggtacatttcattgtcgttccattcatactgcaaattcagaagaaagacactgctcagagggactcgtaagacacatttataatctgatactcctcaagaattattcttaatattccagagattcttgctattcattaagtcagtgaccttcaatgtaagtgtgcatccgtatcacctgaagggttagttacaacactgagtgctgggtccacccctagagcgtctgattcaggaagcccgagatgaaacccaataatttacatctctaacaaactcccaggtggtggtaatgctgctggtcaggcaaccatgctttaggaaccattgggttcacgggtccttttactttagtttgatgtaaactgaaattaacaccttgagtgtaggtttaccgatgggagtcaaacaaaagttgtgggttttgtagcaaaatgtctgtaccttgtggacaaaatcagtttttactatttttatggtacgttctcagaaatgtacttatctataagtgtaaaagaaaaacttgacattcaaatgaaaaataacactttgtaaacagcaagctaatctgtttgttcttgttttccagtgctaaacaaatagcttatgtttgcatagcttttaaagacttaaaagaaagcattcactctttcctccagtagctggcagtaggaatcaatgaatggcactagttgtatgtttctcctttccctttaaaaaattataatatttcacaaaagaattgttacattcacttcagcttggtttcaccgaggtttagaggagttcctttaatagtaataatattattaatattgttactaataacagtctggctactatctctataaatataaaatataaaagattttaaaggctgagttctcaaaataatgccatagatccattggaattcaccatgaaatagtttgaactgagcagatattctgaccctgttgtgtagatgcactaaatatatgatctcgtttcatcaaaacagattgttgctcagtgaattggcctcagaacattacagaatcaaaccccctgaacactatttaccaaccctcactgcatggaaagaggatgagtataaatgtcaagaaaaaagataattgaaaatatcctgatctgccgagactaattaaaatgtattaagccaaggaagagctaataaaaatatgacagagaaatagtcccacaatcacccaatgattattatgaaataggaacttgaactcttaatgattggaaagaaatgcacttccattttcattttttctttcttgaatgttcatctttttactcctgagttatttatgttttgatgtcttaactatgaaaattatactaaaagtgttattgaatcttggacaatgtttaacttttcaggaaaggtaagggggtagaaacacaatctttggatctatccaatgcagacaacaatttgctgtagcatcttggaccattttatccaatagtcccagattgacttctaaccctgcaaagccttcagggtgtcatacccactctcaggcttttgagccccatctacccgagactactctttcctctcctctttcccaatcaaagctaccacttcctcagactggatcatctgagacaggtgttaacgacagagcaatagctaagtaaataattcacattaaggtgtaaataacataatttcctgtaaaatattttgttacccccaaaatgcatttccctaaataagtggttctcaaactttgctgtgactagaatcacctggggagctttaaacactcttgatgcccaactcttgactccataccccagaacaattaaatcagaatctctggaggtgtataacctaggcattaatattttttaaacttcccatgtgattccactgtgcagccaagtttgagaagcagtgttctaaattagagcttcccagtcttgattgtacgtacaaatcacctggaggcttgctaaaatgcagattctgattaagtggtccagggctaggcttgaaattacgcatttttaacaagcttccaggtgattcaaatgctgctggaccatgggccacactctgagtgaagccaggatacaggtgattgactaaaacaaaacaaactaaaaaaacctaactgtaccgcttctaaaaacaaactacctttcaaaatataaccatattctctttctagaataaaagtaatggtgacgagagtcaattgaaaggattggtatctgatatttaaggattgatacagatattttctcattgaagttcataacaccttcaaggcaataagaagtaggaatagcttatccaataaggaataggttactttaaaaacccaaagccaaaggccagaatctggaacttatagttttgaaaagaaccacatggcctctcttctttcagttcacactgaaatgggtttattgtgtcctatttaagtgaagactgtgcactcaaaaataatcaattcactgtccagaatactcactgctttatctccaagagctgattttaggcttatcctcactttgatgctttggtctgcatctgattaaagagaaatagcagactgctggttacagacaacagattgcccacatgtgcttatttccttttcctccaaagatcccactaaagtgatagtaaagggatcttttaaaggtatcaacaggcttttggaaaacgagaaatgatgagacaggggtaactgctttctcagggacaggaagccatgacctaatttgtacacagaggaggcacagacccacaaagagccaaaaaatccaaaagaggtttggaattcaagcacaggtgagggtgggaaaataatactgggctgaaaagaagaggaatggaagtcagggtgtggttaaaaccactttggagaacagttgatcctcctaccccttgtgcccctgcttggacagtctgtgggaggctatgctccagaaaaacaagaggtaatccaagaaagaagacatggaatctaggaagcagtggattcaacccaggagaacaacaaatgttgggaaaggagaatataagactccaagagggaagtctctagggaaaaaaaatgagactgaaaagaatagatatgttgaaatatttgggagaaaaacaaatacaacgtagatagcaaattaggtaagccgaaaaattcaggcaagtagaaactttgagacaaacaacaagccacataagaaaggacacaaaataatacattacttggctcttcaggcatagtgatgtaaacattgataactgttttactaaaaatcattataaggccttattggaagagcaagaaatggaagtggaagagtagaccaaaacgaaggtttaaaactgagcaataacaaaatagcaatataagaaaattatttagaaatatgaaagtgactgccagaaagaagagataatagcattaaaattgttttaaaaaaagtatttgtctttggaaagcaggattcgagtacagttggttggagacagttataatatgtattttaaagatgagactaataaaacagacttgaaagagtacacactcttgtatgtgtatgcacacatgtgcatgcatctgtgtgtgtttgtctgtacagttgctttcactatgtctcatacataggtgctcaacagttgtgatttttctcccataaaatggcagctgtcaccatagcagagaaagaagcaggtactatagagaaagaaacattctcagctgtgtcacaagtcctcatgagactggggccaaaggagactagacgaagtagacaaggaatgggtgtgaaacttgtcaactgggtgtactcacatggactccagtcggtactccatcccacaaaagaattcttgttctggtctttcagccaggtaaataagggctcaaagtagttgagcagtggccttacattcatgttctttgctcctacaacattttccaatgctagggtccagggttctgattttccaagcctcagcatattgctacacaaaaaaagggggttcagggccttttgaggggttccagatgtacatatatttacatctatgatctatggtttcttctctttgacttggctaaatttgcttctggcagataagaaaagaatgcatattaacagatatattccaccctaaaccgctctttccttccaattaccaggaagagagggctgtagttatgatagggagaaaagaggtggcccacccaattgttgtatggtctaggttcctgtctgaccacaaattaaatgtttggtttgtaaatgaggacattttgaggccataaaattttctttttagaacaaagaaatcaaatacaaacctaggcatggaaatgagtaatactgaatactaggagaggttcaacattttgaggtatttcttacaacagtttctgtccagcttctgtagagtttgagatgtcacatttgtgcagagggccttcatgtttagctgcttgacaaagtgcttcttgaaactggaattggtaaagggtccttgtgtaatatctgcacaggagacaaagcaacaaaaaagcagtcccgtgtttacttactgtcttagagttatagattagggcatatatttaaatctggagcccaagtaaccaaagagatactgatcaaatctctgaaatctctttctccagacatgaactctacactcatcataacctatttgtgttttatgtatctgttgataaacatggcaatattactctgttaaatgttagctaacatttgttttgtgttttacagattaatagccctttcacataaatgatgcaaatccatccttataacaggtcgataatattattttcattttacaaataaactgagctccagcaaattcaaggactggggttactaggtgaagaacatatgtttttggacttcaagttaaaaattctctatcacaatgtacaataaactgccagtaacaagaagacaaaactactttttatttctcccaatgatactattgattgctgatgacggggacaagatcttacacaagtttaatttaacccaataaattgtgttagtttaaattgaattgaaattgatcatctatacagacagttcccaacttacaacggttggacttttgatttttcgactttacaatagcgctttcagctgtatatgttaatggtaagtacccaaagtttttcactttcagcacagtattaaataattacatgagatattgaacactttattataaaataaggtttgtgttagatgattttgcccaacagtaggctaatgtgagtgttctgagcatgtttagggtagactaggctatgctttggtgtaccataggttaggtgtattcagcgcattcttaaggtattttcaacttatgatgagtttattgggatgtaaccccattgtaaagcaaggagcatctgtattgagcttggtagttatgggtggaaatagaaaaattataattatcacttcatttatccctactttttgtcgttattagcacagctgtccacaaaccctagaagttaaacagaaacaagaaaactgtaatttaccgaatgaatgagtaatcattagaaacatggaacagagatgcggggtcacagtatgtttcatcatggggcacaggttccaccaccccaactatctctcgcctttggggagaaaagaaaacaatacattagctgtggatcacccatcacaagcatcacaagcaggtgggcataactagtgcagtttcatcaatcaaattttttttttttttttttgagacagggtctcactccgtcacccaggctgtagtgcagtggcacgatcttggctcactgcaacctccgcctcccaggttcaagcgattctcccatctcagcctcccaagtagcttggtttataggtgtgcaccaccacatctaactaatttgtgtatttttaatagagacagggtttcaccatgttggccaggctggtctcgaactcctggcctcaagtgatctgcccacctcggcctcccaaaatgctggaattacaggtgccaccgtgtccagccaatcaatggtatttacattagaaatggttgttgggtgaaatagaaacaatgtaaaaaaaaatcacctacaaaaataaaaaataaataaaaatttttaaaaaatcagacagtaaagctcattatgtagttatctcttagttttaattaattcagccagaatatacccttggaaaatagctatgtcttcaaaagactaatttaataacattcataaagtgcattgcatggccaaaaatgtacagtgaaagccctaataattcctctcaggcaccacacttcatgtactcctggcagagagaatttaataaaattgaaatcttacttattctccacgcctacctagctcaagtgttccctcctctgtgaagcctggccctgatcccatccaccttctggcagaattaacccctcaatctcctttagccttctctagttgtgcctcctttgccatttatctccccgttttgtagttattcaactatagtaacttcctgccctagagacttgagctcctagagggtggggctgtgtcttggtcttctctctaattccagtgtcaaacatggtgcctgacactacagaaagaattaatttatatttactgaacaaaggaacaattgatgcattaatgaatcactctaaggatctgattccatgtgcctttaaaataagctaagaggggtcaaaagattaatccaaccagaaaaaaaggtagcaaaatcatgtatttggctttgattaaatggaatacatttttcctttaaaattgcaggatcattgtagacataacttcagtaatatttaaacactggcaacagttcttataggtgctgcgtctttcctcccaagtacgatttatgttaacagagagaatcttgacagaagaagtgtactgttttaaacctgtgcatgtggaactgcttgttacacatgagttcttcacttcaaaaagaaaatataagaaaaataaagaaagaaataattgaccagggtctatgatggtaaaaagaagatagatttctttcttgtttccattctctccctccctctctcctttctttttttccttctttttctttttctcttataattccttcctccaaaaacctatttatttcatacttgcatgtgacaggcacagtgtgaggcacttgtgacacagcaataagtaacgtagtgctgcaaccatggaaatggtcactgttgcccaaatgtgtcaggttctctctagcttggaattctctgtgttcccctctacacccacacctttctcagggcttaaatgcctctcctcatctgacacccccagttgggctttggatctcccctggacgctaacggaccctgtaccctcccatcacaacactacaaattgcagtggtttaattttccacatcctgccataaactaaacgttttttggggttgaggaccatacctgaaattattaacattggatccccagtgctttgcctaaaatgtggggtcaccgttttgtttaaaaggctggataaaagaatatgtaaaatgaataaattgatcactttcaacataatatcatagtttaatgagtaagccaatacttaagaatatagagtatgaagtagtgtcacctgacccaaggaaattttatctgaggagatggtatccaaatggagactaaaatataaaatataacaaactaaaaatacaaaaagtagttagttaatgtgtgcctctgtgtgtgtgtgtacacgccagtcaaatgcttttaaatacacagcaaactcattagaaaacattttactgattgcatattcattgacttacttcatctcccaccactttttcatccactggtctttgggaatttcccctttaaagaccatccacctccacttctctaacatgtaagtaaatggcagagtcccaacaatcgtgagtgcttgtttgagcaggaagtttatttctgtttctgaaagtaaaatagaaaaggataaatattacgatgaagatgacagtggatgttttgtgttaaagagaattttcctaacctcaaaatattattcctcaagatgtacttactataaggatacatgagaaaaattgacagtattcataatgatatgtatatatttattttctcagctaagggatttggagtaggttgaagccctggaacagaacaggtaaataaaacccaaagttacttctaatcctcattttcttcattagtttcagtttcctcccttaaatacctcttatcagagttcattagagctatttcatccactttcccagtcacactgtttattctggaaagctccatgaagtcagtgactgttaatgtctcatttaagactgtataacttagtcccatgtctgctacgtgatgccttctgtgagtctttgttaaataaacaaatactaaacagattcagtgaaaagcctgtaaaccagggaggggaaatgaaacaaaagagccctcctggagggcactatccactggatggtgaaaagtacaatgtactttaaatgtaaggatatcttccttaccaagaatttaaaatgctttaacaaatcatgttatttcattttatcctttattagtgacataaagaggcagtggagttcatctctagtgtatgaaggaaatgcattgaaatgtaagcaggggatgttatctacttttcacatcactgtgtctccagtgtctagaaaaatgtcttgcacacagtatgtgctcgataaatatgtttggaagaagaaagaaagagaaagagggagggaggaatggaaggaataaaggaatttatttaacattattcacaaatcaggggcagagtcaagaaaaaaagcaggagttttccaaaccggtggtttaaccatgtctaatactatcttttttataaaaaaaaacaaaaaaagcttttattttaggtttaggggtatgtgtccaggtttattatataggtaaactcgtgtcatggggtttgttgtacagattatttcatcactgatctaatatcatcttaagaaacatagtcatcaaccatttttacctgctgtcagggaatatttaaaaataataaaatatctgttcattgacttgaattaatgatattttaaaattaggaagcaggtatggttactgttaactacctttgtttgttactgtcttcatgggaggatgctgctactggtctgtaatccactaggactgtgcttacagtaactatttcaaacatgatgataggctttacactggctcactcccaggcccttgtgggatcaccaagtatctggaaccagagatcaaggcaaagtgaattgtctactcaaggatggagctcatgaccttgacctcatcgaccaaatgctccagacagaggagctgatctttatgtcacaaataactaaaaataggggagagaatatacagaagagaagaaggtattaggctctatttgtcctccatttatgaggaagaatcaaaagccatggcatcctcactgaagaaattggatctcctgaacatttgtcatgttccatcaagtccaaggcatctaaaaggaaatgggctgcctcaggcagaaatgttgaaggatagcacagatctaaggggatgttacaggggaaattcacgcttcagcaggatgaacaaaatgtttcaatcccttctaatcttgatattaaacacctgttctttaagaattccaaaatttaaagctacactttgctttgcataatattatggaaaagactttagattagggctcttgttctggttccgccactacattgcgttttgacttcgggctactttccctctcttgtcttcagtttactcctctataaaatggtttttagaatatattccaactctaaagttttgggaagtttttacctagaaccagaggggtctagttagaatgctgacactaattggacaagccatttcagttctgtgagactgtttcatcatctttaagaaaaaaacttctgttagatatttcacaggatcccaagtccattcattcagttacctctcttattcccttttcaataatacaaaaccaaaagttgacatgttctgatatatacttaaattttttcaccagtagtaatttccagttacccataaatacctcataccttatgtggcaaaaagtaaatatttcctacataataaataccttttcccatatcagattaaagaacctccaaaacaagccatgagaaaatgtccataccattgtcttcttgaaaatcgggtgacagaagaccaatggattttaaatgcttaggtgtggctgcagaaagtgacatgatttccccaacagcttcatggaatccttcattagctccatttcttagcagaaaaggttgtgcagcatatgccatatcatactggatatgccccatctcatgatgagctgtcaggaagtcgtccattgtcacctttgtgcacataaggatcctgcatgaaaatggacaagatgaaaatgaatctcactgactttcatttaaccattacagtggagttgtatggggttttggtagcatgaatcatctttccaagatttattcaccagtgaatcttgagtacccacctcttatgtcctagagacaatactagttgctcaatataaagcaatgggcacagctgaatcctgttctcttgctcatagactaacaggaagacagataagcagagttctccgctacaagaactctgaggcaagtactctataagtgatcagtacacacagccttgagcgtaaaaatgagtgaatgtaggcacagttccctagaagcaccaagaagggcatgactgaggatacaatgagcaatttggaccttaatcaatgtgcaggagtttgcccggtagatgacatggaagttgacgttctagtgctcaatgagaaaggcttaggggcaggggggtggaaatgtggcattcaggacactgcacgctgtttggtattgccaggatagagaaatagtagaaggggctgcaaattgaaacttgggaatcattagcatgtaagttgggaaatagatatgatgggccatggaacaggaatagaatgcaagaaaagaggaccaaagataaacctttagaaggtccaagtacctaaggagtggggagaggaagattattcaggggagacggagaaagtacaatcagagaggtcaaggaaatctggaaaagaatgacaatgtggaagtcggttaaaaaaaaaaagcatttgaaagacaacttgtaaatcttgtctaatgctgctatagcccagtgggataagaactgcatttggcaatgagatggtggtcctttttaacttagcaagagcattttcattcagatgggtgtaggggtcatacatcagtagattcctaaatgtatttcataccacttggatcatgtcaccaccccctccaatatcctgcgaggcctcctcattgctcaagaataaactcagccaccttttatacaccaatatgaccctgtaaaccaaaaactatttgagataggtctcaatcaattcacaagtttattttgccaaggttaagaacatgcccagaagaaaagaacacagaatttatagaaacagtctgtggtttgtgcctttctccaaaaataattttgagggcttcaacatttataggagaaaagtgagctggagaggatagtgggagggcatggtaattcacacattgcaagagaaagggggaaggtaaggaaatattcagttatgtattcatctcatgctcagtaaatctattttcctttcacaaccccaacctacttttctaatttggtttctctctattctcttttgaaataattataaaaataactactatatatttaccgcctactgtatgtaagattctgtgcttgaaaacttacttatactttctcatttttaagcctcactctagtactggcatcagtaaactatggcctgctggccagccattgtttttataaataaatttttattggcacacagccacatccattggtttgtgtattgtctatggctgttttcatgtcacaaaggcagagctgagtagttgtaacagagatctgcaaagcttaaactatttactatctggccctttacagaaaaggactgtagatccaatccctaccctagtcaatgctggtgcgggcctgccaagactttatccaccatcccctagctgcctgagtcacagctgataagggcctacagctgctcccttcactgcctttggctaaatgggggttatgctcccccatactctggggcagtccacagccaaagactgcctgatataaaaggctagcccccttgtcttgaggtgtggcctagtctgtggctcaagttatgctccagagagcttcatgggataaggctgaggccaagtttccagtaaagatcacattcttacttacctccctcctttgtcccagcctgcttccctcattcccctctgcctcagagctctcctcaatgaagcacttgtaaaacgatctccttttcaagctagggaatccaacctaaggctctcacaagcctgcaacctgggaattactattctactttataaaataaggaaactgaaaccaaagaaagttaaataccttgtccaaggttgcatagtcattaagtgacacacctaggattctgaagcctgtgctcattctgccacattacacaaactctccttcacttatttctcattctagcctaacttgccgacttcagtatgcaggtcaggtcctgcctctctgtatttgatcctgctgttctcacagcttgggtcctcctcccgactctgtgtatctgaatccttcttgtctttccaaacctaattcaaatcccacttgtaaagcacggtctgatcctatctcctattgcaaatgtggtcagttttcttccagttctccatagagcatgccctgtgtctctcttacgacatgtaccactttctcccttcgatccaagcgtatttattcacctattctgtctcattcacaagagtgaaacatggaggggaagatcaatgtgtgattcatatgtccatcttccaaaaatcttagcaccaaatctttcctgatatgggtgcaaccatccccattaccatacaacgccaatggatgcatgatatttccaagaaagcagattgtccacaggttcaagttagagcctgctggcaatcctcttttcctgggaaaacccaaatgtgctctcctggactcccagccttagttcaaggagaattaacttatcttttctgtgctcagaaaagcagagaaagaattcaagttaaacttcagcctgcctctgttgtctcccatttagtatcagttgtgtaagtatcagccccactacctgaagtcgcccttccccaggtcccaagctgtgggatggcagactgctttctgaacatttcctgggtccgttagcatggaattttcccagaatccttgagtcatattaggaagaccaacagatacaaagaacttctcggcctccttgaatattctctgtgcatcccaggcctgggaaaagagaacagtattaattccagcatcaaaacaacagcattcttaaattaaataagccaggcaccgaaaaacaaataccacatgttctcacttatgtgtggaatctaaaacaatggaactggtagaagcagagagtagaatggtggttacagaggctatggggtgggggcaacggggagatgatggtcaaagcgtacaaagtctcaaacaggatgaataagttggttttatttttttgagatctactgcacagcatagtaaatatagttaataatagaacattgtacattttgaaattgctaagagagtaaatttcaaatgttctcactgcaaaaaaagtatgtgaagtaattgatatgttaattagctttatttatttttcattgtattcataaatcatgaaatcaccttgtaccccataaatatatacaataataaatgtcaatttacaataaaattttaaaatggaaaaaagtgctaatgtcatttttaaaatagcagcattatttctgttggatatatacattggcataacctttccaaaaggtaatttgataacacacacggatagcatttgaaattcttctctttgtctcagtaatgctgtctctaaggaactaacctaaaaaattatcagaaattagattcaacaattacattgagaattatttttaatagagaaaaagttgaaacgaacatcagaatggttaaataaataatgatacctttgaaaaatagaataatgtgcagccacccaaattatatttatgaaaaattttttggtttatatccaaaagacaggcaataacaaatgctgatgagggtgtggagaaaagggaaccctcctacactgttggaaggaatgtaagttagtacaaccactatggaaaacagtttggaggttcctcaaaaaagtaaaaatagagctaccatatgatccaacaattccactgctgggtatatacccaaaagaaaggaaatcagtattttgaagagatatctgcactcccatgtttgttgcagcactattcacaataaccaagatttggaaacaacctaagtgtccatcagtagatgaatggataaagaaaatgtggtacacatacaaattggaatactattcagccataaaaaaacgaaatcctgccatttgcaacaacgtagatggaaccgaaggtcattatattaagtgaaataagccaggcacagaaagacaaacattacttgttctcacttatttatggcatctaaaaatcaaaagagttgaactcatggacatacagagtggaaggatggttaccagaggctggaaagagtagtgggaaggtggcaggggcaggtgaggatggttaattggtacaaaaaaaacagaaagaatgaggctgtgtgatttgtgactttgggcaaatcatttacctgagcctcagtttcctcacctatagcatggagctgtcacaatacctatcctgagtcagagatgacaatagaagagacgggtgtaaaaaccctttagaaagactaaaaatctacatcaagatggccctatactgctgctcaacttcaaagtggagctacaacagctacaagagtttagaggcccttgcagtttcactttttattctgcagtggacttttcccaggagtatgttatgtatgtgaagatgttcattgcattgcttcttacagatgtaaaactattaacaagcaaaggttcagcaatgcacaaatagtaaattatggtgcaattatctgaagaaattttataaggcaaatagaaatatgattagatattctactcagaaacgtagaattttagttgaatgaacaaatatacataattataactataataccatttcatcaacagaagggaacacagagaatttttttttttgagacagagtctcactttgtcacccaggctggagtgcagtggcatgatctcggctcactgcaacctctgcctcccgagttcaagtgattctcctgcctcagcctcctaaatagctgggactacaggcgcacaccactatgcccagctaattttttttttttttttgtatttttagtagagacggggtttcaccatgttggccaggctggtctcgatctcctgacctcgtgatccacccacctcggcctcccaaagtgctgggattacagctgtgagccaccgtgcccggcctgataattttttaattttaattttaattttaattttaaattcagggagtacatgtgcaggtttgttacaagggtatattgtgtgatactgacgttgggtttctattggtcctatcaaccagatatgaacatagtactcaataggaaggtttgtacttctgtgggatcagttgcaatgtcacctttgtcatttctgattgtgcttatttggatcttctctctttctctgttaatctagctagaggtctttccatcttgtttatccttttaaaaaactgacttttcattttgttgatcctttgtatgattttttaggtctcaatttcattaattctgccctgattttagttatctctttttttctagctttggaactagtttgttcttgtttttctagttcctttaagtgtggtgttagattattaatttgatatctttctaggttcttgatgtaggcatttagcactataaacattcctcttaacattgcttttgccacatcccagatatgttgttggtatgctgtgtctctgttttcatttgtttcaaagaattttttgatatctgccttaatttcattgtttactcaaaagtcattcagcaataagttgttcagtttccaggttatttcatggttttgagagttcctcctggtattgatttctatttttattctactgtggtctgagaatatgtttggcataattttaattttttgaatttattaagacttgctttatgactgagcatgttgccagtcttagagtatgtttcgtatacagatgagaagaatgtatattccatagctgttgggtggaatattctatagatgtctcttaggttcaattggtcaagtgtcaagtttaagtccagaatttccagaatttctttgttagttttctgcctcaatgatctgtataacactgtcagtggggtgatgaagtcccccactattattttctggatgtctaagtcttttcctaggtctaaaagtgctatgtttatgaatctggatactccaatgttgggtgcatatatatttaggataattaagtcttcttgttaaattgaaccctttatcattatgtaatgaccctctttgtccttttttactgttgttggtttaaagtctgttttatctgatacaagaatagcagccccctgctcttttttgttttctatttgcatgatagatctttctgcatcactttactttgagcccatgggtgtcattacacgtgagatgaatctcgaagacagtagaaggttaggttttgtttttctctccaatttgccactctctgtctgttaggtgaagcgttcctgtcatgctgttgttagctggttgctttgtagtctcgattgtgtagttgctttattgggtccatgggctatgtacttacttgtgttttgaggaacctagcacatttaaataattaaaccaaagtagtaataaagatgttacttaaaattgttttaaagattcttgtaatatttttaacactaataattttttaaatatgcaaaaatcccctcataatattcttgtttttactatccatagagattactggctggttacttagcaatgacaaactttggaatgagtgataccaaccagttgacaattctacatcttaccgcttaatggaaaactcaggtaatctccatttcaaatacctttcaatgagatcaatactacacctgcaattcaagttatctgaggccattgtaaactgcttttccatgaaactatagctacataagaaataaatttcaattagcttaaattttttatttacatggtttcacataaaaataaaaatagaaggatgacataaaaataaatgaagttgagaatttagatttagtttttaagggctctttttcctacctggtccaccattgcatcagtaacatctatgtttggtttctgtccaaagggaactgtcaaagagtacagatttgtccaaaatctaccccacatatcacctatatttaaaaaagaatctgttagtatatgacaacacagcagaaatgtagacataatttattaaatatatggaccatcattgacactgtaaattagaaagagatttctataatctaccatccatggtacaaaatattacaaattaagctgttagtaattcctagtgttggcttcaaaagagatcatataagatcatcattcaggaacttctactaactggtaactaaattccacttttattcctatattcgtgtacttaacttggtgactttgtaaacatctcaaacaaatgttaagttgtattccaaggccagggaccataaaaaagaagatgtatctagaaaaagtcaatccaagagcaggaccagaatcctggtgccaaaaaaatggggcaacaaacttcatgaagagtactcctgtaatcccagcactttgcagagctgaagcaggcagatcacttgagatcaggagttcgagaccagcctggccaacatggtgaagccctgtctctactaaaaatacaaaaattagctgggcatggcggcttgagcctgtaatcccagctactcaggaggctgaagcaggagaatcgcttgaacccaggaggcagaggttgcggtgagctgagatcagccactgcactccagcctaggcgacagagcgagactctgaaaaaaataaaagtactccctaaacttatattttaaaacataaaatttagtagtgatacatgtgaagtcctatgcttaaattttaaagaaaaacctatccatcataaaaacatatatgtgacatcaggctaaagcacagtccacatgtaaaagaccaaaaatgagccaacaaacagtatgacctggcttctaaagcataaatgtgaacttgagctaaatcaatagaagtatagtgtctagaacaaaggtagtcatggtaccatgtctttctttatgttggtcaaacctcatctggagtaactgttcatctctaagcatgataattgaggagggacattgacaaagtacagctcattgaaaggagaacaattatagaaaagtgaggttttaaggaatggttgataatgtataagatatttaacttgacaaaagaaaatagggtaaacatgacaataacaataatagtcactaaaatgtattgcaccaggtactatgctgtatcttatatgatggttctttatgaatatctggaaggtcatcttgtagaataggaattgacattctgggtaacctcatagcatggaaatagggctaatgaatggaaggcatcagaggggtgttgcttaagttccacataaggtagaattgtattacattggttccatgtagcagtaaattagtctatattggaatgaagaaattatcccatcacaccagacaggtttaagcagaaactgaattactaaataatgcttgccattgacattgtaggaaggatttccatattactttagagttaaaagcctccacaggtcctttctccgcattctctcctgctgacagacacgaggtatggctgtggaggagattagcttccagcaacttagtttgactacagtagaaatgctatatatgcatggcatgaaattttcaaatatttatattttatttggcctcagctgctgcggtgggagaggggaagatggtcactttcattcattcttcacttatacgattccaagccaagcacttttcagcaagagtaattggtgaagtctagaatgaacttaggaagctttcgctcaagctataaccttctgttacccctgaccacccccagccaaccaagctctgacaatatgatactaaaatctcaaattccaccttaagagcttagccaatcaacttgaatactaaaaattattttccccatttccactctcatttgagcctgtaattctttctctagttatcttaaataacccctttatcatttgaattgcagccaaaataataactctttatgtacaaaaaaagtaatacaatagagaattgtttaaaatagacttttggttgaagaaaatgctttcaaaatgcgatttctacaatgttactaaccacttacagaatttttcaaaagttttatgttaaggctcactcaaaaaggcaattttattgttagaaataacaaagagccaagtacacgaagaattcatggggcttcttaccaagcaaatgagcagggaggcatccaattggactgatataggaaggataggcattcatcaactttgccctcacataggcatgaagatgttcatataatggtttaatctgaaaagcccaggaagaaagtttaagacaaagagtaaccaattctaatttccattccacaacactagaaataggagattctttaaacaagtagaatttccccaaattataattcttcttctctcaaatttctggaaaatttaaaagtattccttcttcctagaacttgatgataactccactgcataaaccaataaacatacttgggagaacacaggtcccaaaataaaagcagatgcaaaaaatatatattcatttttaagattgttacctacttcctttgtttttacattgaggtataatttacatactataaaagccacccattttcaagtgtgtagttccatgagtttcaataaattaaaactaccgggaaaccatcaccactatctagttttttaatatttctataaccacaaaaggtttcttgtagtcagttccactcctatctccggctactttgagtatatcagagtctgtttattcattcactagttgaaggacagctgggttttccagtttggggctattatgaatattgctgctatgaacatttgtgtatgtctttctatggataaggacacatgttttcatttatttcatatagaaacctaagagtcatggtaagtgtgtgtttaactttttaagaaatcgccaaactgttttccaaagtgactgccccattttacatttcttcctgcactgtaagagggctccagtgtctccacattctccccaatacttggtattgtccatctttttaatcatagctatcctggtgggtgtggagtggattttcatcatagctttaatttgcatttccctaataactttttatttgcctatttgccatttgtgtaatttctttgatgatgtacttattcaagtcttcttcccatttcctttttggggagttgtttgtcttacttccatttttgatagctctgccaaactatggctgtgacaaggtaactcacatcagaagtttgaaggttcacgtaaaggggaggcatggggccaaaatgaaggaaaaacatccatgggacatttctgttcacaaaactctctcttccctatgaagactagcttactcaaagtaatagtatcaattgtcctgaggaagaaagcaaagtccatagctctgctaacacaggaagacagtgccagccccaggtagctcaagaagatcattcctacttataatctaaaggaccatttgttcttataatatttcattcttatagtctttctattggtaattaatggtcagtgactgaaagaaggaggaaagcagcgcaattctgatcatctgtaggggctgtcctattattctctaaaatctttcaaactctaatattccataactttatgaggcctgggaatggctgaccaatgtgttaagaatgagccagaatgcctttagtcactgtccctctttcccatacactgccccacaactgtttgtgtgtacagttccttgcttacctcttcaaaggtatgttccacatcttcaatcaactggccgcggctgtagtcatagccatctaccccatttacttcatagtctcctctccaataatccccatagtcctcataatctgtttgtttttttttttaaagagaaagggaagaacataagggaaagaaagagagaaagcacaaaatacatagattagccttgctgggaggttaaaagaaatttaaaggcttatcacatttttattgtgataaacatcaactcaaagggatgcaaatgaataataacattaagtaatctctgtttaagcacttgctctgtgccaggagtttaaatgtattattttatttaataagcacaagaaccatacaagattgtcattattataactcccactgtgcagagtaacagcctatgtttatttttaaataaattttattgtgtatatttaaggtgtacaacatgatgttatgagatacttatataataaaatggttactatagtaaaacaaattaacatatccatcatctcacatagttaagcattatcccccccatggaagagcagctaaaatctactcattttgcaaaaatcctgaatacaaaacattattactaactacagtccttatgttgtacattagatctttagacttgttcatcctgcatatctgctactttgtatcctttaacccacttctccccatatcccaccccgctccacctcacccctggtaatcactattactctatctctgtatatttgatttttttgtagaatccacttttgagtgagatgatgccatatttttctttttatgtctggattatttcacttagcataatgtcctccaggtctatccatgttgaggcaaatgacaggatctcctcttttttaaggctgaataatatcccattccatatacccaccacggtttctttattcattcatcccttgacaaacacttaggttgtttccctatcttggctattgcgaataatgctgcagtgaacatggcagtgtagatatctttatgaagtggtaatttcatctaatttaggtatatacccagaagagggattgctggatcatacggtaattctatttttaatttatttaggaatcctcatactatttttccataacagcttcaccagtttatattcccaccaacaacctgtgcttagagtggttaaatcacttgtccaagatcacacagctggtaagcgaaagaagcacattcctagtctcttaaccctgggtgtgtactctcttgatacatcagtttgtatctttagctttaaaatatgtgactggatctctaagtttttaaattcttcttttgttcatggccttttatttttagatcagacccaactcatcttagactttgccacagtgaacctgtgtttgtttgcaaattatatgtatcaatagcatgtttctatgtgcttcctttagtatctcaccatcagaaaacacaagcttgtgtcaggatattagctaataaagtttgtaaacataatttaataatttttatttttacattcacattggcaattaatgatcaggaagatgaggagagaaataaatatttggatgaaaggacatgcaggatattgttttaaaaatggtgataagctattgtctccagcttgcctaaggcttaagaatactgaatttaagtggcagtgaaagaaatgttaaaacaacaaatgcgggaaaaaaattcttccttactcaacctcagtgggcagtaaatcatcaaagcaaaatgtgaatcatgattccatgacttcagctcactattcagggaagagaataagttaagagatatggaaattccttcctatgttaagattttttatgaccacataatctgagatataattacaactgcagaaaataatacatttccagcctaaactaatctgatattttttctttctggggtatcaccctaaggtagacacacaaatgacctttgaaagtgaactgtgggggctttagacaaaaggcagtgactctgtctttcatcctgagaaatgggattcccccccttaatccccagactccctcgggaacttttaggggcctgagatcttcctagattacttataattcataattcctggataatttactttaggccttgtagttgagtctcattcttgagcttcttgaattgtagaatgccagtgcaccttttctttttccccagtaatttcttttgaaaacaggtaatctgaattgttgaggacatgattgttaattgaggggtatccctgatatcaaagggcaggcttggtaatgcagaagaaatagccccgtggccacacagagagcttcaggacctctacagatcagcaaacttacgatttgctcttgccatctcatttttcaagaccacatactcttcatataatggcctcagctgcttgccgacctcagatctccagctttcccaagcccagagcctctcattgtagtctaaactgtttgccattatttcattcaaacctgttatcccaaagcacacaaagacaagaaaagatgcctttgtaaaaattttatttgtaaagaactacatgaactttaaagaattaaaagtaaggttggcagacatcaggtcataaagtggttaaataaaatctcatgattcattcatgtccttgcccttatagttccaaaatatgtctgcagagaaaataaaccactgaaatgacttacttactgacttgatcaaattaagtaaatgtgatacaatttacaagaaagttttactaaaagttaaaagagcatctatgtgttgaaacacacatatctgcaatcatttttaaaatctgagagaaaagtaaatttcataatcactactaaaaattagtagcctacctggttcaagtaataagcattcttgtggattatctgggttacaaacttttccagtactgtagatggtgctcattgtatttagaattgtgttcaactgcaaattaaagataataaacaatgttaacaatggaaattttgctgaagagaatgctaatataaagatatccttttgaccacatgattttttgattactcaaaatacagcaatttacttctttgccatgtatctttctgtatgtggagaaggaatagcccagttaagtttccccactgtcgactagcacaaagtactataagcacataataaatatatatggagtaattgaaataaccagatctaccaaaacccaaagaagttttcttatccacacatacacagagaggtgcattttttgtttcattcagcatttattgaacctggaatatgtcctacactctgacaattctgaagtgaacaagtcaaagaccataaagtcataggacagtgaggcagccatgaaatcaataactattaatacataacagaatgacaagtgctataactgtcaccaaaaagtgatgcggtagtataggagcagggagaaattaataactaataaccaggagattcaagaatgggtccaaagagaagggaagataagagctgtgtcttggagaagaagtaggcactggtcatgtagagaagggaggtagagggaagagtctaaaagatggaaggaggttggaaaagacaaggcattctcaggggacagtgagatgttgaatgaaactggagcaatggtgttcattaggggaaatgaaagacatgagaatggagagacaagcaggggccagatcacgagggaccgtctatgccataccaaagtttttaaactttaccctgcagataaagtgaaggtgatatagtgaagcagtgctactccaggtgtaatccgtggaccagtgcaagtgacagtttgtttccattctgtgataagtacaggaattaagagaataaaagtttataaactttggagaacaatttgatatttccatgacatctaagcatgtaatcaatgaacttaagcaagtattgatctgcaatgtattggaaataaaggaataaaggagggagaaaggaaagacgggagggaggagagaaggagggaaggaagaagagaagaaaggaaggaaggaaggaaggaaatggttctctccctcagattgatttaagaagcactggattaaaggatctgtttctccttctcctatttccctttggttctgccttgagagtcatcctaaaacatgaaatagatcctatgtttaaaacttccacacgatcccatagtccaaaggaacaaacctaaattccttaccatggcacaaaacccctcatggtctctctccagctcttcttcaatctccacggcttcctctccatcaaatctaagcaaccttgagtccctcctcttcccaaacactttaagctcttacatgcatttcagtggttttcagtcctggctacacattagaattatctggggattttttaaaaaatagaatttctaggttccacctaggctagaccagattgtctatatgcgaatgggcaaggtttcttatagtgtccttgttgggggaaaaaatggagaaacatagaatggataaagtaaagtgcattgataattagttggataattggacccaaagaatgcagaaaaataaatgttaacttgtagaaagatacatttcacatggttttatctttgcctttttgatgcatttttatttttatattcacagattagaacatacaaagttccagaggacaagcaactgagaaagaagactttctttttaaatagctaaatattttaggttaaaaatatttcaataggctatatcagaggtctgcaaactgtgttctgcagaccaaatcctgtctgctgcctgtttttgtaaagttttatttgaacacagccatacttgttcatttatatattagctacagctgatttcctgatacaacagcacagttgactagttgcaacacagacaatacctaaatacacaaaacctaaaatatttactgtcatctgttcctttacagaaaaaaaagtttgctgttgacattgtggacaagatcattctttgttgttgggggccatcccatgcattgtgaaatgttctgcagcatccctacccactagatgtcaacagtatccccatttgtggcaaccaaaaacgtctccagacattgtcaaatatccccggagggctaaatcacccccagttgagaaccactgacataaactaactgtattcttcaggctgcctgatccttcaggaaggtgacctaacactagggggtgtccatacacaccacagtgccagggacaatctcagtttaactctgtgtttgaatataataattaccagtgtctttcactctcaaagattccagtttgaataataaattatatggacaccttacctaggcatagagagagatttttctaacatcagcattactattttttcaaataaaggcagctgctgtgggtgatattaatgtttaatatttcccaaatatttcaactcttgggatcaatgctaaaatgttcacaaacgtacccgtttgctcttgtcttctgagagcactgaagacccattttgctgaagagcctgcagctgaagcttgactgtgagattctgaatttcttgtagtggatacatttgggcaagtgtggactgttcctttaaaaaggcagaccatttgtccccagcattattctgaaatgacagaaaagaaaattgaagttggaatggcattgcttgaagagatagaacagaagatatagtccaaataatatctggtgaaacatttaatatttcctgagtgatttagtcctctactccgctgaaggtcaaggtttaggttaagagtgaccaggccacttttgaccactctctctctctctgtctctctctggcctattgcctggttttcccaagggtcttgtccccagaactggaaatgaattctcacagataatccacattgtggggccctggaatttatagccttagtgctgtgacatagatgagttggccaagaattcaaagacgagtgctctaaaaagagaatccagtagagctcagagtggacttaatgagaatacagccccctaataacaatggaaaccataagaaatgagaaccggttcacagtaacctcctagctgccgtgacttagcccagggattttgatcttaagttaggattcccaaaaaaggcttcccagaaaatggccattggtagccatggtgattttctaccagcaaaagaaatcatcaagcaagtgatgatgccaggacacatttccccccctcctgaatcttgaacatcagttggaaagtggacttctccaaactactgtagtgtagtcttttctcaacttacaaattcatttccatttaccaaagaccaaaatgagcaactacttggtatattgtactgccctagaccacacaaaagagataacgtttgaggaaagtaagaattctgctcctggactcaagtaccttagcctctctgagccacagttgtcttatctgcaaaatgaaagtaataataggacttacctccaaggactgttgtaaggatttgaagaagtaacaaaaaaatgaaatgcttacaagagtgcctaacacatcctaatcattcaacaaatgttagttattttattatttatttattatttattatgttatgatttattttatattttgttatgtataggggaaaagtcgttgtccttagattgctttccattttatcagacagataagatatgcattataaatgtttcattaatgaaacataagagtatataataatgtataaattatgagtgggccaagcagtttctgttacaagaaagaggaaattcatgcaggtgaccatacttggccaagccctcatgcagaagttgcaacttaagacagacctgaaagtaggtaggagtcagatgagtagagaatactttgcaaaataatttacctcatttgattttcttaacaacactatgaggtagaaaatcactctctctccttttttgtacatacagaaagcggctgagagaaataaacagtggagctggcaatcagccaccagcatttgatcctggccctgtggcagacagactctaagaatgctcccatgatctctgcctttggtggtcacacccttgtgtgatcccctccccataagtatgagcagacccgtgatttactttcaaccaatagcatacaacacaggtgacaggatgtcatgtttacgttacataagattttaactttaatcttgatagaagactctctcctttgctgacttgttgcagcaagatgccacgttgtgagctaccctatggaaaaggccacatggcaaataattaaagacggcctctgagtaattgcattggcttggaagtatatccatccccagtcaagcctcagaagagaccatagctctagccagcaccttgaatgcaaccatatgagacttagaagcagaagatccagctgaactgtgcctggactcctagcccacagatactgtgggatattaaatatgtgttgttttaatctgctaagcttgtggtaactttttacacaatagataactagtacagctcccacaggtagaacttcaggcatgattgcactttccaggccaaggaatttcacttttaccctctgagaattaggcagtcactgagggttttgactacgcatgtgacatgatggaaatggtgcacagaagtggcagtaatgagccacacaagagacagagaaaataatggcagtgaaaatggaaaataggctgtgtgtagtggttcatgcctgtaatcccagcactttgggaggttgaggtgggaagatcgcttgagcccagaagtttgagacaagcctgggcaacaaggcgagaccccatctctgcaaataatacaaaaactagccaggtgtggtggctcgcacctgtagtcccagctactcaggaggctgaggtgggaagattgcctgagcttggggaagtcgaggcgcagtgagccatgatcacgccactgcactccagcctgaatgacagaatgagaatctgtctcaaaaaaaaaaaaaaaggaaagcaatttctttctttactgaacactcacaacctctcagaaactgctttttcattaatcttcacaacaaccttgtgagggagttgttattgtctcaactttacaaataagggaaatgaggcacacagcaggtaactttccctaggtcacacagctagaaattagaagaaccagggcatcaacctagtgtttacttccgaagctaatgctctgaactattatcctataggttgtatttgacacattctagtcttctctctaacatgcaggagtgggaagaagtgagctatgggaagaggagtttggtctgcagcacaaactcatctatgcaacccacctgactcacttctcaatccctacctggcttcacccaatccagatgatttactgtgaagcaaaatttctggtaaaactttcataccaaattataggaataattttactctctatctataggaaataactcactacctcccaaaggcctcagtcttagaacattgtttatcatactacatgtaggaattttgaggctatccaattttattttagttatcactaccatactacatgtgttataattatatcaccaaaaaaatcactttgtgttgccttgcattttggcccctgaggaggtattattccttgccaagctattcttttaatatcatttacaatttattccgtatccttaccctagggctcccaagcctaaataaaacagatagcttagtagttatgcaaagaatcagtcagttcatgcatacctatcagataatttagtggttgatagctatatttagactgaatgatgaatggaatgaagcatatatagcagcttacatagccccaggcttgaaaggaaccattacagataaaattggtggcattccacactacctctgggcaaaggcaggggagaagcaactaaaactgcaacagtttctgtagccatacaagggagttttgggagtaaggaacacgttgtttgagataatcacaagaaattaaaacagtctctaaatcccatccgtaactgcaatggatagcatattcccaacttgagagagatcctttgtaatttcaaggactgtaggcataaaatcctagattatattttaaaacattcaaaaagatactctgctctttttggccctaactatatgcataaattaaatacatgatttatcaggccataggtctggttgtctttacccaacttgtgataattgtatttaaactattaaaatccttttgtaagaagttgtttgagatttaaagtattgacaacttattttctctttttctatagctcactatcacctaaaccaggctatatacttttagtaacctctaaaccatttcttcccctgtaggtgtgagagttccatgaagacagaaaatgaaaaactgaatggaatctttagcatctatccagtaccttggagcccaaatctcccaggaaaactttcacccttggctcccatatgctggctcaatttccagatagagctgtcaaaaccgcatcaggttcaaagacaaaagctgccttggttactttctaaatatgcccaggtacttgcatattaaaaaaaaaagtcttccatttaacaaaataggtaatgtaaattataagaatgtgaattccataactcaagcttaggatttaagaaattattttttctttattttagattgggggtttaatattttaacatttaaaatttttaatctgtatgaacatttttattttttcctaactttatctcatgggaaaaaaagtgctcgcccctgaattttattttatgtgctgcacagtgatcttccccgacttgtacctgtgtgtaggtgttcatgtgtattaaggggcatgggacagactcattagagacagggatgaaatttccttgggtatatacagaatagcagtttagaattaccctggtctgagttcactgtgactctatccctggagacaggaataggttcagaaatggggcatgcccaagaccctagggaccctggcagcaggggggctgaagaagctctagagaccacgcaaagagtaagtgtggtaggctaggtgcagtggctcatgcctgtcatcccagcactttgggagcctgaggcaagaggatcacttgagcccaggagttcaagaccagcctgggagacaaagtgagatctcatctctacaaaaaaaaatgttaaatgatgcgagaggatcatttgagcccaggaggtcaagctgcaatgaatcatgatcatgccactccattccagcctgggcaacagagcgagacccttcaaaaaaaaaaaaaagtatgggcctcatgctctctcttcacagcttctggtaactcaccaagaaatagctacaacgtgtccttgattttgttttttggcgaggaattgcttgatcctgaaagtcttgtaagaaaacatgatgagaaatggtcaaccacacataccacaatggcagagaaagggagagaactttggaaacctgttttaaccaagcttttttttccatatctctatctgatggacttctccacacttctacatcagcagctttatgacactatactgatcaagtttggatgccttctattattttgaggtatattctcacagcttgacataaggatcaccacttaaggatactgttttgggatctgtgagagaagaaattcctaaatccttgcacttgttaaagcatctggctttcccagagcattctgatatttgtcagaactggtttaatcatagtttttttgttgtttgtttttgtttttgttttggagggctctgcctggattctgtgaccttttggagtcccttggaggtctgtgacaaagaggaaaggaattcccaagtccagcctcacccaagccctgattagcttaattactagttctttcactaagcctccagttgcatttttcagttaatatatcatttgtagagaatctttagatattcctattgatattgtaggctaaaggaaattattaactcaataacttatggcatttccatgaaatgctttgaaatcctgactgtgatgagaattatggtggtaactttataaagaatattctcttgtttccaagcatctggattgagaccagtgaattattttgtaacaattttctgaatgaaccccagggtcaattaagtttagttatctgggactccaaaatcagggatatggaggcaaacatccaatctcacaactcagagcattttttttgatttcccttttcagtttcacgggcagtaatctaatctttaagaggcaacaaatagcccaatagagccatgagaactcaccatgttttggacattctcttcagtaatattggtgttataattccaagaagcaagtgaactttgatagaacaggtcttcggcttcgtggttaaacttgtccaaaaatgtcttggcctgttcctcaatggtggactgagcagcagttacagcaacaaggctgagaaggagccaggaagagcttgacatcgtcccctgtgagccaagatcacatccactgaatgactttccctagactaaaacctcctcatgagattttctctcttatcagcctttgaacttgggttgggcgctgagcaggaaagaccaaaaaaagaaaaagaagaagaacacagtaaacaatctgctgagccaatataaagttcatcctggagaggacagatatgtaacagattttagaataattttttaaagtgaatcaaataagaatacgttattctttaatcctagagaaccttacctctcctgtcactttatggccaaatcaaaaccggtacttttggttaatattttcctagaaagctgttaaagatacacggaaaatgttataattttacagtgaccaaagaggtctagaactagggatcatgaagataatgttggtgtttgtatggttttcagacaatttcattaataggttatctcacatttatttttatttcaagatcatattcccagaaactctctacttgggcaacattttcccttccaaatacatgactttgcccttgtctttatggaattcatatttctgatcagttttttttttttttttttttttgagactgagtctcggtctgtcgcccaggctggagcacagtggcgcgatctcggctcactgcaagctctgcctcccaggttcacgccattctcctgcctcagcctcccgagtagctgggactacaggtgcccaccaccacgcccagctaagtttttgtatttttaatagagacggggtttcaccgtgttagtcaggacggtctctatctcctgaccttgtgatctgcccaactcggcctcccaaagtgctaggattacaggcgtgagccactgtgcccagccatttctgatcagttttaatttccatggccattttttaaaattatgactactctccactccacaggtcaactctcctgatctgcctttgcaaaacttaaaaaagctcatttcctatttctcacactggttctgtggctgacttctttgagtgcctccttctccttcacttacctattcaaaactcagtcaaggtcacgtggaagtaagaaagcctccacatggtatgaaatccaaagagtatctatgtcaactcctgatcctctgtagccatgggatcacaacaac

SEQ ID NO: 211 - DNA, 37714 bp, Homo sapiens
cacaatcaaaaagagatgattattactttattaagttagcacagattggacttttacaaattgtagaaatggtcaacaaatagaattgtcctattaggggctgatattcagaaaatatataatcaactgttggtgtgataacaggataaaattccaccctgtatatgagtaattccatttttatccatccatttacaataattacttctcacttttgtttacttagtcatatacagagtgatataagtgatcgtcaaaaaggatccattttcaatgatttctacaccatattatatgtattctccactggaaaatttatttttccttaggtctttgaagtgtgaaaatatatacatatgcctgatcttatttctaaaaatgcttaaatcaataactacaaataccacatgaccacatttatacactatactgtcagaaaaatattttagaatattttgagtcgtgaatagcttatgatttcagtggtgttggtgggtataattgattgcttttcactttcaagcacattcaaaatttattacaaaagaagaatggtgaaacaaaatatatgatctgctcttggtatttcaggatgctcagcagtcacacagaaacaaatgtttaatttcttgaggaagcagaacaacagcccttcagagaggggtgagcctctcatcctctgtcatgaaggcatcattaatatgccctcccttcatgtccaggggatcagaggggatgccattttcaattgtgatcatgttttcacacttatcttcagcgtcatccacttcagatggttctttgttctttctaaaagcacataaaaaagagtgattggcatctagaaggaccataaccatggttgcatatggtcttctgaacgaacatggagaacaggaaggggaataggaaccttagaacaatgaaataatttaatgatattgtgtaattttcaaacgaatttcaaagaccataaagagttggtgaggtgaaaagatactatcaagatgagaagtctgtatagatgacatatacatagtgatcaacacaagtggtcttattcagaatactaaaatcaatatagatgaatatgtatatgaatatgagtgtatatgcacatatatacacatagacactcacacacacaaattgcatgaagtaatgtgaagaaaatgcatagtaaattcgcaagtttaaaatccatctctaggagaacttaataacaattgaattgctaaaagtaataaattcctctcatgggatttgacaaattaatggtctgaaaatgttgagtgaaaatcaaatagaaatgagctatcagaaagaaaattaacattactttgtagaaagtaagtgctataaacttcaaatattgctgcttggctctactcattacaaaataattgtgttaatttgcaagtcacgattttggaactcagaatacattttccctaattactttacaacttgtagttataattccaggtcactccaaaaattccatatgacaggataaattcttgagtttctcatagtttcaccctttgtagaccttgctgaccccaaccgaagtaatatgcagatctgtaatatttctttggagtgtggaaaacagtagactcaaattcaaaggtttttcctgtcttttgtgaaagactaaaacaatgagacaattatgcttgatatcatgcagtaaaagaaaaaagagaggtgggtgcctctaggcaaccagaagaaggaggggtttccctaaggcttatcacaggttggatgttggagcaccactccatggtgacaccacggaggcatgatgttaggcatgaggctcctggacttgcaaaggattctcttgtcccacgaatttgtggaaatgccaaatagcagaaaagaatagatcatctggctgagatgttgggcactgcagtggtgaccaggtagagtcccaccactatgagagtcccttagaaccttggtgagtctctgacaggtgaggagatggtgaaggtgccccaatgatgaccgagatggaattcctattagtcctgcgtgagaatgtgctttaaaggatatggtgcacatgtaccctagaacttaaagtataataaaaaaaaattttttttaaatcatctttcccacccacatgattttcctgactccattcctgtcctctgtatcattttcccctatcagttttattgaggtataattgacaaataaaaattgtatatatttcaaaaaaagaatatggtggaagaaagtgaagaaaagagaaagctctttttttatagaagaatgccaacgaatatagaaagagtaataggaacagaaaatcaccatataataataattgattctgatgaggattatcaatggatactaaaccattatgtgagagacggttggagaacaggatattcacatggtttcaagatatcacccccataagcaaaatattaattataaaaggacacttgtattttgctaaaagagaaatctagtgaaaatttccaacaatgaaagaaactgacaagtctctcctgatgtgatacactgagtagatcacatatatgtttttcctgtgttccagccccgccccctccaatttgttttgacctgaatctcataataaggagcctaatcagaaaaatccaaatttaaaaatgttttgcaaaacagctgacctggactcagcacagagtaggcattcaactgtatgggtagatgaatcaatgaatgtagattaatggctgactggctggataataaatacatggatggacagaagatgggtgggtggctgaacaaatgatgaaaggtggatggacagatggataaaataatcaatgaatgtagttcaattgctggttggctagatgatatattaatggctggctggctgaatggatggatggatggatggatagatggacagaagatagatggtagattgaacaattagatgtatgtatgtatggactaatgttgtaggtaaagttactcaggcagtagccctaggtagaccttgaacgggctttaccacaagaaagaaggaaggaaggaaggaaggaaggaaggaaggaaggaaggaaggaaggaagggaattttacacacaagaaatttcttgtatctcttgtattttaggctttgctgatggtttattaaataatttcaaatagttgttcatttaaaacaaaggtaaagtagcattccaattctgtagatcccaatgtcatcatttgaaagtattttaccattgcatatgccaccatcaaatatcacaattaaacacaataggcaatcactgaattgcagatgccacattttaaacatttattaataaaacttctggcccaatgctgggttgaaagtcaggagttgtggtcctagagacctagggaaagataggctgctatatttttccatccttggagtgaagacaccacactggtcatggcaagcatcagcaatcagcaatcagcatgggttggggtggacatagattttaatgtgatgagaggatccttccaggtgaaattacccaccagaggattagaacactttggttcctcttcctatagataggtgtattgttcactttccacgtcctccagaaagcaaaggaaatcaacattctataaccatcaatcacatcacttccattcatagtatccaacattcactaacagctacattttgagcgtctactatgtgtatggaagagatacagtccttgtcctaaaatgaactcaatgaaagggaaaaatgccatatatactcatcctccctctccccattttaatgctttataagagagaggaatgtttcttctaaagatgaagctgtaagtagcaaatgtctatttataaatcatcatttaaaatggctatctcatgtaaattcccccaaaatcactcctcactgggcttggagtgaatgataattttccacaacaataaatagattgtggacagccaaattttaccctgatatttgtatatgttaagtatgaaacctgtattacaaacattttagtaaaggaagcattctgaagtaggtggcaatgcaatagcagtcttagaaataataattgccagggcctattttccagtttcttcagttaataaaaaaagtatttatggagttagaagaaaaataacaaagagctagacgtatgtgatgatcattacaaggaatctcgcttcccccttcccagcaacaaggaaaaatgattcatcaggcatcacgaaagaatggggaaaaactaaaaaggaagatgtaaacaaatgaggacaagtttttcttctttagaataagaataatatctcaaccaaaaagattccaaggggaattgctgtagaaatttatcaaactgagctgtgtcagtggcaaattaggtgcatattgttcttttacaaccatagatccagttgcagagtcctggcattgctgggcttcaccaattgcagtgtcaggaacttgctgcttggtggacatgataagcagctcaaaggctatctaacagtaatatatcactttgtcacatttcatagtgtttgctgtaataaattgattcactacctgtgcattgcttttactaagaataataaaacttaactatctttctggatcattctgatttgatgttctgctaaaaacatgagttctttttcctgaaaactaaaatcaagtgttaattacttctgctattcctgcaatgtcagggggttcaggaagaggatgaaaaaactgattaaaattcctggaacgagctcctagaagccttgagagtgaatatctctcatatacctcataaatatagagagaagaggggcaaaagaggggaggaaagaagtatcaggtgtggccctcagagctaggggatgttgaggaacggggtttgctctgttctaagataaagtaatggtgccaaaagcaggaagagcatttctgtcccccttcaaacaaaatagagctgactgccgggcgtggtggctcacgcctgtaatcccagcactttggaaggctgagacgggcggatcacctgaggtcaggagttcgaggccaggctggccaatatggtgaaaccccatctctactaaaaatataaaaattagccgggcgtggtggcgcatgcctgtagtcccagctactcgggaggctgaggcaacagaattgcttgaacccgggaggtggaggttgcagtgagcagagttcgcaccaatgcactccagccttggcaacggagtgagactccgtctcaaaataaataaataaataaatagagctaaagaggctgggtgtggtggctcgcgcctgtaatcccagcactttgggaggctgaggtgggcagatcacaaggtcaggagatcaagaccaccctggctgacatgatgaaactattaaaaatacaaaaaaattagccgggtgtggtggcgggcgcctgtagtcccagctactcgggaggccgaggcaggagaatggtgtgaacccgggaggcggagcttgcagtgagccaagatcttgccactgcactccagcctgggtgacagagcaagactctgtctcaaaaaaaaaaaaaaaaaaaaaaatagagctaaagagccaagacccaagaatagccagaaagacaataaaagacagacaaatatgattttcaaacagtacagaatcaattatcggggaattgagaccatcctcagaattgctctggatgattctgggggtaaatagggttactggaatgatttgagtgggcactgtagcacagtgagattgatggactttgaaatcaaacctacctggttttaaatcctgttactattactttctaaccatgtgactgtaggcaagttgctttacatgtgccatataatagcaatgataatgctaatgataatattaagtatttattacatggtagaaatcagactagatgttttgtatgcatcatctcacttaattcttactgcaatattatgcatattttattatcactgtttttcaaatccatcgttttaaccactcagccacgactacgtgcctcatctctgtttttcagatgaaggaattgacactcaaatacgtagagtaacttgtctttcagaatgaaacaagactggtgaaaggagttgacctagaactctatttactctccccaggctttactcaacacacttacattagatttttatcaggtatgtatatttaagaacagcaaagaaaaacatttgttatattcgctatgacattactcattttatttacacctctatttttaagactattcatttaattaagactttataagaatgtggtttcaggatataaaagtgttgactgagccacatccgcttgtgtgaaaaacaagatctgtggaaatccaaatgcatttttatttactattgaccttatgggaatataagtataactagaaacaaaccaagcaaatttactaatgactctactcagctgggagcattagctagggttctatgtcctaagtctttgacctggctttgttactataagattacaatctccttttaggcaaggaccatccatgttatttatgtttgtctcatccacaatacatactatagctcctatcacagaatggatggtcaataaaacaataaaatattcttacttatctgggctttggtttctggagggttggatttggatcattgttaaggtcccttcctaagacccagttgtgatcttagatacaactaaggtctaacattataacagtctatttatatactggattcaacatcaattctagtatatacatgtaaatctgaaattgtgctgtgtccatgactgtccttgtaaactacaaagttccaggttatataaaattagcactttataactgctttttatggtcatgctagtaacttaaattgatatagcactttctagcatgtaaaccactagatatattctctgattttgtcttctcatcattacactatttaagaaaatattatcatcattttccttatgtgacctgctcaaggacacagctaacaaatgccagagcctgagactggaacccaaaacaaagagtcttagtttagggctctttctattaaaacacacatcacattatcaacttcatcaccatcaccatcaccatcatcaccatcaccatcactatcaccatcatcattatcactaccatcataaaattgaccatacaactaacacacctacttctagcctgtggctagacactaaatctagtagagacattattgtgaagtatatgcagttcatcctggttgccttcccacttgttctgctccctaattgttgccccaaattttcaaaatcattctcagtaaactatcgcaagaacaaaaaatcaaacaccgcatattctcactcataggtgggaactgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaattataataataataaaaaataaataaataaataaataaataaaagaaaaaaaatcgcttttccaacttctttccttcaacaaatctctcattttcacaaactgctattctcatctagagggcaatagagaagcaacctcttctaggtatttcacaaagaggtggcagctgtaatggtgtgctagatctggctggtacaggttttcaagggctgattgctaaatattcagaatttttcagccttgatgggaaattggcaaatgctacaaattagggtatttattcagaatttttcagccttgatgggaaactggcaaatgctacaaatcagggtatttattcagaatttttcagccttgatgggaaactggcaaatgctacaaatcagggtattttttagagagctggttaaccaattcaccactattgtggtgaccagtagacctcatagaattatttgcatttttaaaaagtgtttattcagcatggtagtggcatcaaaacagacacatagacaaatggaacagaatagcaaggacagaaataaatccatgcacttatggtcaacagatcttcaacaaagatggcaagaacacacaatgaggaaagaacaatctcttcaataaaaggtgttaggaaaactggatatctcgatgcaaaagaatgaaactggattgttgtctcacaccaaatacaaaaatcaactcaaaatagattaaagacttaaacctaagacctgaaactataaaactactagaagaaaacataggagaaaagctccatgacattggtctgggcaatgaccccaaaagcacaaaaacaaattcaaaaatagacaaatgggatttacatcaaaatgaaacgtttctgcacagcaaaggagttaatatccaaaaatatataagaaactcaaacaactcaataacaagaaaacaaataacccaattttaaaatggggaaaggatgtcaatagaaaattttcaaaagaagacatacaaatgcccaacgggtacatgaaagaatgctcaacttcactaatcatcagggaaatgcaaatcaaaaccacaatgagataccacctcacgcctattagaatacctattatcaaaaagacgaaacatagcaagtgttggtgaggatgtggagaaaagggaaccctggtacactactgcaggaaatgtaaattagtacagccattatggaaaacagtatggaagttcctcaaaaaataaaaaataaacttccatatgatccagcaatcccactctgggtatatacccaaaagaattgaaaccattatgtcaaagagatttctgcacttttatgttcaacccagcactactcacaacagccaaggtatggaatcaacctaagtgtccatcaatgaatgaatggataaagaaaatgtggtacaatgaaatactattcagcctttaaaaagaaggaaatcctgacatttgtgacaataaggatcaacctgaagaacagtatgctaaatgaaataagccaggcacagaaagacaaatgccacataaataagttgaatttatatgttaattatttgatttagccatttcataatatatacatatatcaaaacatcaccttatatgccataaatatatacaacttttatttgttaacaacaccttaataaaataaaacaagcatttaataaaatcccaagcaatgagttggtgaattggagaagtttctacagtatgatggaaaataccaagatattttccacaatatcttggtggaaaagagatcctttcccagcacctcttaatcatagcaatggcttaagccgatcttggataatcataattactgtttatttagtgcacactatatcctaggtactttatacacatttatgtcagtcaatcctcatgaaagccctgtgaaacatcatctccctgttgcagatggagaaactgagatccctggaaatcaggtgactcaactaagattatacaggtaaagggcacagctggtatttgagtttacctagtttgggctccattggttgcatacttgccactcactgtccctgaataattaatataatggtgttattggcaaagataacagaattgttaaagctttgctgagaaatttcctcaatagtaagtttaaatatatatatgtgtgttagatgactctggcactcttctccatagaagcagaatggtgacttagataatcccatggtccctccaggtcttctaagtttaagattctgtaccacaaaaactatgttcattattatctaatgtatggattagattgttgaacattcctttgactgtcttcctcgaaactaaaggttttgggggcaactcctatcttttccatgattagaaagggctttcattgcaattttcagggctctccccacttcaaactgcaccctctcctcacatttgacgcaacattttgtccaggagaaacccatcacaaattgtgtcaaacttaaaacacaacaaacaatttatcttcagaaggttgtcataattttcctgactatatttgctaattattgatgctctcccggtttacacaagagatgtgtccatctgctttcccagtttgaacatgaaataaatttgtaaaggcaaggtggtgacaacagcttcacttctcccaggcaacaaattatgatgctacacacccaattattatattactgcagaatctgctcagaaggaaagagatagctgatcccaatacaaactagctgaaaggccagcaaatggcaagatcataaaataatagtaacagctaacacttattgagcactcactgtgtgccagataccactctaagcactctatgtattaactctttttatcccaccaagttaattatttccagtacacctcactgtcactctagaaaagttatctattcacaaacagtaaagataaacttaaccagcttgagtctagcaccacaaattatattctcctaagctcagtttccctgactcactgtgcttcctgatatccatacagttaatggattatatacaagggcagaatctaagagataaatatgttgagtctaagcaatctatctccagagtccattcttctaactcctacactatactgtactagtgaggaaattagaaaccaagtagatggagtgaattcactaatgttacagttgttagaacacagaatcaaagcatctcaagattaatacaaaacaaaagtattaaacacaggtattcaagcattgcatgagaatatttctcaatattttcaaaagaaaaaccaaaatgcacatcttgtaccaagtctctttgcattacatgccatgccaagatcatcaaaaaaatcaggtaagtgtaacttgatcctaaatctttgaatttaatttgaggactagacataaaccatatttatttcatagcattttacttatcatttgtgaataaaattacaaagcccaagatttaaaattattaccttctgttagttactagggtgaaacatatggaaagtagtaaacttcaagaggagcatttagtcaacacatacttacttagccaaacacatcccacatgtcccatgtaagaaccaacacttttaaaaaccatgtccctgttattttcaaatgcatgtcactgtaattaccacttaccagaattattcttccttagtatcagaaaggaaggtttacaagcattaaagtctagtgaaaagctgaggatttttccatcttcccccctgcattagaggtactggttaacaaaatcatgctgagaaatcctgtctcctcttcttctccactacctcagtaacttccccacaggtcttaaattccctcttgaagcagtatcaataacttagacatcgaagtttgcaaatgcctccagaatctaggtaaacgaactcaagaagtgaaactctacctataaattgttaaattgaaagctctcaaactcaatgaataaggatgacctgagtattcattaaaatgcatcccttcagagattctaatttagtgggtctgcaatagggccaaagaacctacatgttaaacaagtgttccaggtgatgtctgatgctgagagttgatttaaaggccacaagcaacacagctctattcaatatcataggcacacaagggatgagtgtccatcaaagggaaggaagtataaaacagtacaaaggcatctgggacaagatggtagcctgcatgcactggactaagaagaggtaagccaaagtagggaggcatgcaactatgaacctgctggcatttggatgtggatgactaccaaagattaactctgcctacccaaaaagtctgtttagctccttacatctagcttacaaaatcacaacacagatattaaaatcaagcctggatatgaaacatttatgtggtacagaatagagggaaaggtagtcgtggaaggagcctagttaagtaagggacgctggactctaaaatatatctaaagaaaagagcataagtgatatttttgaaaatcaccaattttttcaaagtttcaaatttaaggcattatcttcagccagaggaaaatcctctcctgatttgtccaagtcatgaggaaataagaaaatgctctttcaatcactccttttaaatatcttaccttctacgttgccagatccctgataaaatcagtagtgcaattgcaactatgatgatgcaaaatatcacaccaaatataataatccagatgggcacagatgggtccatgggtggtgcaagtgtggaagggatttttaaaaattccagagtttggtcatttagaaagaaggcattgttgatccggttcttgttcattctaaaatgcaatgataattaaaaataaacaaaataagacagaaaaaaaactattaagacaaagtacaaacctgtttctccatgattataaatatctctataaacaaagcatcctcctggcaggagacttcaagttgactaaaaagtttgctgagggcaatcatgccatagtttctcttaagttacaacactagctgccagagggatacccatgtatccactgctgcccccattgttgtgaatgtccagaagtcctgagctttgagctctgtccaccatgttttatttcctgagaggtagtaaggtagacggagggactcgtctctggaggcagggctctaaccctggaccaaactgaggactaactaaaacagagctagggggtggcggggaagcagctttccatcagacatgcccaccagtgtgccatgtcagtttaccattgccatggcaacacctgggagttaccacccctttccatagcaatgatgtgatgaccccaaagttattacccttccctagaaatttctgcataaactgctccttaatctacatgtaattaaaagtgggtataaatatgactgcaaaactgccctgagctgctagtctctgcctacagggtagtcctgctctgcaggagcagtcacagagcagtaacatcacaggagctataatactgcctcttcagtaaagttgttttcttctacttctggctctctcttgaatttttttcctgggcaaagcccagaatcctcatgggctaagcctcaatttgggtttcacctgtcctgtgtgagtagcatctagattagaatgacaaagctctatttaaggtggcttacataaatatcacagcccccaaaagtaaaattacatgtaaaatatgggtgatgaataggagaagtaaagaaaaccagaagcaaaaatgaaaacatgaaccaggagtggcttcaaattcaccaacttgatcttgatatttttttcattaattcaacaaacatttgccaaaaacttattaaatatcaaatactgtgctagatgctggagatacaacgtgaaattaaagtaccaaggagcttacggtctagaagggtgacagatcagtagatccacaaccacagtgtggtacaaaatgttctgtgaaagaggcaaatatgggcacagtgtgagcagagggaagggccaagtacaccattgtgagaagtcagagctgctttgctgtggaggccatttttgagctctgttttgagggacaagtaggagtttttagaccaaagtatgtggtgagcacaggaatggaaacaaggtaaagtaagacttgttcagcaaattgcaagtagttccataggactaaagacattaatgatttaggagttcaaaagcttagaaaaatgttacttttcctaggaaatatctgcatttttagtggtggtggcagttaaggagaggttggtagcaaagacttatttaattgaaaccaaataagtgaatttctaactgtaaactggagagtccttggagatattttatgacctttactgaattcatattatgcaagctgcctttgtctacctctagagcagccctggaaaacagaaatataatgtgagcttcgtgtgacttaaaattttctagtagctgcactaaaataaacagatgaaactaattttaataatgtattttttgtccaatatatccaagaaaatgtaatttcaacatgtaaacagtatcaagttgactttgcatgtttgtttgtttgtttgttttttgagacaggaacgatcatggttcattgcagcctcaaactcctgggctcaagcaatcctcctgcatcaacctcccaagtagctaggaccacaggtgtgtgccaccacacctggctgtgtgtgtgtgtgtgtgtgtgtgtgtgtgtgtgtgtgtgtaaacagggtcttgctatattgcccaggctggggctccacattttattttgtacaatgtctttgaaatttggcttatgttttacactgtgagcacacctgactttgaactagccacatttcaggtgcttaataaccacatttggctggtggctacggtaccggacagtccaagtctacagcctgatagtatggcttgagaatctctgcaggccagcaccaggctatcaggaaagaccccctttagtaaataaataactatgctgtggcatgattattcatggatgtgaaagtgaactctagccagataatctacaacaagggatttttatccaacaatggaatattttattttgtcataacctaatattgaacatctgagagcacaaacttttccacaaaataatgaaacccactgctaagatataactcagagaaaaatgagaagttgctctgcattctcattctatcttcctagttggttaaccctttgttacttgctcactctaggcttggaatgtattctatcatctcacagactgactggaagttctagctcaggtacatattaaatctgctccaccactggaatcaccaattggcatcaagcatcatgtatgtctttcagccaagagtggtattgaattaggccacgccctcacaaaagaactaaaacagacatcttggaattagttggtcactcctttacctcatactatgtatactctgtattggtaaaaagtccagtactcttttttgcccatttcaattattttacttgaaatgagaattttgtaattctcattctgttggctatccccacttcctaaatagtttatcctgctaggacctttgaaatagacattttgtgaacaaattcacgtgcttcctggaccttcaccctaagcactttgtgtaaaggaatgaccaaccaattctaagatgtctgtttcagttctttgtgtactctggtaaacaggaaaaatcactggatatggtggcaggatgcctaggttcaagtcctcactttctctttctagcatggtggccttaacaaatcaattaatctccctgagcctcagtttcttcatttataaaggagagataatagtaattactgaaaaattattggtgttggctgggtgcaatggctcatgcctgtaatcccagcactttgggagtctgaggcaggaggatcgcctgaggccagttcaagggcagcctgggcaacatagtaagaccctgtctctacaaaaaaaaaaaaaaatttaaattagccaggcatagtggcacatccctgtagtcccagctactcaggaggctgagacaagaggatcacttgaaccccaggagttcaaggctgcaatgagctattatcatgctactgtactatagcctgggcaacaaagccagactctgcctcttaaaaagaaaacaaaaaaaaactgttggtgtcattattaaatgccacagatgcataagaacattccttgtgaaccaaaaagtggtatgcaaatattaggtggaactagtattattttgcccaatcacttagattcttcagccttgaaattcctattatttgctctctaaacaccatctcctttttttcactctatccttcctttgttgtatagtttcctttattttcatccaatcctgatgtgccctactaattccctgacataaattctcattctattggctatccccacttcctaaatagattctcctgctaggacccttgaaaaagacattttgttgtgaacatattcatgtattaatacttcccagaccttcaccctaagcactcactcttcctcctcctatcaactgaaggactggtttaacccagtgccttcattttccctgtagccctcacagatcacaagacatgaataaaatcttttttcacatgaaatatgatatttataattcttactccctaagtggtgagagtcttaacagtattcttagtggccacagtgaagaagcaatttagttcaaactttcttgttagggcagattcaaccatttccaatcagtataaatcctcagtgcctttgcttcagcaaaagaaatagatgatgttcacaaaaacctttgacatttgattatatactcattatcttaagtgttaacattttacagagagctaatgagttattccagtaggtatttatccttggtaaaaagaataatatgtatttcagtaacttgtaaatcttgtgtggggagagctactttgctttgttctagtttatttcctgagctcattttttgagtatatctttgcccaacatcaatcacatgtggtatttgaagttttgacacataccaaaggcacagtaattgaaagaaatacaagttgcatcctcctaattcttgaaagtctcgaattcgtttcacttttgagtttcttacgatcataaggaggggaggagtacaactgtcgggaagtcgggaaaaattgtaaaatacttgaaatgggcaaaacagagtactggactttttcctgattgtcctgctgagagcacctttctaggcaatttccatctcttacggtctttgagctactttgcaaatccctaagttcttgaaaactaacataatgtaaatgattcttgtccatagaaaatcaaatgaactgtgtctagtggaacataattggttactgcccgaaaaatagactgatgcatccttctgtaaatgcattttgccattcctcactttctatatatgggtggttccttgaagtctccttgaaaaagaatttaacatcttactagtgccctcattaactaatgagataaaatttttgatagtaataatgattagtttgcatgagagtcatgattttacctttttttaaaaaaaattatctttttaaagtaaagactatatattgactgaaaaaggtaagctattgggtccctaacttctgcttactcaatgctggtggtaccaccaccccctccagctgtgacaataaaaatgtctccagacattgcgaaatgtctccagatattgccaaatgtctccttgaaggtaaaattgcccctggatgagaactactgatctatactcatctctaacagaaactaacaaaatgaaatctttgtcattttaataaataattcatgtatgaaacagataaaactcttcaatatctatttttaaaaacagttgaattaatcagcaagttgattgactaatagaaggcatatttaagggtgattaccttatggctgattgcacctcaacagcaggaagggtgtgattttttgaagggtctgtaaccacaaaccagaatgataccctctgggttacattgcaaagtaggacatgggaaattctgcagacagtggaaagaaaaaatacatgagaagaatatcataccaaatggcattaaaccgttcactctgatgctactactatcttaagagacatcttagctatgtttaaaaagtcatttctaccattatgaagaatgagctcagtaagaagaaaattatataggaaattcccattgtttcaaaatcatatacttggggatcattccttatagggaataacagggaatctgccaaaaaataataatagtcagtggagagcattagggatctcattctccatcaccggttggtgacagcccccgtttccccaatgcttggccctctctgaaccacagaaacctttggtattttctcattcaactctttttagtgccctgcccattcagtcttccacctctcagatccagagaggatctgctgccccctcatgattcaatacttgctctgtctgcatctactgtctctcttccaccccagcatcagggccaagacaaaaggcaccttctgtgtgtacttttgaagaaaaagttctcaaaaacaagtttcttttacatcgccttgaacaaacctccaacttaaacactataatcaattcaccagcagtctttgaactctttgttttgcagttacagacttttcaactgcaaattggaaatgtgactcactctcctctgtattacaagtgaaaggggagaaatgaaaatagtgttcagagagagacaatctatacatggatgtactcaggatggaaattataggaaagtccacataaaatcaacattgccaatgctaaaacaaaacctgatggctttcccagtttacttaagagcaaaattgcaaaaagcaacattaacatccatcctagaagaatctgatatgagtaaaggatttgtttagagcatccaagtgtattgtgatcattttcacactgatcaaagagagcacccttctgtcaacaggtatctgcagttttcaggacctggcagaaattcttctatgttctgtttttaaaggtcaggtacaaaagtagaggcagctgccaggcccctctgcccagagctgagtgtctgggaccatgagtgggaaggactgaggcttgagcctccttggtccgccagacagcatggggcgccacttgccccttctgcagctgcgcgccgcaaagctctggcctggccgtggcctcctgccccatgcaacacttggtggccagaccgtacccggcacatggcgcctcgtgcactttctgacattttgataccaaaggtcgctggtcactgagcccggacactatctctggccctgaccgcagatttcggaaacttctggcagcccagtgtctactggaaggcccaacccactgccctgctctcatgggcagctacctgagcggcttcctgggctggctctgggccagaaaaccgcgcacccacccccccgcccgacccccgcgccagaagcactgggccctactgtccaggcccttcctcagctcccaggtccaggagaactgcaaggtcacctacttccacgggaagcgctgggtctgcatccagcccctccccaccgctcctcccagctgggactacgcccgcatccgcatccggagagagatggtgcccgcccgcatccgcgtcctgagagagatggttcccgaggcctggaggtgctttcccaacaggctgccgctgctgagcaacatcaggcctgatttctctgaggctcgcctggcctacatgaagcggtggctttggaccgccgccacccccccaccagcctgtccgcagcctggtaaccatgaaaatcgccccgcccgagcgcagagggagcccgatgcccaggccatctgccttcgggtctgtgatgagaaacggagtggcccattcctttctgcccgggtctaggccgctgagcagagcccctactcccgggcagcgttgtctcaatccttcctggcggccgcctgccctgctgaggatatgtggccgccaggcgcccggtcgccgcaggagcgctaggcctgcgggtagcactgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataataataggtgtctttattatcatagagattgtcatattctttctttcaaagacgacaccatggtttctccagcttggcactactacttgggccagatggttctttcttggtgggggggggaggggggaggggaagggggagggaggagcgggaagctgtcttgtgcattgcagggccttagcaacatccctggcctctcacttctaggtgccagcagcacactcacagtcctatcaaaaatggctccaggcgttgccaaatactccctgggagggtagagaggtcaaaagtcatactggtggagaaccactgaggaacagtgacctctactggcagaaacaggcaagcctagtcccccaaaatgtgcggttttctaatacatatcaaagacgtagggacaaaccaaatgaagtggcgcatgctggacagaaaacattttcaccagttttctagaatgcttggggtgtgaatgattcctgtggtctggtcttactagcaatcaggaaatgcaaaattgttacaaatgagctactattttaaacgtttcaaattggcaacaatttaaaagttaaataataccaagggctggtaaagacgcatggaattggaatcccaggtgacgctgtggaagcaaggagtccagccactctggaatggcatttggaagtgattcccagaacagaaaacgcagctaccagaaaccctgtggcacacatacacagacactggtgaggatgttctttgcggcactcgtcaccatagcagagaattggaacaacccaaatgtcaatcagtacgggactaaagtaaatatagtatatgctgtcgagggaatactgttccacagattaaaggaaagaaatagcccagggtttctcaacatcagtacgatcaggccagataattttatgttgtgaggataccatgtgctttccaggttgtttagcagcaaatctgagctctatctaccaggtatcaggactacctccagttgtgacaatcaaaaatggctacaggtgttcccaaatatcccctgaaggacaaaatcacccccctggtggcaaccattgagctagagctatataattttttaaataaaagaataaatcttggcctggcacggtagctcacgcctgtaatcccagcactttgggaggctgaggggggcagatcacgaggtcaggagtttgagaccagtctggccagcatggtgaaaccccatctctacgaaaaatacaaaaattagctaggcatggtgacgcacacgtgtaatcccagctactcaggaggctgaggcaggagaatcgcttgaacccgggaggtggaggttgcagtgagctgagatcgcgccactgcactgcagcctgggcaacaaacaagactccgtctcaaaaaaaaaaagaataaatctcaaaaatacaccatcaagtgaaaaagataagaggtaaaatattatgcgtagtacataacatttatataaattaaacaaataccaaatagaatttcaggcataaaaggccagaaatcatgtaaagagtcatttagttactttgcctgtattattttttccatataaagcctctttaaatactgttcaaacatgaatttcatggtattccccattacagagccatagaatacagctgtaaacaaagcaaaatcctttatctcatggagcttgctaaggaggtggagacaaaagataaacaagtaaataaatgcatacactgtggaggtgtgaagtaagtactataaagaaaaaaaaataaaaggaagggcatacaactccatcaacacaactatggccccaaatactttcctctgtccccatcactatggaactataccatgaattcaagttctttaaatttattcaagtttccaatgggtggcaactcatactttaacacattacctcagcaaataaaatgaaaatattttatctacttagaaataaagatttccaaaagattaaaatttttgctgaaaatagtaaaccttacattttcaatagagacagttattgttagatagaaaaagttcctggactgaaactctaaaaacaaagtttttattttgaaatttactacctgccaaatggtggtcttgagacaagtcatttcgctgtctatgagttactaggaagggcttgagctcttagtgtgtcaatgggggtgtgctgttggcattttgggtgggaatgttatgggtaactgtcttgagccattcaccacactgattatctctcttccccaccctttaaatgccacagcactctacagtcatagatataacccccatacagatcccatttccttatactccatgggcagggggcggtcagtaccaagtaagaaacacttctaaatcccttcaaaagtttcaaggtcatgaaaacaaaggaagacagagaaagtgtcatagagtggatcagactaaggagaaatagattcttaaacagaaaaaggacattagtagaaaaagtgaaccaacgtgaatttctttgtttggataagtctaccgtggttatttaacatgatatcataagggaattggggttagagcagggtttctcaatagcaccattaacattttagcctggataattctaggttgtcggggactgtctatgttttgtatgatatatagcagcatccctagcctctacatactagatgccagtagcacatccaattgtgaaaaccaaaatgtctccagaaattgccagatatccttgggagcaattgcagggaacccccccaccaagtgttgagaaccactggtacgtagggactctctatattaactttgtaactcttttgtaaatctttttaattaaatacacagacatatacatacatataagagcaaagcagttatttaaaaagttgcctgggcacagtaaaagtatctacacgaaaaataaaaactaggcaacgttttaatgcttttgactagcttcattgataaggagataacagatttaaaaaatttgtttgaaattaagaaagctgtattcaaatgcaagatactggtacccaccagcataaggatggtattaatagttacctgaattttttaaaaattctttgttatacattcagatgtaaaattatttattatgatgacttccatcgtactagtttcttaagcatcatttctctaagattgatataaagagaagaggtaaatagttttggctgtttgtggtcttcttcaacaggacaatgttgtgtccttcctacatgatgtttctgcccaaatatgtaactcgtctcaagattctaagcaaacaaaaaggtaacctaatgttcaacaaatgtcaccaacagatatataactctacagacgtgtttatattttgttcacatacaggcagttgaactaagaattaataagcccacttcccacagtagcaatgttgtgggaagggggccaggggaaagcctagccctgctctgaaggcagcaaaggctgtatatgaagatggagacacactctgggctgatacttcctacttgcttggatgatgctttcagaaactaactgatgtcttggcctccccaagagtaagaaaccgaggtccaacaagagctaatacccaggcaacagggaactgcttctactctggccattgtgtgccaaatccaccatgggagcatcctcctgtgggactgaggtgaaaaagagaaagaaattggggggatggggggacatggttttcttgtgtccactgcacctcaatagacaggcctctggtttaagagccaggatgttaaacatgcttcattcactcacaactatttactaagagctaaccttgattagccagtatggttagggatatggttaggaaaagagttcctactacagcggccttcagattccgtgccccatcccatgcaggaatttagtgatgctaagactcttgaaaaccaagaccagagtcttgagtccaccagagcattaaataccaaagtggaagccagtaacccccacggtggcagaatttgcacatagttccatgccctatgtgagaatagacccaggacatggggaggacaaagatcttctagatttcacatggcttgtctgcattctttgtcaggagggtctctaatccctgccctgatttgaacttcatgatctccaagcaaagagcacctgttttaatttgatcagttgcagggtcactagggagattatcaaatattttgtccatttgcagcagatttctcttgtgccctgggacatgaggacatgagtcccaagtctgtcctgtgctgtaagcccccatattcctgaagcttggcccacgtggattcagcaagtgattggggggaaaaatggatggatgaaagaaggttaacatctcagtgcttctgacattattcccagagagacaaactgaggaagtaaattggtccagggctgtaataacagaaaagagaggcagggagggaaggagattactttcccgaaactttatctactcacctacaaatactcagacaacaaaacaaaacacagaactctctggcaaaagaagaatcctgaatatactgtagatgaaagtagccaagaagaactgtaaatgtgaaggcagaaagttggtgctaaaaaggaagtaacatgaagaatgactgcacatagttctgtaatttatgtattaaggaaccaaaggatacaaatttcttccagttatagattatgtgcaactaatgtgacttctccatggcctttcttccaaatgtgactacattgaatgtcctccaagatttgtacagaatgaaaaattgatcaacaagcatttcttgagctaaacatgtctttttaaagcacgttttgatgtcataaagaaactgaaatgccattagcacaactaaataaaaatcctacattttcaagattttaaatatgaatgagtccaatggaattattttttgttgttgttagagcaactcagcgaaacaaaattctaatttattgttcatcatattgtttcacacatatgtcaaagaggccaaaaaaataaacagcaactttacagacaaaaaaaaaaaaaaggcagggaggggagtgagaaaccttttatctttggcctttttaaccatctcatacaaacttatagtaccgctaagttcatatacaaaaaagacactggaacactcggaataagattttgttgttgttgttgttgtttttgcttttcttcaaggtttgttttttctttgaactgtatcatgaacatggtcacaccacaagtaaagtcagaagtaagacagagaaagctctgaaggctggtttgatcatttgaaatcattaaaaatggctgacccctaacaatatgtacaaaaatatacaatgaaaataaaaaatattgccaggtacagtggctcacgcctgtaatcccaggactctcgaggctgaggcgggcagatcacctgaggtcaggagttcgagacagcctggccaacatggtgaaaccccgtctctactaaaaatacaaaaattagccaggcgttgtggcaggcacctgtaatccttgctactcgggaaactgaggcaggagaattgcgttaaccgaggagatggaagttgcagtgagccaagatggcgccactgcactccaccctgggtgacagagcgagactccatctcaaaaaaaaacaaataaataaacaatgtaaataaaaaatatgaacaaatttttttcttgaagtacttttaaggaaaaaagctgagctttggaagtttggggttttttttcctcccctgttgcaaattcttgtggtttgggttgggtgttgaagagtgcttgcccggcaggcctctctacttcaagatgactacacttagattctgaaacagggtgaagagtgaatggatcacggtggccttttctctttttttcttttttttaatttaacttttccttttttgctgtctagtcaacctcatcagtcttctgcttcttggtatcaacgttgtcatcctcagcatcttcaactgcccatttgcccatagcatcctcagctgccacatcttcatcttcatcctcttcctcaccatcaccttcttcctcctctttttcctccccatattcttcctattcttcttctacctcattgtcagcctcctgtttcccattttcctcattagcgttcccattaccaggaccatctcttcccttctctgcctcctccacaacttctttcttctcctttaagactttggtgatgatcttggagctggtgtccacagttgcatctgacatggtggggcacaccagtgaccaatgcagtggactaaaaagaaaccgagagtttggggactggcaataatgcagagtccgagaagggcaggtgtagctgcagcaagctggaagccaaacccaaaaacaatgcaaatatggcttttcagagcagccagtgggctggtggaattatttgaattcactttaataatcattttgaccaattgtttttaccaagaaattatattaattcatacataagtaacttctttcagcaaatcatgaaagagaggtaaaaatgtttactccttttcctcaagtgtggaaagccctggtctgaaggtttctctaagaattggatccactgccatttttcatcaatggcgccagacagggccaactgcctccaaagagtggtaagaatctggctcttgtttctggaaatcaaaaggactaaataggcgctgggctgctgttttacaagcacaagaccgttaatccccttaccgtggatacaacagcacgttgttcctttttagatcacaagacttatccttgaataattaggcagaggcagaaatccattatatattctacaccatttaactcagaaagagaaagccttgcctgagttagactttatctttcttgctaaaaatgataaattatctaaaagttgatgtttgagtaaactaggcatattaagtttccagttgacctgggaattagactaaactttggattagattatagcttccttagaaattcctttcaacattttaaaattcctgtgaaactgttttagtaaatctggcctaaatcatattttaaacagttgaaaacacttggttgccatcttcaatccaagttccaggaaaacctcaagtaacctcaactaatgaaaccagagctttcccttaacttcatttttccatctatctcccattctgctcctaaaaaaatacagcaatagcaaaaaaagcatttaatatcagaaattgtgaatgatgattttgaaagagttgtcttgttgctgtcacatttgatctatctttctacaatgtctaccagggctaggttcctgggtgtggacctggtgcagtgtgggacctggtcttagtcctcattcgaatctcagtgctcagcacgtagcaggctttcagtagaggtcacttaatcctgtggctccagccacagcagtgtagttccacgggctggcctcatggacagcagtgaaggaagaggttgatgttgctcacactgttccctttgggcactctgtcagctccttcttcctcgcctcttgacagcatctggggcagatggtgtggctttcctgtcacttccggctgctaaggcatccaggccagtctaaccaaaactgccttcctgcctctcacctacagctgctctccttccagcagttctggccagagcagggacctgagtggtgggctccagccatttcctccgggctccactccctactccctccctgcctgtgctcccctccaccatgcttcattctcctcgcttagggacaggaaagcaagatgatgggggcgtgagatagataaggaaaggccaaattattcttcctggacctgggtccttgtggttcccccgctttgagaggtcttctgtggtagtggacgtccagatgctctccactcagaatgctcctgtggggccttcaagggcccctccagggacctctgcactgcatcttcccctgacatgggtgacacgctgactgatttcctccacctcgcctcggctctgcctccggggtgtacacctccagcctcactctgctgccttgccttgctctgtctcacttagggacatgggcccaataggcagtaactctatcctgttcccttccaaagcctctgcttggccccaggaatatattcaagtgcagactgctcaaaaaactgctctctctctccccagtcacaggtactcaagccagccttccaccatgagacttctctggctaagaagtagccaccagtttctgttccagatacactctcagtggctagggacaccatcatattctctagagctccagctactgttactctagtggcaacttgacggagtcctgagaatgtctgcaagttggggagcatccctccagaaaatattatgccagtctcctttcttaaagacaactgtatcctctatgagcacttctctacctgacttcaggtaggtagggatgcaaacaagaatatcactccaacacatcatcactcgtaaggaatggggaccaactcatcagcatgaactcagttgtcaacaccctagctggccgcactggggaatctgcacaggaacccattcccagccctgttcaagtcctaggggagtggaaatgccacagccctctctgcaagcccacaccctcagcctctctgatccccttagggaatccctggtttctcttccactgcctgcctgcggtgatggtaactggactagatcagctctccaacaagacatcacttcctttttcatagccatgcaagcttctactgtaagtatatgccaattgtacgtttccaaataggaagaggcatgctcaggagacaatgagctctgtatcattggtggtgaccaaacttgatataagagatgttgtagatatcaccctgggtaaaaggtgggatgaaagtgagactattcattattctgttaattacttgaatatctttatttttaattcacgtgatttggtttatttttgtgctttacagttttctgcaatattagtagataaacaatggtgggcgggggggagacaataaacagccagtcccaaaacttggatcctgaagctatcctggaaaggaatatttgccacactccttcagtctgcccacattggcaccaaaagatttctggaaggcggctactggtatcttccatccacctgccacactggagagaagcagcctctccgcaaagctattttcaatccaatcttgcattatgtggtgccctttcccatagctcttcatgtaggggtgcagcttccaatatggcagtgcatgtggaatccaggccagcagctgaattgcatcttaaacacatctcgctcgccaattcatccccttgatagcagtattaccaggactcatactgcctgactctttacagaaaaatgtgtactgaccctcagtccagttttgcagttttgatttttacaactgacactggcaacaaaagcttctacttttcttgaaggtgccattacttgcaatggcaaaaaccacaattactatttcaccaacccgacatatatcctgtgtacccaatttttttttttttttgagacagagtctcactctgtcacccaggctggagtgcagtggcaccatcatagttcactacagcctcaaactcccaggctcaagtgatctcagcctcctgagtagctgggactattggtgtgtgccaccatgcccagctaatttttgcattttttgtagaaacgaggttttgccatgttgtccatgttgcccaggctggtctcgaactcctgggctcaagtgatctgcctgcctcggcctcccaaagttttgggattggaggcgtgagccactgcacccagccccagtgcccaactgtaagtcaaacaacctttcaaataaaccggatcagatattcatagactcctacaatgctccagattctgaaggaagatattttaaaggtaaactcccaaaaatcaatctgaaatgttatatacttaaattaaaatttcctaagaatggaaacacttaatttaacttagtcatgtactaggtgaaatgtgatcatttaaaggaactaatagtgccatgaacacagcaatgtataaaacttgcttacaagaagggctagaagaaaatacaaagagaatatttaagaggttaccattgtgagataaccagtggcttttcttcttattttttttttcctgttcaactttttgtaatgtaatcaccttatttttattgaaaaaagttattataaatagttgtgaaagaatgctgcagtttaatggcatgaaatacaatatatataattttaagatctataaaacaggagtagaacttagggcaaagttttgttttattatataccttcttttcattttttgaatcacgttaatatattattttaaaacatatatttaaaatatacatgtgtgtatacacaaatgtatatgtgttcattttgctccctcaaattccactcttctgtttcattctttatattcatatcccatgcatcagatattgtggatgtgagggagaccaattaatagtaatcatctatactgggccttgaattattatagaattaagacaaaaagattgtacagatgggagaccaaaataaaaggttaggttggaggatatgactttaatcagcaggcagaatttctccctaatttaaaaaaaatcctgaaatgaaatatattcacctccattgtctcaagtagagcataagtgaggcaggtattgtcctgtactggagtaatacacaagatatttaacccttcatataaaatggcacctactaaatgctcctcagctgcaaacagcaagtacaaccttagggtgtatgcacctgtgcatgcagggcctggttctgtacttagctagagagttgcatgagagacgtctgctatcatttggggatggctacctcacaaggagaaaggaacccatgcccaggttctccttccagctcaccaatcacataagtcattttacctctcaagggaggagtgaagaagggaatagagaaagaccaggaatgttaccctcatcacaaatagagaaagaaagaaacatcatagagaagattcctccagaagaacagacaaaaaatataaaactattaaaagtcatattaagtgcttttaagaaaataaacaaggtactatgataaataccaagagtggaaagaacttatacacacttaggttattttcaaaataagagtaaaattctttggtatctatctgcaagaaaattatatatatatatatatatatatacacacacacacacaatagaaatgtagaaagcttaggatatatagctgcaattttgagggatatttatcttcatattatctattaaacaaagagcattgttggaacatgatataaactgtaagatgagttagattataaaagttatttttaagtttaataaaagtgtgaatccctttgaaaaattagcttaataaattattttcaaaatcaaggtttgaaataatgcactatctcaaataatactgtaaataatcagttaagatttctcattatttgcttactctgttgcttctctgttgggaacttttctcatggagaaagctaccatcgctttgaagaggtattcttcattggtatcccaggcatactgaaaaagaaggaaaacaaagtgtatgggggaaaatatggtccattggttctacttgtacccacagtggctctccctctctctctctctccacacacacacacacacacacgcacacacacacacgtttctcatatattagatactggagaccacgataaattatatccccatgtttggggtagggtttcttggacattctaagtttggtgtgtctcctgttgcactatcttcctaagaacctgcagcatcagtacccagccaacaaatagggcatttggacatttcatcctggccatatatagtccattttcatttccttcctccctttctcttttccctcataaactccctcccagttgcctttattaacatcagtacaatttttaaaaaattttcttagccagaaactttagtgtgtgtgcgtgcatattatgggctgaatttttgtcctcaccagaaaaatttcatgttgaagtcctaacttgcaatacctcagaatttaactctatttggagacagggtctttgcagtgatgattaagtcaaaatgaagttgttggagtgggccctaatccactatgattggtgtccttagaagaggaaatctggacacagagggaagatgatatgaagacacagggagaagacagccatctacatacaggccaaagagagaggcctggaacagatccttccttcacagccctcagaaggaaccaaccctatgacatcttgacttccagaactgagagaaaataaatttccgttgtgtaaggcacccagtctgtgttactctgttatggcaaccctagcaaattaatatagtatatttgactcactctgctccttaatgcagtaaatgcaaaaagcctgaggcaaaaagaaactgagctgtttaaggaccaccaaggagggtagcaactaaagagaagcaggaagggagaaagtagcaaaagctgagcggaagaagttggtgagggtggggggttggtatatcacaaggacattgtcaggattggggtttcactctgggatggggaaacatattttaccgttactgcctttctcctctttggtggcagggaggatagtaagtaaaaataaatgactcctaaataacaacaacaaaaaatgtattactcagttaccttctctgggtaaggtttatgactgtgctgtactttttcctttctcctaaatattttcatagcatattctttttttggaagggaggagggatggggtcttgctgtgctgtccaggctggtctcaaatgtgtggccttaagtgatcctcctgccttggcctctgtaacatagaaccttaaactttcttcagttgcttcttccacttcaccattttctccttcagtcctaccttatgtaactctgctgtaagatgttaccataaagaacagaaaagggggacaggagtggtggctcaagcctgtaacactttgggaggccaagatgggtggatcacttgagcccaggagctcaagactagcctgggcaacatagtgaaaccccatctctaccaaaaaaaaaaaaaaaatcagccaggcgtggtggcatgcacctgtagtcccagctacccaggaggctaaggcaggaagattgcttgaacctgggaagtggaggttgccgtgagccaagatcatgccactgcactccagcctggatgacagagtgagaccctgtctccaacaacaacaacaacaacaacaacaacaacaacaacaaaagaatggaaatggaaaaatcacttttctcatatgcaaatgttaaatactgcattttaatgtcaactttagatcttatttgaagtgctccttcaatgttttgatgtgaacttttcatttgatattatactatgaaagtttaaaagtaactgattggtggcatagctctttgtttttgataatgcatttttttccaaaattaattttattcagaataagagtagctatgatctaacctaataataaatgaataaaacatgaagaagaaatgggtctgattaaaaatggtgcagaaacactattaagacagggaaggcttattaacagaatgcagacacaaggaataagcctgctcaagaacaaatgagaataataagctcagtgcagaaaatgaaaataaagatgttagccagctctccctgggacatgaatttcagttgcttttcagatcttggggacaacttgacctgatctcctgtccttccatttgttcatctcaaaaacaagagcataagctggctgggtaggagtccaattttggtcacagaacaaaggtccaagctacttagatcagaacagaactgatgcagttctagattgggttgggtatcctgccagtggaaccaacttatcttgggcaagtgtgaaaaggattgaaagcttgtgcattggacgtagtgtatttctcccagggcattcaaacacttcaaagagagagcctccgcttataaaaggaattgagcacatatattaatgagaaaatgtacaacttaagagaggataaggtaagagttactaaagctaaacatttgtatactttatgatccattaatctactccagggtaaatacccccaaaaaagaaggcatatgaaaaatacacatataagaatgtccatagcagcttaactacctgttgtgcgtatacttgacacataataggtgctcaatgtgaaattgaacacatctttatatgccacgtgtggcttcacagaccaaatggtacaaattaattgcatatatttatctatcagtttagattccttggttcctcatttcaataacatgtgccaggaccttaaatgccccagctcaccttgctttttgcacacatctaagaacactcaaaccatggctaaccccacattttaggtaagtaactggtataactagagacaattacagaacagggttagttggtttaactctaaattcatgatgacctacccccaaattgcctgggaatccctaaggtttcaccatcagttctctttctcatgggtcacataactatttcaaacctctctctagagagagaactgatggtcaatgctttttttttttaaccatttttcccaatggtttccctcaaacctcactctcactaaatggttttgcttcataatttatagatacatctcatcaatttcaactctcccaacctcctgacatcaagatacaacacttcctccatagacacgtcttagccgcctcctctcctgaagtgccagacagaactatgcctatcagaggccatttccgtcacttatattaggaatgcttctcctctgcccttctcagatctaaacaatatcagttcccctccattctgtgtatttagctctgaccggagtctgttcattgtcttttaaccaagctcaagactttctcattaaagccatagcaaagagctgttgttttgcaacagcaaaaacaaatcattttactcagtcttcctttcttctacctactgctatctctttcctgcccttcacagccaaaattctcccaggagttgtccacacatctgtttcaacatgttcaccactcatttattttttaactccccactatctgtcttccagctcctccaccccacgaaaagagctctttctaaaatcaccattgacctccatattgtccaacacaatgaacatttttcagtcgccttctggcttggcctctcaacggcatttgatgctcttgaaccctccctacatctcaaaatgaaactccctaacacagcccacatattccttggcctgcctgctcctctctctttaagctcatcacctgccatgttcctcctcactgccccaattccagatatttctgccctctttctaatctttactctcaccaagatccttcctgtgataagcctttgcacatgctgttccctctgcctttccttctttcatttcctgtaacacttcaactcatgcttcagacatcacagtaagtgccaggtattgtgggccttgacaaagccgaagtgcccttgtacttcttcccgtaatacttgtcaagattgcacatttgcatttggtttactgaatatttaatagatgaccaattctactactactataagctccacaagggtaaggacaagccttaatcaccattacatcccagcattcagcatcgtacctgctattagaggatactgggatggccaaccctgcacactagtagagacagtgtattctgcactcagactgcctgggctcaaatcttacttctgccacttgctgacttgaaatattgagcatgttacttaatttctttgaacctcagttttctcatccattcagtgggaatactaatacctgtactactatcttcctcaaagcattgttgtgagggctaaatgatttgataggagtaaggtgcttagaagagccccagctagaaagtaagataagttctcaataaatgctggctgttataacaatcattactcattgagtcaataataaaataccaaattgatgaactggcctgcaaacagaatacctctaagtttctttagcactcttttttctgtttctatgcctaaggcatcttaacgtcaccttctattggggaaaaaattttgcagaccacactaggaaactgaaactagaattagacaatactgtctttttaattcaatgatctttaccattcctatagccacatgggccctatgactattttttaaacttctatttcataagcatatatttcatatgttactttgataattgagaataattgaagaaacttcaggttcaaattggaaattttttgtgctatgaaagactttatgtgggtagaactatcccttattttcaatggtagaaaatcgaggctaacaaaattcaaatgaccacaacggtgaggagtagacccagtccagacctgaacgactgactcaggccacttggcttcactatcccgagttgagatgctggttttttaagttgttttgtgtggcacaaaacttcacatgttgcctagcatacactactgattaaatactttaggcaaacctactttattaaaaattcatattattctataatctatctttaagaaatcagatttgaggtctttagaaataatttattcaagattaaggtaactatgcagacaggcccattattagagaaagcacagtgttattagcaaacaaaatttaaaaagaacactcaggtgctccacttactgctttatctcccagagctgttctgatactaagtctcactttaaaagcattttctgcacctgccagaaaagaaaaaagaaagagcagtatatgatgattaggatctgccaaaacagagtctgaaaaatcctaatatgtaatgcaactcaaactaatggaacaaagaactacaattaaacagccccaaatactcctggaagtttaacctaaatcatcttagatggtttaatattttctttcaaactcattaaacactcactgccccaactttcaagccacaacatgtctgcagatttagaaaaataaagagttctttcagtcgatgacttgtcaaacatgtagaaaactgttcatctatttttaaatttcaaggctacatacctggttgacagagttcagcatgaatggcagtcaccagaaaaaagagcagccacaacattctttcagggtggaaaacacaaggcaaagtgagaaaaaaaaaatccacgctgcacttaaatctgccttagccattctgtgacccggattagaatatcagagaaacaagcgagccaccaccaaaaaggtttaatgattaacacccatcatttgggttaatacttccataaaaacagcccatctcctgtcagttatttatgaaaacctgtttggaaaacagattagttgttttccctactctgactctacctcaaaag

SEQ ID NO: 212 - DNA, 100996 bp, Homo sapiens
ggtattcaatgcgtgttcatttattttacacttacaaaagaaatcgcccacccctttgccccattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatattacaagttagcaaattctagtacaaaaatagtccgtgtgttggaacagctttccttttacataggtcttaggtcagtctgctgtaatacctaacgcttccggattctctctcacaaatggctcaatcgtcactgctgaagcagcatggtgcctgcagcagcaggggctagtgtccaccttggggccgtgctggagacggcaggcctgggactgccttgctggccccagggcacctgggcagagctccagccctagctccgcatcgggggcttggagggagggatgagcttccccctcctgaggcaatgtcagacccaggacacagggcacatctgcccagggagctgggctggcgctggtgcaggacagcacatctcctgccagtgtctcctccccctacagcctggtcaggtgagaggcggtcctgcatgtcatcagcggcgagagtgtggccctgcccttgctgcagccagggcaggctggggcaggctacttgtccctcaggatgtcgagctgttcctgacactcggtgaagaggcgctggaatcggaggttctgcccgatgactggtagcagctccttcagcagctccctcttccgcagaccctgtggacacagagtgacagctgagtgcaagtgtcagtgaagagacctagattgtggggactttcctggcctggcagagaaccttgtgtctgctcacgggagaaggaaagaacaattcctctgcaggtgagaaactgtgagagagctgtggggcaaatgtgcaggatgaagtggcaggtggaatgggagcaacacagtgtggggataaaggaggatgaggccaatgcagggtctgctcctccatccgtgggcacagccactgctgaccttatagtgactgagcagttccctgaccatccagggcaggatgagagtagaacaaggctgagggtcaggtggctggccattcaggaggggctgttccctcatgctgatgtttgccaggggtttgaggtcaagccccagggcaaggatgcacctggggggcagtgactggctttagttttccagcaacacaaatgaggtgccagtatcccctgatgtggaggatgttcggatgctgaccaaactatgcttagttgcctaaacatcctccacgtcaggtcatattggcaccacagtctgaaacaagcattgccagttggggtctctgctgcacagaccaaaagagcagactcctgagcagtacggctgctccaaagggaaaactaccagccagacaactttaacactggacgagaaggtctaagatcttgaattaacggtgacagatatacctgcaacaagtctagaagtgacagtaaagaataagtgtaactattaggtttgagtaacacagaagttgttagagatgggataagcaggagaatggctgctgttggcgaccaagtttgatggaggagcagcccacactccaacagggaggctctgacaccagagtgccatagtcagaacagagatggtatggatttgcaaaggctgaaatgtttactatctggtcctttacagaaaagtttgtcaactcctaaaatagatcatgttttctaactaaaataattgagtaaaactcataggtcaaaggggaattctaattaagtgaaattaaaaatgacttgcaagagaatggtaaaaaaaaaaaaccaacacaaaatactccaaaagtggtaagattcagcaaaagtgggcactttagaggcatttagaaacaacagcttatactgtattagagaacatgaaagaatgacaagccaagactccaacctaaagccatcaggggaaaggaaaaaaaaaaagactaaagaaaaaaaggacatgagaaaaaaacattttttttaaaaaaaggagataataaaaattgaaataaataaaatagaaaacaaagatttaatagagaagatttagaaaaacaattttattttatatatttttttgagacagggtctagctctgttgcccaggctggagcgtagtggtgcaatcacagctcgctgcagcctcaacctcccaggctcaagtgatcctcctgcctcagttacccgagtagctgggactataggtgtgtgccaccatgtctggctaatttttatatatttagtagagcggggtttcaccttgttggccaggctgatctcaaactcctgagctcaagtgatcttcctgccttgttctcccaaagtgctgggattaaaggcgtgagccactatgcctggcaaaagtcatttcttgaaaagactaatggacaaacgtctggcaggattaatcaagaaagagagagaaagcttaaagaaataatattagaaataaaaagagacataactacagatatagaagaaagaaaaagatatgattactatcaactttatgctaagaaatttgaacatttagagaaaatggagaaattcctagaaaaatataatttatcaaaactagctcaaaaagaaatagaaaggaaaagttaattattaccataaagaaaacatcaggaatactattttaaaactgacatcaaggatgagattttctttgtctttcctttcccacagtttgactaatgtgtctcagtgcaggttcctttgggattttcctacttagagttcactgaggctcttgtattagtagacccccgtctttcctcaaatttggaaaatttccgccagtatttcttcaaataagctctctactcctttctctctcttacacttctagaactcccattatggattcatgggtatacttggatggtgtctggtaagtctcttagactctgtttgcttttcttcattctattttctttttgctcctcatacttgataatttcaaatgacctgttttcaagtttgctgatttacccttttgtctattcgagtctgctgttgaacccttctagtgaacttttcaattcagttattgtatttttaaactccagatttctgtttagctctttttttggaatttctatctccttgttgatactctcattttctttttttttttcttgagatggagcctcgatctgtcgcccaggctggagtgcagtggtgtgatctcggctcactgcaagctccgcctcctgggttcacaccattctcctgcctcagcctcccgagtagctgggactacaggcgccggccagcacgcctggctaatttttttgtatttttagtagagatggggttccaccatgttagcaaggatggtctcgatctcctgaccttgtgatccgcccgccttggcctcccaaagtgctgggattacaggcatgagccactgcacccggccctcattttcttcatatatagttttcctgattttgtttagttgtctgtattctccttgagcattttttaagacatttattttaaagtcttatgtctgatgggcacagtggctcatgcctgtaatctcagcactttgggaggccaaggcgggcagatcgcttgaggccaggagttcgagaccagtctggccaacatggcgaaaccccatctccactaaaaatacaaaaattaggccaggcgcggtggctcacgcctataatcccagcactttgggaggctgaggcggctggatcacttgaggtcaggagttcgagaccagtctggccaacatggcgaaaccccatctccactaaaaatactaaaattagccagtcctgacctcaggtgatccacctgccttggcctcccaaagtgctgggattaaggcatgaaccaacgcacccggcagtccttttacttttaagccattgtgttattacatgtaagctgggtttcttataagcagcatacagctggttgttattaattctaatctgataatctatgccttttagacctatatttaatgattattgatatattagggtttaaatctaccatcctatgtatgtttttctgccttcttttgaatgaatgtattattttctatcattcaattttatctatttgttagttttttagctacgattctttttactgctttgggatttgtatgtgtatgtgcatgagttttattttttggttttggtggttgctctagggcatataacatacagtatatgcctttacttatcatagtctgtcttcaagtattatatcactttgcataatgtgtaaaaatcttttaatggtatactttcatatccccactcctggcgtctgtgatactgctgtcatgccacttcacttctacatatgttataattacaaactacattttcattatttggcttaaaaaggcagaactttttgactttttttttttttgagacagggtcttgcgctctgttgcccaggctggagtgcagtggcgtgatcttggctcactgcaacctctgcctctcaggttcaagcaattcttgtgtcttcgcctcctgagtagctgggactacaggcatgtgccaccacacccggctaatttttgtatttctagtagagatggggtttcgccacgttggccaggctggtcttgaactcctggcctcaagtgatctgtccacctcggcctcccaaagtgctgggattacaggcgtgagccaccgcgccgaacgagaacttttttacattttgacatttagatgaacacttttgacatttaattcttaaccctttggaggtatatttttatgaactgaagatctgcttttacttagttacatataaataaccagtttcctaaactccatttattgaatagccccccctatttttcccactgtatctgttttgtcttctctctcatatagcaaagtatctaaattactccggcttcataataaacccaaatatctggtagcatagtgaatgtcttaactattcttggctttttactgctccatataaattgttgaattagcttgtcaagtttcattgaaacctctagtgggcatttgattagagaggcattgagtcagtaggtctgtttagaaacggttggcgtcttttactgtactgcactttctcatcgtttgtccaggttttctttaatgactttaagtaaacgtttataattcttagcatataggctatgtacatcctttgttagatttattcttagatactttataattctcaaaagagacaatcttgaaagtggcaaaaaaaaagtgactcatgagagggatttgaagtttgtgaagaactacacgcacaattgctggcttaaagatggaggaggcaggtggaaagctaacaaggaaatgaattctgctattccaataacgactgagcttggaagaggaccttgaaccctaggtgatctcatctggccagtaatttgagtagagaattcaggaaccactgcaaaagcacaccaggaagaccgaaagaaatcacagatcctttgaaagaagtggcaggctgctgcaaattccacaagacaggtgaaaaactctggtgctctctcaaaagtgccatctcctggctggaggccaattaactcaggacattacagcaattcataacagaacaaccctgctccaaggaaggagaaaaacaacagctaattccactgcctgcaacatcctttctaaccagtggtcctgagtgtgtccacatgatgacttcactggtagcataaccagcatttgagaaagcctgcacactaaacatatctacaaacaaggactctcacagagtctacgccattcccctggcaccaccaccacagcaggtgctggtatccacagctgggagatctgaagatggatcacatcaccgggttctttgcagacgttccccagcatgggcccagagcctggtagccccactgggtggctagacccagaagggcaataataatcaccgcagtctggctcataggaatctccatccctaggggaaggggaagtgcaccaaatcaagggatcaccctgtgggacaaaataatctcaacagcagcctctgagttccagatttttccactgaactagtctacccaaatgagaagtaatcagaaaagtaattctggcaataatgacaaaacaaggttctataatacctccaaaagaccacactagctcctcagcaatggatccaaaccaagaataattacaaagtacattttcattatttggcttaaaaaggcagaactttttggctttttctttttcttttttttttgagacagggtctcgctctgttgtccaggctggagtgcagtggcgtgatctctgaattgccaaagaattcagaaggctgattattaagctactcaaggagataccaaaggtgaaaatcaacttcaagaaattttaaaaaatatataggatatggatgaaaaatgctccagagaaatcggtatcataaagaaaaaatcaaaaaatcaaaaatcaaaacttctggaaataaaagacacacttagagaaatacaaaatgcactagaaagtttcaacaatagaatcaaagaagtagaagagagaacttcagaattcaaagacaagactttgaatcagacaaaaacaaagaaaaaataattttttaaaaaaatgaacaaagcctccaagaaatttgggattatgttaaatggccaaacctaagagtaagaataaatggtgttcctaagaagagaaatctaaaagtctgaaaaacgtatttgtggggatagttgaggaaagcttccctgaccttgctagagatctagacatccaaatacaagaagctcaaagaacacctgggaaatttatcacaaaaagatcatcacccaggtacacagtcatcaggttatctaaagtcaagacaaaggaaagaatcttaagagctgtaaggcaaaagcatcaggtaacctatacacgaaagcctatcggatttttttttttgagacagagtcttgctttgtcatccaggctggagtgcagtggtgcaatcttggctcactgcaatctctgccgccctggttcacgcaattctcctgcctcagcctcccaagtagctgggactacaggcccctgccaccaggcctggataatttttgtatttttattagaggtggggtttcaccgtgttggccaggctggtcttgaactcctgaccttaaatgatccacccaccttggcctccctaagtgttgggattacacgaatgagccactgcgcctggccagaatacctatcagattaacagcagatttctcagcagataccctacaagccagaagggtttgggttcctatttttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaaaaccttgaaatacaccaaaatagaacttccttaaagcataaaactcacagggtctataaaacaataacaaaatgaaaaaaaaaaaaccaacaaaaaaagaaggtattcaggtaaaaacaagcatggtaaataaaacagtacctcacatctcgatactaacattgaatgtaaatagtctaaatgctccacttaaaagatacagaatggcagaatggatacaaatccaccaaccaaatatctgctaacacatatggactcacataagttgagggtaaaggggtgaaaaaagatattccatgcaaatacaaaccaaaagcgagcagaaatagctattcttatatcagacaaaacagactttaaagcaacaatagttgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagcaacacagtaacagcggggacttcaacactagacaggtcatcaagacagaaaagcaacaaagaaacaatggacttacactataccctagaacaaatggacttaacacatatttacagaacattctacccaacaactgcagaatatacattcttttcatcagcacatggaacattctccaagaaagaccatatgataggccacaaaacaactctcaataaacttaagaaaatcgaaattatatcaagtaccctcttagaccacagtaaaataaaattggaaattaactccaaaaggaaccctcaaaactatacaaatacatggaaattaaaaaatatgctcctgaatgatctttgggtaaacaatgaaatcaagatggaaattaaaaagttttatgaactgaataatgacacagcttatcaaaacctctgggacacagcaaaagtggtgctaagaggaaagttgatagcattaaatgcttacatcaaaaagtatgaaagaggccaagcacggtggctcgtgtctgtaatcccagcaattttggaggccaaggcaggaggatcacttgaggtcaggagttcaagaccagcctggccaaaatgccaaaaccccgtctctatcaaaaatagaaaaaaattagctgggtgtggtgacgcatgcctgtagtcccagctacttgggaggctgaggcctgagaattgcttgaacctgggaggcagaggttgtagtgagccgagatgcaccactgcactccagcctgggcgacagagcgagactccgtctcaaaaaaaaaaaaaaaagatccaattaagctaaattagaaacaaaatgaaagatattacaactgataccacagaaatagaaaagatcattcaagactactatgaacacctttatgcacacaaactagaaaatctagaggaaatggataaattcctggaaatatataaccctcctagattcattcaggaaaaaatagaaactttgaacagaccaataataagtagcaagactgaaacagtaatttaaaaattgccaacaaaaaaacagtctgggaccagatggattcacagctgaattctattgaacattcaaagaagaatttgtaccaatcttactgaagctattacaaaagacagagaaagagggaatctccctaaatcactctatgaagccagtatcaccctaataccaaaaccaggaaaggacataacaaaaaatgaaatctacagaccaatatccctggtgaacatagatgcaaaaatcctcaacaaaatactacctaatcgaatcaaatggtgtatcaaaaagataatacaccatgatcaagtgggtttcataccagggatacagggaagacttaacgtacacatgtcaataaatgagatacatcacataaacagaattaaaaacaaaatcatatgatcatctcaatagatgccgaaaaagcatctgacaaaatctagcatgccttcgattaaagccctcaggaaaaccgtcatagaatggaaatacctcaaggtaataaaagccactatgacaaactcacagttgactttataccgaaaagggaaaagataaaagggttccccctgagaactctaacagacaaggatgcccactgtcaccactgctattcaacattgtactggaagtcctagccagagcaaacagacaagagaaagaaataaagggcatccaaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaatcagtaacactgctgtataccaacaatgaccaagctgagaatcaaatcaagaacctcttgttacaatagctgcaaataaaataaaataaaatacttcggaatatacctaaccaaggatgtgaaagatctctacaagaaaaactgaaaaactgattgctgaaagaaatcatagacaacacaaataaatggaaacacatctaaagctcatggtaggtaaaattaaaaatgaccatactgctaagagcaatctacagattcaatgcaattcccatcaaactaccatgattattcttcacagaactagaaaaaacaaccctaaaattcacaagaaaccacagcagggtgtggtggctcacgcctgtaattccagcactttgggaggctaaggtaggcagatcacttgagcccaggagttcgaaaccagtctgggcaacatggcgaaactctgtctctacaaaatatacaaaaatcagctgggtgtggtggctcacgtctgtaatcccagcactttgggaggctaaaatgggcagatcacttgagcccaggagttcgagaccagcctagacaacatggtgaaaccctatctttacaaaacatacaaaaattagccgggtgtgctggcacatgctgtagtcccagctactcaggaggctgaggtgcaggatcacttgagccttggaggcagagtttgccatgagccgagattgtgccactgcactccaacctgggtgacagagtgggaccctgtttcaaaaaaaaaaaaaaaaaaaaaaaatcatatggaacaaaagagcccaaatagccaaagcaagataaagctggaggcatcacattacccgacatcaaactatactacaaggatatagttaccaccaaaacagcatggtactggtataaaaataggcaaacagaccaatggaacagaatagagaacccagaaataaagccaaatacttacagccaacagatcttcaacaaagcaaacaaaaatacagagtggggaacaaacaccctattcaacaagtggtgctgggataactggcaagccacatatagaagaatgaagctggatcctcatctctcatcttatacaaatatcaattcaagatggatcaaagacttaaatctacgatctgaaaccacaacaattctagaagataacatcggaaaaactcttctagacattggcttaggcaaatagttcatgactacgaacccaaaagcaaatgcaacaaaaacaaggataaagagatggcacctaattaaacttaaaagcttctgcacagcaaaagaaataatcagcagagtaaacagacaacccacagagtgggagaaaatatttgcaaactatgcatctgacaaaggactaatatctggaatctacaaggaactcaaacaaatcagcaagataaaaacaaataaccccattaaaaagtggacaaagaacatgaatagacaattctcaaaagaagatatacaaatgaccaacaaacatatgaaaaaaatgctcaacatcactaattatcagggaaatgcaaatcaaaaccacaatgacataccaccttactcctgcaagaatggccataattaaaaaataaaaaaaatagatattagcatggaggtggtgaaaagggaacacttttacactgctggtgggaatgtaaactagtacaaccaccgtggaaaacagtatggggactcgttctggagatggagtctcactctgtcacccaggctggaatgcagtggcacgatctcggctcactggaacctctgcctcctgggttcaagtgattctcctgcctcagcctcctgagtagctgggactataggcatgcgccaccatggttggctaattttttgtatttttagtagagacagggtttcaccatgttggctgtgctggtcttgaactcctgacctcaggtgatctttccgcctcagcctcccaaagtgctgggattacaggcatgagccactgcacctggccagagattccttaaagaactaaaagtagaactaccatttgatccagcaatcccactactgtgtatctacccagaggaaaagaagtcattatgtgaacaatacacttgtacacacgtttatagcagcaccatttgcaactgcaaaaatacggaaccagtctaaatgcccatcaaccaatgagtggataaagaaaatgtggtatatatacaccatggaatactactcagccttaaaaaggaatgaaataatggcattcacagcaacctggatggagttggagaccattattctaagtgaagtaactcaggaatggaaaaccaaacattatatgttctcacttataagtaggagctaacctatgaggatgcaaaggtataacaatgatgtaatggactttggggactcagggggaagggtgaagagggtgagtgataaaagactacacattgggtacagtgtacactgctcaggtgatgggtgcactaaaatgtcaaaaaaagaaaaaaagcaactcatgtaaataggatattcaataagattatcagcatagtcagtgggatgacatattcaaaagaaagaaagaggccaggtgcagtggctcacacctgtaatcccagcactttgggaggctgaggtaggtggattgcttgagctcaggagtttgggaccagcctgggcaacacagcaaaatcccacctctaccaagaaaaaaaataaaaataaaaaatttgccaggcatggtggcgcacatctgtggtcccagctactcaggaggctgaggtgggaggcccacttgagcctgggaggtggaggttgaagtaagtcgagattacaccaatgtactccagcctgggtggcagagtcagactctgtctccaaaaatctacaacatcgtggaagttggaaaacacactgttattttaaatttcatgtatttttataaaaacagatggagttggttgggtgtggtggcttacacctgtaatcccaacactttgggagcctgagacgggtggattgattgagcctaggaatttgagaccagcctgggcaacatggagaaaaccccatctctacaaaagatacaacaattagttgggtgtggtggtgcacgcctgtaatcccagctactcgggaggcagaggcaggaggattgattgagccagaaggttgaggccacagtgaggggaaaaaaaaaaaagagagagagagagagagtcttgctatgttgctcaggctggtctcgaattcctgacctcaagtgatcttcccacctcagcttcccaaagtgctgggattacaggtgtgagccaccacgcctggctgaaaaaacacactattaaacaaagtgagacaaatgaaaatgaaaatacaacataccaaaacttacagtatgcagtgaaagctgatctcaaatcaataatctaacattacaccttaaggaactagaaaaagaactatacctaaagctagcagaagaaaataataaagataatgggacaagataaatggaaaataatagagataatcaatgaaaccaaaagttgattctttgaaaagatgaacaaaattgacaaacttttagctagactacataataaaaagagagacaagatccaaataatgaaaatcaaaaatgaaagcagggacattacaaccaatgccacaaaaataaaaaagattataaataagagaacagcatgaacaactatatgacaataaatctgataacctacataaaatggaaacaacttaccaagactggctcataaagaaattaaaaatctggacggatctctaatgagcaagaaaactgaatcaataaaacaaaccctctcataaagaaaagcctaggatcatatagcttctctgatgtattctaccaaacacttagagaattaacaccaatcctccttccaaaataggtaggaacacttcctatttcattctatgaggacagcattaccctgacaaagctagacaaagatactacaagaaaactattagatcaatatcctttgtaaacagtgacccaaaaatcctcaacaaaatgccagcaaacagaattccaaagtacattaaaagaattatacaccatgaccaagtgggatttattccttgaatgcaagaatggtttaacatatgaaaaccaatcactgtaatacatcacattaatgaaataaaagaaaattttaaaatgacacgatcatcttaatgcagaaaaagcatctgagaaaatgcaacattctttcttgataaaagcactcaacaaactaggaatggaagaaaactatctcgacatagtaaagaccataaataaaaagcccacagctaacatcgtacttaatggtaaaagactaaaagcttttcctttaatatcaggaacaagagaaggatgcctgcttccagcactaatatttaacgtagtattaagagtcctagacagatcaattaggcaaggagaagaaataaaaggcaaccaaattgggaaaaaagaagtaaaattatttctgttcacagatgacatgatcttatatatggaaaaccctaaagattcagcgaaaaactactataaacaaagcaaaacattctgcctgcctgtggtactaggaagaagctgcaagaggacttgccctctggcctgaaggcaatgtaaagagcagccaagtattattgatatttcctcacccttcggctctcagtaaaggatggtttttccactctttcaggatgcgatgtatagctctttgtacagcctgcaacacacaacttaatcaccacctctctggccactgccacaggtcttacagcagcagtccccaaccttttcggcacccaggactggtttttttttatggaccagtgggggaggggaagacggtttcaggataaaactgttccacctcagatcatcaggcattagattctcataaggagcacacaacctagatctctcatatgtgaagttcacaatagggtttgtgctcctatgagaatttaatgttgctgctgactggtctgtggcccagaggttggggacccctgtcttacactgaagaccacagcaaagggaggcttcctaagaacagggcctggctggggaggctggagccagaacaaagcccaggaacctgaaaggtgtttgcttagtgccccaaccttctgcttctcattttcctcccatgcacactgaaccatgcaaaggatccttgaagttgaaagaaatctgaacctttggtgtccctgtggtgcactggcagctcaaatcagagtatataaagagctcctataatatacatagagttcctacaaaccattgagaaaaacaaatggcaacaagtatttcaatagatagttcaaaaaagggaaacacaagcggctcttaagcatgtgaaatgatgctctcctaacaagccttcttgggagggctgctgagtcagcatggctggttggaagtccaccctccaaccacagctatattttcccagttatttgaaggatcagttccacttgaatgaccaattctcaccataaatgttgataaataaggccaggcacggtggctcacgcctgtaatcccagcactttgggaggctgaggtgggccactgcattccacactccagcctgggtgacagagagagacttcgtctcaaataaacacataaataaaataaaagagtgttgataaataaacccaagaagagcacagaaggctcatgctcactcatctcctctgccccaacatctagatgaaaagacagtaaacatacagaaaaaaaggaacaaattcagaatagtgttgagatcaggagaggacctggcagaagacactgggattggctatgtctacgtctgctctaaatcctcttctcttacatattctttgtacagagggagaaaacctgctcattttcccagcctcccttgcagcagaggtgggtgcccaagtgatttaatggttgcctgtgaggcacagactagtttctgggagagcgtttcttttctgatgagagggtgaatgttgctgttgccagatttctcctgttctctctccttccctgatcttggacatggaagccaccttgtaaccatgagggaagggctaggagacctttacagagggtggtaagcgggtggtacatactgacaggtgactctgggaggggaaccacagattctcttaggcagagcctcagtgaagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttcctcactgacaacaaagaaaaaaaggtggacaaatagcagcaaacttctgagagctaatgtgttaatgataaatgactgagccatgctgtggggaagacagagatccaaagagggatgcctttgctttggaaatatttatccatgaggaagaagctaggcagaacttctaccaaacttgagggcctgggttgggagcggtggctcatgtctataatcccagcacttcgggaggctgaggtgggtagatcacctgaggtcaggagtttgagaccagcctggtcaacatggtgaaaccccgcctctactaaaaaaataaaaattagctgggtgtagtggtgtgtgcctgtaattccagctacttgggaggctgaggcaggagaattgcttgaacccaggaggcagaggttacagtgagctgatattgtgccactgtactccagcccgggtgacagagcgagactccgtctcaaaataaacaaacaaaacaaacaaacaacttgagggcctagggggaccatagcaggggctagggccctgttaacttacccctcctttgtcctggtattccaaaggtacgcaacctagaataagcgtcaactggaagtaaactagcctctataccagctggcacccagctttgagttccaggcagcctagaaaacctcagtccctgaacgggatcatggagtccctacagtgctactcccaagaagttggcagaagcaaatagaagtgttctgtagaagaagataacatcatcttaggcctcaaactatttctacaataaatttttcaaatactatgtccaccagatagtaaaaaataaccaggtacataaggagataagacaatctgaatgagaaacagcagaaatatttataggcaacggaaatagatctgcaaaggctcctgatactagaattatcagacataaaactttaaaataactaagattattatgctaaagtagataaaagcctaaattaaaaatctggtgaagaattgaaagcatgaaaaatgatacagctgatttttttttttttgagacagagtctcaccctgtcgcctgggctggtgtgcaatggcgcgatctcggctcactgcaacctccgcctcctgggttcaagtgattctcctgcctcagcctcccaagtagctgggattacaggtgcccgccaccatgcctggctaattttttgtatttttagtagagatggggtttcactaagttggccaggctggtctcaaactcctgacctcatgatccgacccccttggcctcccaaagtgctggaattacaggagtgagccaccacgcttggcctttttattttttattttttgagatggagtttcgctcttgtcgcccaggctggagtacaatggcgtgatcttggctctgcctcctaggttcaagcgattctcctgcctcagcctcccgagtagctgggattacaggcacatgtcaccaagcccagctaatttttttttttagtagagtcggggtttcaccatgttggctgggttggtctcaaactcctgacctcaggtgatccgcccatcttggcctcccaaaaggctgggattataggcatgagccaccacgcctggcctgatacttgattttacttttttttaaattttccttttcttgagacggagttttgctctgtctcccaggatggagtgcagtggtgtgatcttggctcactgcagcctcctcctcccggttcaagcgattctcctgcctcagcctccccagtagctgggattacaggagtgtgccaccacacccagctaatttttatttttagtagagacgggatttcagcatgttggccgggcaggtcttgaactcctgacctcaggtgatccacccatctcggtttcccaaagtgctgggattacaggcatgagccactgtgcccggcgatacagctgattttaaaaagagaggatattacatctctcagatgatggggaaaatgaaagggaagaaataatcaaataggaaaaccgaagaaaatcactggtctctgtctctgtttctacagaatgaatgagctttctgaatcttcaaaacaccaagataggatcccaaagtacttacaaagcaatggaaattagatttacaatagatttttttagcaataacactggatgcaaagtctatggaacaatgccttcagggacttaaggggatttgactttgaacccaggattcaaagtacctagtcaattaaggtacaccacagtcaaatttaagaatggaataaaaaattaggcctctgtacacaccaaggcctgtgagggctgaccctctggccttttgatgtcaactcctttcacccttctgctaccatcccgttgggctgttccttttaaactccaagctctcccacctcaggcctttgcactttccctctgcctggatgttcttctcccaaatatatgcatggtttcatccctcaccttttctggtctctgcttatctgtttgtttggcctttcctttttcttttctttttttttttttgagacggagtctcgctctattgcccagactggagtgcagtggcgcgatcttggctcactgaaagcttagcctggcctttcttaattgcccagcatgaaatagcagcctgccagtattctatatctccctgcccttttaatttttttcccatggcatccatcaccactcaagacactacagatacctcttctcatttgcttagtctgtctctctccataagaaagcagatccatgaatgcagggactcagtctgccttattcactgctgcctgccccattcactgctgcctgccctatgcctataacatgcctggccaggggaggtgccccatcagtaattgctcaatgattgaatgaagctgtgagctaactcttagatccataccttctcccatcccccaccaacctgttaccttcttgatttaatgaatggttctggcatccattttttgcagctgaacctggaggtgccacatgttcattatgctttttccttccacatccaaccacccatcaaatcttattggttctgcctccaaaatacatcttgaatctgtctcctttcccctctccatggccaccacactgatccaagtcaccttcatctcttcctgggactgttacagaagatactccctgactgtttttctattttagttcatgacacctctgtgccaactctgccaagaagaaaacgctagctcctgtaaaggtctctgtggtccacctcctgcctcatttcacaccaccctctccttttgccttctatgtgccagccacagtggctccaaacagatcaagcactccttgcttttactctcacttctactaggaaacactttctccaggtctctgtatggctgtctcactcttctccttgggtttcatccgcagtgtcctctcacaaggccttcctggtcactccttcccaggcactctcatctgaagaccctgcttacttccttcttagtctgaatctagtctgaaaatattttgttgacctaactgcctccctgtttatgtgtgcatccctaccagaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaacaaacaacaacaacaaaaaacaaaacagaaataggaacacattacaaaaagaaataaaatcaagaatatgttgttgtgtctatcaaatcagaataaacacatgcgtattttattgcctactatgggcaagacgcccctgcatgtctctcagcggggggcactgagacccataatcacagattttcactcacttgctcactcccctgacatctgtagtgcctcctctgtgtgttgggcccagaggaaaaacgagatatggccagttctgtgataaactccttaaggtgatgggaagatatgggaaattgtgggctggtgagatctgtctttgagaagatgcgctggcagctggtgttgaggggaggtcaggagggtgggacggccagcccgcaggaggtaagagatggcaaaggcatgactgaagaggggcaactgagtggagggggcataggtccattaactcaagggttatgggcaccacccagtagggctgctagaaaggctggaggtagagtgtcggggtttgtcagcacttggggcagctaaagcaatagggaatggattaaactgtccaaagaaaagggtggagtaagagagatgaaactggaatctgaggaattttggaagtgaatggggtccacttttatactagattcctccttttacagccaaggaaacaagggacagaatggagggtgggtaactggtgtatggacactagaacaggcaggtggaagatggagaaagagaagcaagcagcagaagtcatcccaagatgggtggcggggcggagaggaggtggggacttgatgcagggcatcagagcaagtcccagtcaacacccaggatgaagcaaaccagagtggagtaagaggaggggctcccagggaagacgtgactagagcaccacaggagaggtatgagagcctgggaaggctgagtattcagaaaagctggggaccacacataatggcaaccacatagacctggtgggaagagtaaacatcaaattcatcatcgtggtctgcagggagggaggggaggcttcaagttgatcagtaatatttgctgtcgtttacaagtgtatgtacacacacacacacatacactcgtatttacacagccagaggcacatgtgacatgttagttctgggaattacatccgtgaaggtctgattatgattttctctgtcttttctgtacttaaatttttttctaaattataatcaaaatggggagggtgatgacaaaaataaagcaaaaagcccaggaagctgcacagagagagctctgggagggcctgccccatgccgcaccctgaaggctgcactcaagtgggaggaaaagttggtaaggctattggagtcactgtgaggacagtgcagccacctcttccagcacacctggctttctgcaagggaggcagcagagtgagagctctggcgggaagtgccagaaatggagggcctcagtaagtgcaggacatcaggcaagcctgtccagggcaggaagggctgggaggaggaagagaaccactgctacaagatgccctcactgattagcagcactgccaagttgtggtgcagggcaggagccagaacatagaatctgctccttcagaccatgtctttccacccaggcatctattcctccgtcctgctgcctgtcctgctgcttctctgcgggaacaccctcagggtcactctattcagagcctcagagcctataaggggctgggtgcctgctgagctgccttgactgcagctcaggctgggaggtagaggctgctgggccatcacatcttttccctgatttcacagggactaagtgaggcctgggaggatggaggggcagaaggagaaggctgctcagggctgccaggagcctcaccttcgtttacgaggtaccgtgcgtagacgaggagccaatggcggtactcgtggctggactgcagggtgagtgctgctgccacctggttctctaggtaggccagggtggtctcttgctgcaccacatgaggcacggagaagagccgggcagcctgccttcccgagctgcagagaccaggagagtttccatgatggggcagcaggcactacacagagtcaggaactgcccccgtgtgcaacaggcaaggagctggcaggaggcaggcaccagggctgccaaggcctcccgtccactagccagtctgttggcagatgccagatctgttgtctgcccatccccacgccccagccatgtgcctcctggcacccttggggtatctcacccagcacctgccatctgggcccctgaagtgacagggccagtgattgctgcccccaaccccaagatattacctgatgcaggaccactaccctcagcacccctagtccgtcctgcccagcctgcctgtgctgaccagcacctggggcacaggggaagggcaggtggagaccaggcctgggcagggactgtgcgtgcactgacccaggcacttccccagggcaggactaaggacagtggccatggcattcaggtcacgtacttggaggtgcggccctggattatggctaacggtcctgagcacagcatggcgtcctgggatggcaggctgctcctaaagtctgcacactgagccagtgagtcctgcttgtcagaaaccaggttcctggggaggcaaaggcaggagcagagctcaggaaaaccaagagatctggttggcctctttgccaaccagagaaggctggcaaagaggccacagagaagcagcccctgccgacacagaaagccagtagaggctgagcgcccctgcacttccgcacaggcgcctatcactgacaggtttcatggtaatgggtctgatagatcactgttccaaaggaaaaatgagtgaagtgaaggctgtggatagggcccttgctgggaacacttcagctccatatgttggttcctgatgactgcaggcctctgtgtgcagtgtgctctgatgctcagctcaaacactgccatggtctgcccacagggccacatggcctgggccctgtagctagcgagcaatgccaggcctctacctgcctgtatttctacaactatcccagactggcagtccttccaccttctctggacccttctcatccttgtgaagaagactcttcacacacttttagaacagctagatgtctttgtaaatgtgtccaaaatacaaagatgcctacagagagtcaatatttctcttcttaaataatcagcttatttccattattacagcaatcatatataatagacaacattttgcaatttgggggagcaggcagtggagattttttttttcctttgagacagggtcttactctgctgcccaggctgaagtgcagtagtgtgattacagctcactgcagcctcgacctcctgggctcaagggatctcctgcttcagcttcccaaggagctgggactacagatgtgtgccactgcacctggcttatttaaaattttttttttttggtagagacagggtctcactatgttgcccaagctggtctcaaactcatgggatcaagcaatcctctcagcctcccacagcgctgggattacaggtgtgagccatcgcacccagcagattttttttttccaaattcaagaaagaagtctcagtgtgaatgtagacttctgcatggcagttcttaacagaaaaggggctaggaggtagcaagctttggttcttaaggaccaaaggtatagacagaagaaaagaacttggagtggctggaacacaacgtacataattcacgtgtctgggttaagagctctgatgtataaattattttgcaagtacaaaaaagggctccaaattcctgagtggacagaggaaaagtacagaccatcatgcctgggtaagtggataagcatccttactaattcactgaggaagtctgaagtgcttactaagctcacagaaattgactagtcctgttaaggctcctgtaaagcccactaacctatgctcatggtggctaagggggccacagcaaaaaccataaaaattttggggctttttcaaaaagtgcctcctgaaaataatgcaggaggacagtgctcctgcacacaggctctgagggcagaggccataggctgcagtgtcctgctgggacaggggagcatgcacagatagtcaatgcagcctgcactccagggcctgactctcaggaaaagcagggctaggcagccctgtaggccacgaccctttgctctgctgtctagagcagacagacactcttccagggaataggactgggggtcagcttgcttaccatgtggaaagtgacggattaaagcagtacgccttcccatcggacaggttcattactgggattccatgctgcgtcagcaagatctgtgataccgtcatatcacttcctgaggacagcatgggaatgagttctgggtgtgctctgatcagcaagtgttttcaaacatatcaaaggagaaatctgtactctaggctcccacagtcccagcagcaaatgcatcaacactgccttggcaaatagggagggcaagccattctccttgccacacaccaggcttttgtcacctcttggggacccattcaaacatgcccccaaaaagtgtgtgtctcctgcagcgtaaccacacctcctgcctcactgagagccctgggctgaggccagagcctggctctctgagcggggcccttctgcagcatcagacatgaacttgggcccccaaaagagtagggacagcctgttgcctgcattacctgccaggatggagtgtagagactcttctttcaccacaaccacctgtctgtgaacatccctaggagggagacagggaacagtttactcaccaacccaggtaaacacatcagagtgtgccttggctgctcagacaccctggccctactgcatgcgaccctaaccctggcctctcctagtgagaggggctctgggctacgagtggcttctgctctccatgtgccactacactccctctgcattaaggctgcagcacaaagcccaggcaacagagccatggggaaccctcagcgcccacaccactttgggggaagccaggccacagcagccacatcaggaacatggccacattctgccagctaagactccatttctgatgaatcttgcataggaccctggcagtgcaactggtcgcatgggctgctccagtaaggaaataatcgagcaggcaagctgcctccatcccccttgcacactacccctcagccctcagcctacccagggcacccaacacaagcaatatcactaactgctcagggcctcttctggggcctgatggccagccttgtccactgccttccctgcccctgcagtgaggtggggcctacacagccctgtcctgccctggctgaagcccaccccaccctgtgcctgcctctcaccagacagagagtgtggctgcagcggtgagcgccatgacgtaggagcctgtgcaatgcaaagtagagatcggggatggcaggaggatgggagagaggagacggcgaccacaggtggagaacactgacagcatccttttttcacaggcgacacacaccacgtcactgagaaggcagagtgggggcaggtgtcatgggggctgagtgctgcagccaagacagtagccctggaagtgtgggccttccctctgcctgggcccaacaagggcctcccctgagcaggtacagccagaagggaaggtggattgggtcagggtagggctggtggggctgttggagcctccctgagatcttggatgaaagaggcttctgtcctatttccacaggctgcctgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacagagccccctaaggcacagccacaggcccagggtgaggctggagctcagacgcaggcaggggtagcagatgtacagccagtacagtgagatcctggccacagtaggccacccagagccctgctttgtgtcacttctatcctggtgagccagtcactccagcaggctcaaggaggtcagttaaggaaggagctctgccaactgccttcctaatgagccactattgctactggctccaaaaagggagaggcaagtgagatgcttttgtttacaaatgtttacttggagagtatgaatcagagaacactctaagcagcacgggcaacaaggagctctctgcagtgctgtgactgaattcttattttttctgagacagagtctcggtctgtcgcccaggctggagtgtagtggcgtgatctcggctcactgcaacctccgcctccccagttcaagcgattctcctaccttagcctcccgagtagctgggattacaggcacatgctaccacgcctggctaatttttgtatttttggtagagatggggtttcaatatgttggccaggctggtactgtgactgaattctatctgcccatctctggtggtcagagcctggctcaagccagcccactgcaaagaaagccatcatttttgggctgtaacactggggaacaggtctgcaggctgggcctgaactgggcaggactaagcaggaggagaggtcccacgtggtccagcaggcttgccccacagctgccatgtcactgtgggagaggctgtgccgacaccccttagccctcagctgggcaagccacctgccttgaggggagggacagagagtgggagcctgtggaagcatctgatacacaggtgcctgggactgggaatttaaatggctcatctggagggggaatttgagggaggaacagaacaaacagtggggtcccctaggcctaaaaacacaaaactcactcagggcccacgagaattgtggtctaagacctaaggccatgtgctttgacacaagtaaaagcatttacatgggacctcatggcagatgattaagggtgtaattatgatgactgtatctggtcctgactgggatgctacatcagacaggaacctgaggagaaacattggttccccttccacattgaacacaggtagggacagggctcacgtacagttctaggaacccaggggaagatactgggtgactaatcactgaatcaaggtccccctcacagtgcagaatctggcatgggctgggatggggacttcagggacagtcagaaatccatcctgaccaacttggatggaaatctgggatccaaaaaaggaaccagcccaggtcaaggtgagccaggcacacctcagtgtggaattcgagactttggggatctggctggacaagggaatcaggccatcaggttcaaagcttggcctgggtaaccctcaagggctcagtttccccatctgtaacacggggatactgatgctgaccttgctgggtgctgcagggactgagatgacaagcacatatgcttggcctggagtgaagcctggtgtgagtctctgtgggagctggtgctcccagggtcatgcacctcccctagacaggcccaggcccagaatgatggcatgtgtgcctgtgtcacctgggccggctaaggacctgcccacccttaccagctgcccgcagcagtgaggatccggctggtgagtaccgtctcccactccttcccttcccggttgcacttcaggcggctcagcttcacgccccccaccactgtcacttcattctccacctcaatgtacatggaaggatcggagctgacctggatgaagtaaacacacgggtctgctcagacaagggccgcagcccaggtgacatgctccaaggctctgtagcctggggccccaaggcagcagcaggatacagaggcagactggctggccaagagaggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtgggtgagctgggccgagggctgactgcccccttcacagacccagaaatgacagtcccaagcagtgcttggagggcaagatgcctaggggaagggctggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctgaggtacaagggtatgcagagaggcagcagtgtgtgtgacggcaccatggcaggagaggcctagatactatgctgggccaagtgaccaggagggctctgggtataaaggattatttactccagaattgtgttttggataaccacatgcttacaagcttccattccaagagctcaaacaactctgatgattgactgtgccagacactgagaagacaaagctagcaggatggttgggagatagattatgaccacacattcccacagacaccaagcctgaggctgcccagggctgtgtgtggaggtggaggtggcttccagccaggacacctgagaggagtcctgaagagcaccagaacatgtggtggtaatggcagccccagcagctggaatcccaagggcaaagccagacagaggctatgggtgagtgagagtggaggctggcaatttcgctaagagttggtgggtaccccgatctgctatgacttctcccagaaggtgatggagagccactggaaaccaatctccaaggaagtgacaagataggatttgtatgcagtaggggacagagaatgtctgggtgtgcctgagggagaactggcagggtcctagaacttacctggagggtgaatgctctctgggggcttggaattggcagcttcagtgcaagtgctggtgcagacagacacatggcctccttctctgcggttagggcagctggagactggaagagccagaaacgttcctgagccttgctctaacactacggggtagcatttggtaaaggcaggtcacccagaagtgaggctgagcctgcgaccagagcatttccaccctgggagggaggaagcagaggggaatgctacaaggatcctaacctcatggacaagccagttgatgccagggaacctgctcaagggccctgggtgagtcaagggcacatctgagggagagcgtggcctccatgctacattccaggggctgcatgtctaagccagctggttcccaaggtgacccacccagctgaggcttaccatgcacacagggccttcaagctctaagtacagaaaggtgggctaaagaaggcaggatgggcccactggcctcacctggacagacagagacacaggcatgagacgagagtccttccgaggccgccctttcttcttcttctctactgtctctacctcaagctcaagttttcgcttggacagtgaggaagccttagccaaagggactttctcatcgctgtcactgctgctctccaggaggtctcggggcctcagctctttcacaaggttctgctcttttaacctgcacaaaaacattacatcacacttcccttcagaaaccattcatgcaagaaagagtgaagtgaaatatttaaagtgcttaaacaaacctcttgccaacctagaattctgtgtccagtgaaattatgcctcaaaagtaaaggagaaataatgactttgtcagacaaaaataaacaaagagacaccggaatctgttgccagaagacctgccttgcaagaaatgttaaaagtctttcagagagaagataaatgatgcaggccagaaactcacatctgcatgaagaaaggaagagtgatgttagagaaaaaaaacaatgaacataaaatagaatcttttgtatttcatattcccaactgatctgagagacaactttctgttcaaacaaataacagccaccatgtcttgaattactatagtttatgaatgagtgaaataagtggtaccaatgtcatagggcatggaaggaaagagtggggaactctttctactacccatgaagtggtataatattatttgaaagtagagttaggttataaatgtttattgtaaactctagagcaatcactaaaaaaaattttttaaagcataattaataatgctgagaggagagaaaatttatttttattttattatcattttttttttggagatggattttcactcttctcgcccagcctggaatgcaatggtgtgatcttggctcactgcaacatccacctactggggtcaagtgattctcctgcctcagtctcccaagtagctgggattacaggtgtgtgccaccacgcctggttaatttttgtattattagtagagacagggtttcatcatgttggccaggccagtcttgaactcctgacctcaggtgacctacccgcctcagcctcccaaagtgttgggattatggtcgtgagccaccatgcctggctgagaaaactgaatcatataaaatactcagctaaaaccagagaaggcagaaaaagaagataaaaagaagtgaagattaaaaaaaaagaataaggccgggcacggtggctcacgcctgtaatcccagcactttgggaggctgaggtgggtgaatcacctgaggtcaggagattgagaccgtcctggccaacacggtgaaaccctgtctctactaaaatacaaaaaattagccgggtgtggtggcgtgtgcctgtagtcccagctactcggcaggctgaggcagggcaattgcttgaacccaggaggcagaggttgcagggagtcaagatcgtgccactgcactccagcctggtgacaaagtgagattccgtctcaaaaaaaaaaacaaaaaaaacaaaaaaaagaaatgggtttatgtttttaaaaatttaattttaactacaaaagacaaagacagattaatagtaggtggacacagtggctcatgcctgtagtcccagctacttggtaggctgaggcaggaggactgctcgagcccagaggcttgagagcagcctgggcaaaataatgagaccccatctctaagaacaaaaaataagtaaataaataaatacaagaaaaggggtgattctaactatatgacaacctggaacaggcaaaaccatggagacaataaaaagatcagtggtttccaggggttggggaaaggaaggtaactatatgaagcacagaatttttaaggcattgaaactattctggctgggtgtggtggctctttcctgtaattcctacactttgggaggccaaggtgggcagatcacttgaggtcaggagtttgagactggcctggccaacatggtgagaccccatctctactaaaaatacaaaaattagccacgtgtggtggcatacacatgtaatcccagctacctgggaggctgaggtaggagaattgcttgaacctgggaggcggaggttgcagtgagccgagatgcgactgtgccaccgcactccagcctgggcaatagagcgagactctgtctcgaaaaaacccaaaaaactattctgtaagatatataatgatgaatatatgtcattatacattggttaaacccgtaaaacgtacaacatcaagagtagacccaaatgtaaactttgggtgacggtgtgccccactctggtgggggatgctgaaagtgggggatgctatgggtatgttggggaggcgggcatgtgggaactctttgtatttcctgttcaatttagctgtgaacctaaactgctctaacaaataaagtctattaaaaaaaaaaagcgaggactggagaaagacatgccatgataacactaatcaaaaaaaggtggtgtagttacgtaagcaaagcaggcatcagagacagtaaagttatcaaggataaagagggacattacacagtgataaagatgaaggagtcaattcttcaagaagacagaacaattctgaataagtacacaggcataccttgtgttattgtgctttacttcactgtgcttcgcagagactatgttttttttacaagttgaaggtttgtggcaaccctgcatcaagcaagtctattggcgccatttccccaacagcaggtgctcatttcgtgtctctgtgtcacattttgataattctcacaatatttcaaacattttcattcttattgtatctgttttggtgatctgccattagtgatctttcatgttagtattataactgttttggggcactgtgaaccacacccatgtaagatgctgaacttaatcaataaatggcgtttatgttctgactgctccaccaactggttgttctcctgtctcccttcctctccccaggcctccctattatctgagacaaaacaatattgaaattaggccaatcgataaccctataatggcctctaagtaagtgttaaaccaaaagctaaaaatgattaagcttaaagaggaaggcacattgaaagctgagacaggccaaaagctataccttttgcaccagttagccaaggtgtgaatgcaatggaaaagctcttaaaggaagttaaaagtgctactccagtgaacacatgtttgaaaagaaagcaaaacagccttattgctaatatggagaaagttttagtgctctggatagaagatcaaaccagccacaacactcccttaatccacagcctaatccaaagcaaggctctaactattttcatttctatgaaggctgagagaggtgaggaagctggagaagaaagtctgaagctagcagaggttggctcatgaagtttaaggaaagaagctgcctctataacataaaacggcaaggtgaagcagcaagtgctaatgtagaagttgcagcaaggtattagaacatctagctaagatcatggatgaaggtggtaacactaaacaacagattgtcagtgtaggtaaaacagccttctatcagaagaagatgtcatctaggactttcctagctagagaagggaagtcaatgcctggcttcaaagtttcagaagacaggctggttatcttattgaagtgaatgcagctggtgattttaggtggaagtcaatactcattaactattccaaaaatcctagggcccttaagaattattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccacactaagtttggcatcagtatagtgaccttctgagagcaagagaccacaccaggttgcctaaggagaggtgaactgcccagtttggaaacagagcaggtaaaaactcttgtgttgataagtagtggtactgtgcctgtgaataacactgcactccagcctgggcaacatagcaagacactatctcttaaataaattaaaaataataattaaaaaattttgtgggccaggtgtggtggttcccgcctgtaatcccagcactttgggaggctgaggcaggcagatcacaaggtcaggagaccgagaccatcctggataacacggtaaaaccccgtctctactaaaaatacaaaaaattagccaggtgtggtggggggcgcctgtagtcccagctacttgggaggctgaggcaggagaatggcgtgaacccgggaggtggagcttgcagtgagccgagaccgcaccactgcactccagcctgggcgacagagcgagactccgtctcaaaaaaacaaaaaaacattttgtaagctatatcagattcctctggcagatctgggcaaagtaatctggaaagtattcaccattctagatgtcattaagaacatcagtgattcatgggatgtcaaaatatcaaccttaacaagagtttggaagaagcggattccaaccctcatgaatgactttgaggggttcaagacttcagtggaaaaagtcattacacatgtggtggaaacagtaagagaactagaagtaaagcctgaagatgggactaaattgctgcaatctcataaaaaacttgaacaaatgaggaggtgctagttagggaagagcaaagaaagtagtttcttaagatggaatctcctggtgaagatgctgtgcatattgttgaaataataagggatttatttatttttattttgagacagattctcattctgttgcccaggctggagtacagtggcacaatctcagctcgctgcaacctccgcctcctgggctcaagggattctcatacctcagcctccccgagtagctaggactacaggcatgcaccgtgacaaccggctaattttttgtatttttaatagagatggggtttcaccatgttggccaagctggtcttgagctcctgacctcagatgaaccacccacctcggcctcccaaagtgttgggattacaggtgtgagccactgcacctggcctttattggcatacattgaaatatcatgccatcgaaatcctttttgtaaggttggtactaatgcctcctttcatttctgattgtatttatttatatactaatcatactttaatacaactgtatgtcgggcttttttcaaataacattccatctgaactatttttccatagtacagtcatcctttggtatctgcatggggattgattccaggacccccaggagatatcaaaatccaaggatgctcaagtcccgtatataaaatgatttagtatttgcatataatgtaggcacagcttccaatgtaccattttttttttttttttgagacggagtctcactctgttgctcaggctggaatgcagtggtgtgatcttggatcactgcaacctctgcctcccaggttcaagtgactctcctgcctcagcctcccaagtagctgagattacaggcacgcaccaccacgccccgctaatttttgtatttttactagagacgaagttttgccatgttggccagggtggtctcgaattcctgacctcaggtgatctgcctgccttggcttcccaaagtgctgagattacaggtatgagccactgagctgagcccggccagcctcctatatactttaaataatctctagatcacgtatacatagtacaatgcctaaaaataacttcatttgcatggattcaaagtagtacttggcatgtagcaaattcagtttttgctttttggaactctgtggaatttcttttcccaaatatttttgatccatagttggctgaatccatagatgtggaacccatggatacagaggggcgcctgtactttggtccttataaacattaaagagaggcacaacataatgaatagcttacttcctcaacacctctcttttgaagaagttggtaaatgtttctcataatgctgtgttaaacatctctaaatatgacagactccctggatcacaggtgctatcactgatcttatttcctcaaggagttcaccatgagtgaactcctgtctagtatccaagagccctcatccctgcctgccttcccactgctaaccagcctctggcctgttagcccctcctctgggcactgtcttcagctgttttccctgctagtcacctgggtcaaagaaatgtgggcagatacacacaccagcgtgtagaatcctggattcttttcatttgtatccatgtgaaaaactgggaagacaagaggcccatgacgctgctctgtgaaactgaagtgtctgttcccctttcttctaatgtcctacaacagggcaaagcatccatctgtgggtgtagcttaatattctggaagtcctgagtcagtgctcctcaaaatcctttaaaaatttttttttttttaaatgtcagacatttgcctcttcaaagagcttgttttactatgttgtaaaaatcagatcatgtacattttcatattaaattttttgttaaataagcttttggaacagtcaaaaatgctttctctcagatgttctgaatatggaaatggaatattagcttgttctaattttttctaacatgaattttcctggttcagactgatctgaaagggtttcatgtattaaaatgagagaatcctattgtgaaacatggaaaaaaagtcagacttttatgtaactatcgttttgtaaaatacagcgagaatgtcacagcaacgtccaactatcatctaagtttctaaggcgggcggtggcttcctgagctcaccacagcactggcccatgacatacacttgcttggcactgccgagctccagctgctccaccctctctggttgggacccctgagagcccttaggagtctccccacctcctgcctctgccagatgccccattcagggactctggggccagtggcccactgggaactgcacctccccagcctgcatgtgggcttgtatcagttgttacaatatccctgggagcaccaggtaaatcgatctacagcagttgcccaatgggtctagacatctgtgaagcaagagcacagctggccagggctgccccccttacaaatgggctccatcctaggttctgtctgctcaggcctacttgccctgtagtcacttacctcaggtccctacgtgcttctgcctgacacctggccttaggagagggtggagcagaagacccacagtttcacccagggctgctaccctgtacctgggatgctagcatttggctcccaatccacctgaggctcttggctaggaagtgccagtcaggttgcaggggtctcactgcccaaccactgtgacgcacaatgaaggaacaacagcaggagctgacatgtgctgctcaccgtgaggcaaggaccaagatacggctttacaggcctaaggttaagggatacctcctatgaggagagttttcctgggaggtccattctgcctgagaggagatggactcagaaagaccatgtgtctcaagattatccctcctccctctctgaggaagtgggggacctgggcctaacttgcaaggtgtattactttgcgcaccacccctaaccactgcatgacactgtgcctcaaagaaaatctccactgaaggccaggtgcggtggctcacacctgtaatcccaacactgggaggccgaggtgggcgcatcacttgaggtcaggagttcaagaccagcctggccaacatggtgaaaccccatctgtactaaaaatacaaaaattagccgggcgtcatggcatacacctgtaatcccagctactagggaggctgaggcagaattgcttgagcctgggagacagaggttgcagtaagccaagactgcgccactgcactccagcctgggcgacacagcgagactctgtctcaaaaaacaaacaaacaaacaaagaaaatctccactgatgggtgttttcttgtttcgttttgtttttgttttttgagacaagtcttgttcaggctggagtgcaatggtacaatctcggctcactgcaatctctgcctcctgggttcaagcgattctcctgcctcagcctctcgccactacacttggctaatttttgtatttttatagtagagacggggtttcaccatgttggccaggctggtctccaactcctaacctcaggtgatctgcccacctcggcctcccaaattacaggcatgagccaccacgcctggcctgttttgtttttattcttgttttgagacagggtctcactctgttgcccaggctgcagtggagtgatttctgcttactgcaacctctgcttcctgcgtttaaggaattctgctgcctcagcctcctgagtagctgggactacaggcacgcaccaccatgcccagctaatttttgtattttcagcagagatggggtttcaccatgatgaccaagctggtctcaaactcccggactcaagtgatccacctgcctcggcctcccagaatgctaggattgactacaggcatgagccactgcaccaggcctccagtgatgggtgttttaaagggctcctcctggttttcattgagaatcaatacaagaaaacagccacatcaagaaagtatctgcattttctgtaaggcctttgttaaagatactgggacttgttttatttcattttcctcatataaggatccaacccaacctgagaattcagcaccaggctcctagaagctcactatactcattctggctggaaagcaggaagctcagccccaagtgaatgctcactcactgccactttcaagtgagaaactgaggatgacaaatgtgatggtggccccttattatacagatcttgctacagctgtatttatggctggacggtcttgtgagaccctgtggacatagctgctgaggaaccaacccttgtggcaccaggacccaggatatacagtcaagattctgtctccagaagccaatctaagggctatcctcctggcttctcattcagggtatgcactacatgagagataagggccacagaaagccacaaagcaaacatgagtgtcttcctcaataagcaggactgtctgtggcacactgtagtttctctcaggtggggaattcattttatttattttgttcagaacttgctccatttcaaaatctgaggtttcttcaccttctggtaagcctcttaactccctcttgacaactaccccgcagcacatcctcctggggggactcctctctattgccctgtcttcagctccacctcctcacctctgtgccactctggccaattttgtagactgaatgttcttttcagctggttctgatctgctctctgaaatgcttgttgacttttaaactgcaatgattattatttttcttttctaaaagtattttttttggttcatttccaaatctggtttttttttgatagtgtattattcttttaatttttattgagatatatatatcataaacttcgccactttaaagtatagaatcattagcttttagcatattcataaggttaagcaaccatcatcactatctaatgccagaacattttcataattccaaaaacaaactctgtacccattggtactcactccttatcctccctccctcagaccctggcaaccactgttactctactttctttatggattttccattctggacatttcctatcaatggaatcatacaacctatgatcctttgtgactggcttctttctcttagcataatgtctttaaggtttatcgttattgtagcacatgtaagcattccattcctctttattgttgaataatattctattgtatgggtaaaccatattttgtttattcatcacctgatggacttttgggctatttccactttttggttattatgtacagatgtgaacattcatgtatgagttattgcatggatatatgttttcaattctcctgggtatgtatctaggtgtgggaactgctaggtcagatgataactctatattttaccatttgaggaacttccagactgttttccaaaggtgctaaaagactttacattcctaccagcatgtatatgagggttccctttagagctaatttttgtttacagaatagagtattaatctttcctcacattttgttttagctttcatgtccttcaagacttaagcatactttatagtgccatctgacaattctatgatcacaggtttataggaccaacacttattatctgactatctgatcttttaattacagacctccaaatgggtatgaagtatttcattgaagttttgctttgtatttccctgatggctaatgatgttgattgaatttttatgtacctgtgctttgtatatattctctgcagtttctcttcagatcttttgctcatttttaagctgtgttattcgtctttttattgttgaattgtaaaagttatttatataatttaaattctggactttaattagatgggatttgcaaatattttctcccattctgtaggttgtctttcaattctgatagtgctttggaagcaaaaaagcttttaattttttttttttttttttgagatggagttttgctcttttgcccaggctggagtgaagtggcgtgatctctgctcactgcaacctctgtcccccgagtttaagtgattctcttgtctcagcctactgagtagctgggattataggcgcctgccaccatgcctggctcatttttgtatttttagtagagatggggtttcgccatgttggccaggctggtcttgaactcctgacctcaggtgatccacccacctcagcctcccaaagtgctaggattacaggcgtgagccaccgtgcctggccaagcttttaatttttaacatggttttgtaaagatgaggtcttgccatgttgctcaggctggtctgaattactgggccttctgtctcgggcttccaaagtgctaagattataagcatgagccattgtgtccagccaaaagttttaaattttgatgaagtccaatttatcgattccttcctttagttgtttgtgcattaggtgtcatatctaagaaacagttgcctaatccaaggtcacatagatttctatctatattttcttctaagagttttatagtttttgctcttacatttagttctttgttcccttttgagttaatttttgtttatagaatacagtattaatctttcctcattttgttttagcttttgttccaattttgttttagctttcatgtctttcaaaatttgttccaattttgttttagctttcatgtctttcaagacttaagcatattttatagtgccatctgacaattctatgatcacaggtttatagaaacctaagtctcccagtaagtatgtctcctgacatttgtgcatgacaggctctttcttcttgtgactgtggattttatgatcatctaaacagtgctttatcagtggtaatgctgtacaccctggcccaaggaatgtcactgcatggtggatacgcatctctgccaagtgcctctgaacgtcaattagaccaggatttcgtttgtgttcatttctcggcttggcgatttctatacaacacaagtagtattaaactggccctgaatccacatgagggcagacctgtggttacacagtctcaagggaagactgttatcccaacccaaaaacaggctgagacattccaacttctctgctagttcttgtgctgtcagttgggttttcccaggtctgcctcagtccttttttaagcagcttgactttatgctggtgacttaattccaactcctacatggcttagaccccaggccttgtctcaagtcgatgtggtcattaaaactcaaggtcctcagtcaagacccctagccttgcacccatggtgcagttctgctcactgctctggcttttttgttcactcttagattttagactctgggtactgctctttcctgtgaactagttattcattttagggacgagggttgcatttaatccagcatttcaaagtatttagaagcatggagaccgcgcgcggtggctcacgcctgtaatcccagcactttaggaggctgaggcgggtggatcacctgaggtcaggagtttgagaccagcgtggccaacatggtgaaaccccatctctactaaaattaccaaaaattagccaggtgttgtggcaggcgccagtaatcccagctacttgggaggctgaagcaggggaatcaatcaaacctgggaggcggaggttgcagtgagcagagtggctaggacaatagacataagccacaacacctggataatttttctggtagagatacgggtctcactatgttgcccaggctggtctcaaactcctggcctcaagcgatcctcctgtcttggcctcccaaagcatttgggattacaggcatgagctatcgcatgtggcctgcattgagttaattatgaaacaagcatgattagattacagagcagactacaagattccacaccaagtttatagatacagcatcaaacttgcagaaagggtcctcccatgctagcttccaggaactgttttccaaggagaataaatcctgtccagacatgcagttctggacagggcttttcataagcaaagccccagaggtagcatgctgtggctttagctccaaatcaccatctactgcaaggacaggtcacatacaaatgctcctttcattgggcacctgctggctgtgtggctactgcaagtttctgaccagtgtccttgtacttggctgatggtggcacaggctagggtgtgtctgcccagggctgctgagccctataaacctcgcagtggggtgcaactcttaagggacagctcttaagcccccaaagtccagcccacatctgcctctcctctcctaggctctgactcactgggatgtgaacttagctccttgtcaagctaggcttggagggaggggccctctcaggaggcagagaacttcagtgccaatggcagaggctgcagacattcgctctggccacctcaggaggatgcactactgcaaaactccaagaaataaagaactacaacctgcgtgatgtcacagctgtgtttgaggggagacccagagaatggataagcagcatagtgtccacaagagctcagaagccaatctgacttgacaaagacctcacttacatcatttttattgcagctctctacctctggtcagtttctgagtggaaggccgtcacttccatgatgtatcaatatcagagtcttccacctctccaactaatctcatgctctcttccgtgcaaactctgggctccatccaaacaccattattctcagttcagcctctgcactgaccaatccttgtgcctttgaccttgtggttcttttgccgcgtcctcccccatgactccttccagccaccttcccacttcaaggaaccacctctttctcctggtggctcactaagggctctgcagtcttgctcccatgtattgagtggctagagtcttttccccaacaggaaggcaggttgcttggtgggaacactgccactgtgctgttgacccatgcctgcaccctgcctggtccttcagggtcctgcagctaccacctacctttccacagctgtcggagtcatgctggtcagggcaggagcacctggtgtggctttggaccgctctgtgaaccgggagtcaaacgctttcatgggttcgatcttggacggggtcgttaacacagaaggtgacaatgcagcaggagtagaggtagcattcatactggggtgaagaagaggggaggcatgtcaagcgcaatcctgaaaggatctggaggtctagtatttgcattatttggagcctactaaaaaaggcacaaatatcaaacttccataaacacaaaaaatgtcaagatacaatctactactcccatttctttaaaattttcatgtgtcaaaattatggacacctagaaggttgtgagcaaatgcattcacatttccccctttgcactgttctgagagcttttgcgggtagaatgaggcctagaacatggttcttacaacccttttctctagtcacactgccctatctccacaacttaaatacagcacctctaccccaaaccactccagccactcacctttcccactttgacaatgagtctcatgagataagcctgcacctggggtcctgaagccatggtctgcttttacccttagtcaggcatcctccatcctgagcggcccctcccatatctccctgtgacagtgtcacattcttagcattatgctccaagtgctcatcacacaactttcatcttctattccacagagaaaggagaggccaggcagaagcctgcctggtccatccttcatgtccaagcccacaccacacgctttgggaccatggccactggacctcctcctaagcacacccaggctaacaccttccactcctatctgcccagacaccacaccacatgcctggtagtcaccctggacagccccattcttctcctccatgatctgtggccactagaatgggccatccccacagagttctcagatctggcatggtctgtccttcccaggctcccttcgtcctggcatgctttgcttcctcactggtcttgctgctcagtcttctcttcctaccctctcagggtccccccagggcagtgacctaatgtttgggcatgccttcacagccatggtgctagcacccagaagtaggaggctgaagtaacataagactccattccaccaatggagaattgctctgacggtatcagctgtatcccagaagcagggggctgcagtaacacaagactccattccaccaatggagaatcgctctgacggtatcagctgtatgtgccagggagtggcctatttggggcaccaccgcctaacagagtcactttcctaaaatggagatctcaaagccttctacgtctccactctggggaaaagcccagactacctgatccagcacagacaccttggccttctccctcttcttggccttcctcaggggactggggggctgctgcccctaatccccaggcctcatcccctggtaggcctgtatgagtcctgtggagggtaccctctgaggcacctccctgatccctgagataccagcccctctttggatggctagccatttctatccaggggacctgaggggccacctgcaaccctgtggctacctctcccccaccagcctacacactccctgaggatgaggacccacccattaagcccctgcgatgcctggggcctagcagggtgtataacccagagcaggtgctgagcaaacgttcactcctggctttcatttgtgcttgcctggttctttctgatttctaatttggtttccaagtaacaatgggtgaggacacaggctctgtgagtgaatataattctgagagtataaggggagtctgtgccctcccacaggagaaccctgcctaagatgaatgctgtgtgatgtgctcagcagagtgaagtggaagctgaggccccagaaatgtgaagcacctccagtgtagagctgccaggtggggctgaccctgcagcacgtagcatttcactggtagttcccacccttagcagcctgaccctcggtcagccttgatacactctgtgaaatcctcaacagtcctgtgcatcagagactcactgaacaagtcctcccctctgagaagtccccatttcaaatcacgcatttttttctttcttttttgattgaaggggccacaaagtgcaaacagaataaaattctctgtcctcaaaactatgtgcaaacctgaactttccccagggacaggaacaagccttggcacccactaacctgtctttattgacagaatcgcctgcaggtctggcactggcagccaccacaggctctgtgcaaggcttcgaggcgccgaaggagttaggggtactggagtccagtggcagtagctgtggactgctatgagaagagagcatggtgcccgccagggagcccgagagggggatgctgttaaagaatgccgtggagaagtccctgtcatcaagtaagaacaaaagtcagccttgaaagtcaggtgccacatccagtactttatacattcaaataacttttttctaggtccaaaggcagtatgttttcatgatagaaaatctgcaaagttacagaaaagtaaaaagaaaattaaagccacttaatatactatatttaattgaatctaggatttacaggttctatatgtactactaagaaagaaaacaatgctactaattgtcagatgccattgactgtacaacacacccaaatctcagaggtgttaaactgtgcaaacacatgtcttaggaggaatgaaatgcagcaatacagaaagggcctccctttcatgaagggccatggggcatgccactagatgggtgtgccataatatacctaacccagcctctactgagggaccacaagactgtctccagctttttctagaacagatgctgctgcaccaggaagcaaggtattgcagtgtcagaactgaggattctgggacagccaggtctgactcctctgccatttgttagcttgtgacttgctctaactactcttgtgcctccagtcatgtctgcaaaatacaaagtgccaggactctccccatggggttgctgtcaggactaaagcagttggtgtaggacactcttagaacacacattggctgctcaaagaattatgaaattctaataattgtcattacacctaagattcacataatatatgggataaattcttagaagtggaattgtagcagcaaatgaaatgttcactgatgatttggaataaatatttctaaagtgccctcctcagaggtttaaattacaagccatgtatgagagcgcctatttctccacataggtgcttagtaacacttttatcaaatttcttgacacttaacaatctgacagaagaaaaatggtatcttattttgatatgagtgacgttgacattttttctttttcttttttttttttgagacagagtctctcccgccgcccaggctggagtgcagtggcgcgatctcgcctcactgcaagctccgcctcccgggttcacgccattctcctgcctcagcctcccgagtatcccgccaccatgcccggctaattttttgtatttttagtagagacggggtttaaccgtgttagccaggatggtctcgatctcctgacctcgtgatccgcccgccttggcttcccaaagtgctgggattacaggtgtgagccaccgtgcccggccggcagtttttcaaagtagaaatacttgatttccggccaggcgcagtggctcatgcctgtaatcccagcactttggcaggccgaggcgggtggatcacgaggtcaagagttcgagaccagcctggccaacatggtgaaaccccgtctccactaaaaatacaaaaattagccgggcatggtggtaggcgcctgtaatcccagctacttgggaggctgaggcaggagaatctcttgaaccagggaggcagaggctgcagtgagttgagatcacaccactgtactccagcctgggcaacagagtgagacttcgcctcaattaaaaaaaaaaaaaaagaaatacttgatttctttttttttttttttgtgaactgcttgttcatatgctttgtctactgttttgttattggtctttattactgatttgtaaaaatcatttacatattaaaaaaattccttatatggtaggaaatattttacctgggatgttgtgtttcaactatttatggcctttttttttgagacgaagtctcgctgtgtcgccaggctggagtgcagtggcgcaatctcggctcactgcaacctctgcctcctgggttcaagtgactttcctgcctcagccttccaagtagctgggactacaggggcgtgccaccacgcccagctaatttttatattttttagtagagacggggtttcaccatgttggccaggatggtcttgatctcttgaccttgtatccatctgcctcagcctccgaaagtgctgggattacaggtgtgagccaccacgcccagacagcctatcttttaaatgcactaaaattttaaaatttttgtgtactctaaattgtcatttacagaaaacacttttttgacctctgagattataaaaaatattcttccagggaatcttctaaaattttaaacaaaaatattttaaataacaatttaaaaagaaacaaactataagctgtttagaatgtatgtaatgataagttatgaggctgggacccaacattgtttctaggaggtgccatgtagtcctgtcttccatttaccgaattagccaatgttttatcactgatgtgaaatgctacctttaaaattcccataaatattcgggcctgtttcctcatattctatcatattccactgcactatctactcatgtgtcagtatctcactgttttgagttatgacagcttttaagtcttaatttctggtggggctagtcttccctggctaatcttctttttcagaaatatttcggccattcctatttatttttccagataactttattttatttatttatttatttgatacaaagtctcactctgtcacccaggctggagagtggcactatcttggctcactgcaacctcccaggttcaagcaattctcctgcctcagcctccaagtatctgggatacaggtagtagctacagtagctacaggtgggcaccaccactcccagctaatttttatatttttagtagggacggggtttcaccatgttggccaggctggtctcaaactcgtgacctcaggtgatctgcctgcctcggcctcccaaagtgctgagattacagttgtcagccactgtgcccagtcgatttttccacataactttatagttaccttgtctgattcccaaaattcctacggttatttgtactggttaaatttataggctacaagagagctgacatctttatgatgccatcctagctaatcaatggtatgaatttctagttatttctttgagttttctttgaagcctctcagtagggtttttaattttttcttcattaagatatgcatctctggttgcatcctagttattttatttgtgaatatgacttatttctttatgtgctctgagggtagttggtgctacctgacttcatgttgattgtatcctgccatgtgactatcttctttcattgcctatggcagcttttccagttgattctcttataaaccatatcatccttaaataattatcctttccaatttgttctttcctttgactaactacatgggctaggacctatagaacaatgttaaattatagttgcaagagtaggcatttgtttagtttttgaacttaatttgaaataagataatttatcaagttaaggaagcatccacctattcccatttaactgagttttaaaacaacgttgaattttaccaaaacgcctattaagcatcgatgagagatcatataattttttttcttttgatctactgatacgtagaattaaatagttacctaaaatttgaacctccttactttcccaaaacaaacctcacttggtcatggtatattagccttttaacaagcagtaaggttctgtttgttactattttacttaggattttgcactgacattcagaaatgagaatgatcttgaatttattatgttttatccttgtaagattttgatatattatgttcatttcaaaataaaaatttgcacatttcttctccatgcactagaatatttaaaatggtattaacagttacctgagttacctgttccttaaaagttcctgaagtttccctgtgaagccatcttagtccggtggctttggtggggttaactctgtcctctatttcttccacaataatttttcacttttagtaattttattttcttcaaaaaccatccactttctgtgcaaatttatttgcacagagttcagcaaagaagtctctcatctttttgatttgtctattatttctcacttatacctactttgtatatttatgctttttctcttctttcttgattagctaagctaataaggacctatcctgttgctacgtgttagaacgtgggaatcaggagggcaaaaagcttttaataccaaaaggatcaggtcctgatgctagaaatatgcatcctatgtcagaaagttggccccagaccagttaggaagccacctacaccttctcaccaggtaacgcctggaaggatccacagaacaaagtgtcaccatcaccaccaccacctccccatcccacaggcccagtatgttcagagctcaaccacacactgggtctcacttggtctcaataaaaggtaggtaggggcattaccccctacagggtcacaataggaaaaagacttagtcaaaagaaaatgagtgctctgtggggagccagcagacctggttcttgctctactcgtggggacctcagagcctgcacatctaacatgaggagactggatctgtacactgtacgagtgaaggtttctttagacaccaaggaagatttggaatagctcgtggatggacaactgcaaaacgcagaggcctaaagtgtgtggcctccatgaagggcttacaaatgccctgagcagatagacggaatgagaataaaacccagagtgaactgccttgacagtgggggtctatttctttcacacagtgctttatcatttttctttctttttttttttttttttgaatcaacacacatcattttgggaagattaaccaattcaaaaacaatcttcactatatacactgggacaacagcaagtggtgaatgagtctcttcccccttctctgtcccccacagggaaatatgtttgggagccctactctctgcccagtaattccacttctagaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataaaaataactttatgaaagaaaaaaaagaaaaaaaaaatcagcctgactgactgctttccttgtgcgtcctctggtgccctggcaacagtgaagtgcagcagatgtgctggccgccttagcactcccacccctcacatgattcaggtgtgcacaagggctccaggaggagtatgggctttgagactgcgggaagctgagcttcacttccttgcttccatgttctaccagtcaggttgtgaaggacccgtgaagatcctcactgtgaaagtgttaaccgctgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggtgataagaacactaagcataagatccaccctcttagcaaagttttaagtatgcaatatcatattgtgaactgtaggcactatgctgtaggggagatttctaggacttattcatcttctataacttaaactttataccctttggctaataactcccattttcctctgaccccagtattcaccattctattctctgtctctgtgagtttgactattttagattcctcatataagaggtatcaggcaggccaggcacggtggctcacgcctgtaatcccagcactttggggaggccgaggtggacagatcacaaggtcaggagatcgagaccattctggccaacatggtgaaaccccgtctctactaaaaatacaaaaattagctgggcgtggtggtgtgtaactgtaatcccagctactcaggaggctgaggctgaggcaggagaatcgcctgaaccagggagtcggaggttgcagtgagccaagattgcgccactgcactccagcctggtgacagagcgagactccatctcaaaaaaaaaaaaaaaaaaaaagagagatatcatgcggtatttgtccttctgtgtctggcttatcattaatttgtacacactaagtatgtataactttttatatgtcaattgtacttcaacacggtaggtttaaaaataataaggcttctaaggaaatgtattctaaattgccctcctggtacaactaaataagacacccaagcaaagaacaagcagtgggtacatgccacactggccgcctcgcacaacagccatgggaccaatgaaagggctaaaggactgagctctgtacccgtgaaccacacatctgtcactaagctagggattttctttctttcttttttttttttgagacagaatctcactctgtctcccaggctggagtgcagtggcgcagtctcggcacactgcaatatctgcttcccgggtttaagcaattctcctgctcagcctcccatgtagctgggattataggcatgcaccaccatacccggctattttttttttttttaagtagagacaaggtttcaccatgttggccaggctggtcggaactcctgacctcaagtgatccgcctgcctcagcctcccaaagtgctgggattacaggggtgagccactgcgcctggcctgaggtagagattttcaaactgactttcaaaatagaatccttccttccacagaaagcttgtaactaggggttttctctcatactttatatctgaattgcctggaggaggtttgtcagcctacacaggctcctggagatggtttatactccccaggcaataacgttccctacccttttcccgccccatttccaaccccttcccatcaaacatggcttccagatgaagaagggggagcccatagaagtctcctaagggcagagcctgaaatccactgttgttagcatctaggatttttagaaagaccagaaggataaaattcgtaagttcttacaagagatgacctcctctgggctcctggggataaggaggcctttgataaagaggatccaggccccattactgcatcatgcagcagtgggcaaggggccaacaggcccgaggctggctaacccacagatcccgtaccactctaaacaaaccccttccttaccaccactggtgtctgcccctcaccctgtccctgggcatatgtccatgtctttagcgccaccaggcagggctctcaccttcctgatatcttcaagactctccccgttgacaacgcctgcgactgaggtggctgagcccatctccctggtcgcagcactcttctggtccagctgctgctgctgctgccttcgctggtacttgagcatctcagggttctcaatgacggctgtggagagctgggcctcggtcatgatggctaggctcttgccataggtggactggtgaatgcggctctggggaagcaaggagaggcatgacatgccagcatgagtgccagtgtggccagtgctgcccaccagcaggcaaactacagcagggctctcctggctctgagtggagaagggacccaaggccaactccccatcgcctcccatcctattctgcctgtccctcattcgacagctctgttgatgtctcatgcccacccttgatttttatggcctcccttgtatctgtagctgggatgacagtaaatgagacagccaacaagacaacacctgccccacagtctggtggagaacaaatgacaatccacagtgcttcagtggaaaggaagatactcaaggtgctaacttaaggctcttaaatcactcctaggacccaaatgattttgggaatcagatcctagaacaaaagtctactttcacagctcatctgcagccataagccctgtggttggaagtccccattggcctgcttagtgtctctaagagtatgggaaggcctggcacagcagggctggggagcctcctttactcccacccctcctagtatgtcatcatactcccctccttctaggccctcatagtcttgtgccctaacaagctagacaggagcctcatgagagcagagatggtgtccccagcacactgtagtgactgctgtacatgaaagtgcatgaggaacacacttccatgggatgtgcaaatgtccaatgtgggattctgctcaagaacagggactgtggttaacaggacatctgctttacagcagagcatgggttgagaggcagcgttccaagagaggtgccttgggacctgctcctgcagggcttgaatgtggccaggaacctccttttcttgccatcttggctcctgcccttctctcctgagtctatcccctggaatctcgaagcagaattcagtgtttggccagggtttccctagtgttcctccaacatggagtcccagcctgacttgggaaatggtaagcagatgggttattaggctcccagagtgactccaagggagtgcatagtgatcccaggtacctgatgacagtgacaaggttggaggaggacctgaggcctctgagatactcattccttcatggaaaaatgatggggtggcaggccccattctaagtgtagtcattaaggcagacctctcccccaaaggggttcacattttagtggggaggtcacactgtaggttaagaggaagcttccaccagcaaataaggtcatgaggagagctgccagcctgctctgggctttcacagagctcccttcagacacatacacacaacccaccaagtgggggcaggtttctaagcctctggtaggtgaagcagggcttttctcaaagcctggcagaagggcagagagaccccatcaccccagcagagcacagaggggaggcagcctggcccagaggcagcaggccttgttcactcttctgacctaagggtcacatacagtctgggcaaagagccatgctattttctgaggcttagtttccatatccacgaaatggatgagccttgccttgaagggttttgtgcaatttaaatgaaatcatatgtgcaaaacacattcccagagcctggcagacaatgcgttctaagaaatgaccaatattactaccatgaaggtgaaagtgacatgagcaggggcccctgaggagtcacttcagctctttcccagggcaaaaacctcccagtggatggcctattatcagctcaaaaagagatgcctaaaatagttctactcttaactccaggacttatttctgaaatggggactcgttttttaattaatctattttgtaaagaaggattacaagatataaaagatgaataccccattacatgttaagaaatgacttgtctgtgtatctcacaagaagagggtgtagtcaaaggggtctctcagagctattgtggcaatggccacagagcacccagcagcacaagagccgtcagcctaccttctcctcctcgctcaggggatcgccaagctcatcctgggagaagtcgaggaatgccacagagccgtccatagagcataccaagatgcccagcccattcagagtcctgaaagacatggccatcagcagcctggtagcaagagccccaggcagacacatgtgccgcagtagctggcctgtgaggatggtgggcagtgttctagggagatgctggaaactcctggttcccttctgtggcctggttcccttctttggcctgggcgggggggggagggggcgacaattgtatcccaaagggccctggtgttctttagctctaagcaggtgtacaaaatatctcctttaccatatgttctgtaagaattttcaattttacttatcttacttttgaaactattaaaataaaaaaaacttgacaaagtatacatataaatcaggtcactgagaagcagaaagtgtgcttctgactttggttcatgcactgacggagtaaagtggaacatactaggatcacgtcattctcctcgtcttagacaaatcctgaaaaggcattttccagtggcaaattctacacaggcaggacattctcgcagcagcaggtacaccgctgccagttcccaaatcacgtgcaaacagcactcttggtctgcgctactatgacacctggggaggggccactggccacctgaccctagtcacacccagaaggcctcatgttccaatgtgtggcttctcctttcttaacctattcctgtaagtagaatccaccttaccaggaaatatccatgatggatttgtcaaacagttcatggatgaccaccagcggccgtttcagacatgtgagctggaaggaaagacacagtcaaggttaatgaaattactgaaatccccttctgtattcagctcagttaacataaccaacctagaagcctgggtcaaagtggctgctgatatttaaggcatcttcaactctattcaaactgcagctgcagagatcccaaactgtgggaaccaaagcctgccaaaaatgtgcatgctacctagagtggaccctgcctccagggcttgctgtggtctgacaggggaaatagctttatacacagataactagcaacagagaaggcagagtgggagtgggtttctgaagggctatggtcggaggagagggacagccccagggtggacctctgagagggtctatggagcaggagacacgatgccaaagcctagacaggggatgaggcaccctgagagagaacacaacacatcttccctgggcccaagggactctggtacacatttatccaaggctcattctacactatgtgtaggtagtacagaaatacacacctgggcccttaatctgggcctagttaccgactattaatactttgatgaattattatcttctattttgtgcaaatatttattttattcttcaaagtaagaatttattttattcttcatagttgtgtctgttttttcatttaacacacaataagtatgtcattaaatatcctgtaaaagtctcttctggatgactgcatagcatgcactgtgcatattctctatcgagtcactcaattgctggcatacactctgactccacgttcccacaactatggtaggcctttccacttgtgcacaagtgcctggctaccctgctggctggccctgaactgcaggacaatgggcagggaagaaacacacttcctcacgggatggtgggctcccataggtgctgctgcagcttctgggaggctgtggggctgagcgtcccagtgcagcctgagactgctatgtggggaaggagaagctgtgtctaccctagtggtggagagggggctgaagtctgaacgatctggaacccacattaagaatctcgcctccaccttaattccacttctagaaaaagctgccttgtccctcctctcataaatgtgcctacagacccctcagaaatctacaggccgtgtgactgcctaacctgagcattctaagaaatatgggcatcacagtcagtgatgttttggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcacagcacaccagcccctggcagtgagaaacttaacccttcaggagccctcacttagaaaccgccacagttcttacccttgggttctcactcgccaactaccattgagtatatctgctgagaacctgctctgtagagggcactgagttaggaaggtgaggggaacaatgaaactgaagacacatcgggctgggtgtggtggctcacacctgtaatcccagtactttgggaggccaaggcgggcggatcacctgaggtcaggagtttgtgaccagcctggacaacatggtgaaaccccatctttactaaaattacaaaaaaattaaccgggtgtggtggcctgtaatcccagctattcaggaggctgaggcaggagaatctcgctcgaacccaggaggcagaggttgcagtgactcaagaagccaagattgcaccactgcactccagcctgctgggcaatagagggagactctgtctcaaaaaaaaaaaaaaaaaaaaaaaaaagaagctgaagacatcgcctcatctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatacaagaatgttcatatcagctttagtcataatatctcaaaactggaacaatcttaatgtccatcaacaggagactgtataaacaaattgtggtgtattcatacagtggaatgctacaccgaaattataaggaataaaatactgttaagtgcagcaacatacacgaatctcaaaaacactgtgccaagcaaaagaaatgaagacacaaagaagcaagtaccacacaattgcatttatatgaagttcaagagcaggcaaaactcatcagtgtaacagaggccattagagtggttgctttggtggtgagggaggtcttgactggggagggacaaagggacaaaaaggagtgctctaggcagtgatgacactggtgtgtaaacatgtatgacaactcaccaaactgtacctttcaggtgaatacactttatataaagatttttctttttcttttttttttttttttgagacggagtctcgctctgttgcccaggctggagtgcagtggcgcggtctcagctcactgcaagctctgcctcccaggttcacgccattctccgtctcagcctcccgagtagctgggactacaggcgcccaccaccacgcccagctaattttttgtatttttagtagagacggggtttcactgtgttagccaggatggtctcgaactcctgaccttgtgatccgcccacctcggcctcctaaagtgctgggattacaggcgtgagccaccgcgcccagccatataaagatttttctaataggaagcaagcccaacatgctgctcatggcattgaccactgagggtgctgcctgagtctggacacaagagctggtctaggtgggggtcaaggtggcctctcctggctgggcacagacccagtcttcagcacttccttctgggagagcaggagagcctgtgagcttccaaggaggggctgaccccaggtgcagaatagaaatacactcttagcatcacccaaagcaggtctctttcctccacttgctactttaccaacctacacctcccgtcctgcaacaaaagctcaggatagcaggctcacccagacagaaagcgagcggtccttgctgccaacagcacagcagcagtacgggcagctaggcttcgcagaactcccattcttctgcttctttttgaagatttttgggttgaatttctaaagccaaataacagatgttaaaaataattaatcaagcatcaggcatgtcccctgtgcccaagtcccagcccactgaagggagtctcccacagacattctctgagcccaggcactgagcatgcatttcatcttcccgaccacctatgaggcatctggctgatgatggaaaggaagcttagggaggtcagaaagtatgtgcggaggcaccaaatgagtaagctgggaaatgcagatttgaaactagagctaccaaactctccatttctggagcttgccaagtagaagggatgcgtagctactgaaactagccttctcaattccctctggccaggcagggccagccctaggacctgcagaaaagctgagcctgcaagggggcttcagaaacaaagacctactcactccctatctcctaagggaggccaaggggatgggcaggaggggtgtgaatctctgaattccttattgcctcactgcatttgttgttcagtcataaccgtctagcagagatctgctcagtcagagagtcatttgtgatctccctgggccagtgaccatggcaatatcacacaaaggtgcttggttggctgcttagtccagggaactaccccgagagtaacttgtctttgtttctgcaaaggatgaaagcactcactgagctcccagacaccctcctggatttaaaggggtgggcgctctgggaatccccaacctaggacaactgagggcagaagaaggagggttcctgaaagcctggtgtcaggtagcctagagatgttttaattccagagggcaggcaggaatggccggggtgcacagagactggagaagatggaactcagaggcgtgtccctgggcttgctgtctctaacaccaatgaggctgcagggccttaggagctctgtgagccataggcaggcgtcgtgatctcccagagctgctaataaagtggttgtgaggactgcatgggagaatcacgtagagcactaaccatgaagcactgatttccaaagactttagcaacaaagctctggttcaaacaaaaccctacatgaactccaaaacaaaaaaatttaataagtaatattttattcatataaaatttgtgttttaaggtacaatatatgatacttattatctttttttatttttatttttgagacggagtctcgctctgtcgcccaggctggagtacggtggcgcaatctcagctcactgcaacctccgcctcccgggttcaagtgattctcttgcctcggcctcctgagtggctgggattacaggcgcatgacaccatgcccagctaatttttgtattttcagtagagacggggtttcatcatgttggtcaggctggtcttgacctcctgacctcatgatccgcccaccacagcctcccaaagtgctgggattacaggcatgagccaccgtgtccggccgatacttattatctatttaaacacgggcaaaagtgagtctattttcatcagggtcttggatgatccttcacttttatcaaccttagtccaccaatctgtttattttatttggctgcccagtgttgagaaaatcctggttctcacagattattcgcaactacttaacagcttgccttgggctctgtcaggacactatttaattaaagtcatggagaagcataagacgagtggccagacaactctcatgcctaaggactgacagcagttcacgcctctgagctcttcacctgccgcagcaagatctggcagcagctcccaactcagtgatccatggcatggccttgcacctgtggttgatgctgccaggtgtggggacaagcacagtgcttggtgggtataccagaattgtacctgtattcactggagccaggtgagggtggcaccgtgcttgggcaccccaagcatacctgagtgtgtaaaaggctgatgtggagctacgatgttcctaacccaagactgattttggtgatgttcacatgtaaagtttgccaataaatcaaccaagtacatactctattttgtaaaattagcttttaaatatttaagtataactattcaaaataaaccaagaattaatatttgctgaatcttggagcccatctccctttagttccctgggcactcaccacgacagtcacagctttccggtgcccaacaaagtccatgttggtcttccatccctcccgttcgatgatctgggcagtggggcctgagttgttcatggcatgggcagacaccaggtaatgcccatcaggtgaccagctgagccgcaacacatgggtcgttcctccacactgaaagaagcatctgcacttgaaaggagctcaaggccacctttgtgaccaaaactctggcctcgaggataaagttaaacttcaatttataaatgtgtgatggtggagcatgcaccccaagcttctggctacactgacagcttctgtctcaccagatggcccaaccaaaaagggctctgtgaaatgaatttggaaactgcagcatcctacactcccccagaggagctgaacaaagaaatatagtacagaagtgtatgccctgaggagatctgcaggaaggctacctgtttgaaccatagcctctgcatgggccaaatctctctggccactgacccaattcttctgtgtagcacctgttaacccacagcatggcatctgcacagcatcctcaagatatactctggtggagaaaaagccctttttaacccaggagcctggcagaagcctgtgtctgtaatgtagctgatgactgtgaggcaccacctactctcttgagcctgttgcctcacccaaagggtggtgaggatacccgcaagggagaagaggtttgtaacatccttataaactataaaaggaacagtagaaaggcactgctcccccagtctggactgggggctgaggcagagcatccctccacattatccctcctgcaaaaagagatgacatgggtccagagccagctccttgaagctcaaggtgggcccagggcagctctaaagacttaagggttaagatcatgacctcacagctctagagcaggacatgacaaaccagagcctgagtatagtgaaatcacccacctcagctctcagcctaggtgacagaaccaccccctacctggaaggatgggcccacccagtagaggctgaagagtactaccacctcctgctggtactcaagacactcctaaagccgtccctaggagtccacctcatgggaccccactgcctggcagtcagagccctgaggaactccagaaggagcaaaagctccttagggcaagactaagtaaggtaaaaaccagtactcatatacctagcccaggagctggtgttgtgcgggaagaactgaacatatgactatcactttacttttgcagccatcctgaccagtgggcaaatgcgtgctcttcctgcaaaccttccctcatgtgtccctcgctctgtgaagtctttcctgatgcactcacctctcctgggctgtttctgcactctggacaactccattatcatgcaactaatgggaatgcctgtctttcctatggggctttaagcttcaagaggagagactccatctcaatccacttttatttccctgtgcccagttattgccttctatacagtagacacttaataaatgtctaatgaacaatggtgatcttgagctctcattccatttgaaatcagaactcaaataacggaagagagattaaaataccagagaagctactgcagtctgatctccaaacatgtgcaaactgtactgctaactccagccaggaaaaaaggcccctgaactgcagggtgcatatcaacaagcacagcacagtcgaggatggcacaagagtctcctccatcctccccaacaagctgctctgcgggaggctcagagtaaactccgcactataagaagcagttttatccacgtctgtgggagtgagctgggtgacagaatgatgtggagacatctctaaggttcacttcaactttaaacctataaatccgggccaggcgcagtgactcatgcttgtaatcccagcactttgggaagctgaagcgggtagatcacctgaggtcaggagttcgagaccagcctggccaacatggcgaaaccgcatctctgttaaaaatacaaaaattagctaggtgtggtggtgggcacctgtaatcccagctactcaggaggctgaggcaggagaatcgcttgaacccaggaggcggaggttgcagtgagctgagatcgtgccactgcactctagcctgggcaacaagagcgaaactctgtcgccaaaacaaagcaaaaaacaacaaaactataaatcccttttatttcaaagttggaaattaaacagcgtctcagaaatgaaggattctgtattatctgactcttagggccagagtcccaccccagagagccttggtgaatccgctcaggcccccggactctgtgcattccccaggtggcctggcccatggccagctccctctctgtacacagaagtcaggaagaggctggggcagctgcgggggctcagctccctgagctgtccccacttacctcatcaaaaggcttggtgatgctggtctccaactgccagtccagcgtcctccacacctttaggctgcggtcatcagcttgagaagctatgtatttaccaacagggtcccatgtcaaccctttgaccaagccagaatgacctctcagagtagctagaatttctgtgaagaaaaaaggaatgtggagaggtgttgtctgagggaaacatgacctgcaatccatgggccatgggatggatatgcaagagaggggactcagcagtctgccatggccagcccccacaccagacagaagcagaagggcctcctcatttgatctccaccaaggcaaaagccaattgaagaaatgacagcatcaaggaggcaggcaccaaggggctagttctgatccaggtcttatctgtatctagcggccctgcctatggctgcccttcctgggctgtgacaccagcacttctgacgttagcctccctggtagctccctgataaggaggaggcctactagctcaaagggcctgactgtggctgagtcttttataagttatggctgaagacaaaggtgtgtacgacggtaccccatatagatctgtaatccaaatgctactccggtctctaaagcttccctctccatagccagactgagtgtttccacacatgctggtggctttcaaagagttaaaatgacctggatccataaggaaagcatacttcaaatacagagctgaaatatgagaagaattttactagttataaactgcagcactgtgccaggttatgccatctgttgtgactttaaacacaatgaataagaaaaatcaatcttttgcaaaactgggtttgtgttagcccgtatctgctcaagggtttcacagaggagatggtgactgagctgagcccagagcccagtggtgggggtgcacacagcaggtttaggagcatcagggtccccaacaacagctgcccatccattaccctcctgatctgtggcatgccatgctagcactcagttaccatttttcttaagcatgaatctctttttaaagcttaaacaaatgtaactgacaaagaaaaactgacaagacacataaatcctaggccactgtgacacatctgttgccaccaagactaaggagacagcccaacccctgctccagaaactgacaggcagtactgcttgctgttaaccagtcagaggaggccccagacctgggaactttacagcattccagatgacgacagtgttatccacgctgcatgaggctagccaggcatcgtggggagaccatgctacatccatcacatctgaaagaagacagagggttctggtgagatctcttacctggtgatgcccttgtctattagcttggccagtgcccctgggacctgggaccatcataaccactctggtattttttaaccaacctgaaaaaactccccccagaatttttcaattggtcataaatttaaagcatctaaccgaccccagtgcctcactccttttacagacgaagcaactgagggcgtggttcagagcttgggcaccatatggcaccacacccatgcatgagagcctgctacttcgtgggtctgtggcctggagcatgctcctcagccctgctgacttgctttgccaatcataacagggccttcctccgagagccttctgagcatgagacacagtgggtaaagcacatggcagaatgcctggcacagtcagaactccagggctgctgacaactgaacacaagtcatcttgaggccctcgtctggttcatggactgggtctcatctcccagaccctgacaggagtaccccttcactatggagcctccaaacagaattattcacattcacttctttgtgactccattttatcatttgttaagtgcagattaaaaaacaaaatctaggccaggtgcagggactcacgtctgtaatctcagcattttgggaggctgaggtgggcagatcgcttgagcccagaggtacaataccagcctaggcaacatggcaaaaccctatctctacaaaaaattggctgggcttggtagcacatgcctgtatccccagctacacaggaagttgaggtgggaggatcacttgagcccagggaggttaaggctgcagtgaccatgattgcaccactgcactccaggctgggcaacagagtaagaccctgtctcaaaaaacaaacaaaaaaaccaatgaaacaaaaaaccccaaaacctatcctcatagggtcactgtaaggattaaatgtgataaactgctgcaacaccatgccaggcacacaccaaggcatcgatgagggtccgctgtgacgatggtgccaaccttgcctatcctgccatcaggggtgaagggcgcagtcttagttatttctctaacctcagcgcctggtgcagtgctaggtatacagaagaatgattggtgagttgaagaaacaaacatagcagcaaggtaatagctatcaagtcctttctttgtacaagaggtttaagcaaaatattccaaatatctattgtattttttccagttaaaaaaaaactatagtaacagcttaacaggtttttttttttttttcaaattgtctcacatgctgtggttcacattttgtattctaaatgcctatgtgatcttcacagcttctttccttttttgccctgcattctatgtggttgagagtattcactactattaattgacctaatttaacactgaagattaactggattctggttttttgggcccgtgtgtatttgtcactctccatactccagattattactctgagacgcataccctagagtgggaatcctgggcagaatatctgagcatcctcataggtctggattctcataaaactgtagactgcttttccaagatccctgtggttttacatttctacatgcagactgtttgcttcaaaactcccttattagcattgaggatgatgactttttccccttccgacttatttattcaatacaattttatatttaaaatttttaattagattattagtgaaagcgtttgtctcttatctaatgtgtttttggactgatttgctgacttattgtgaccatttactgggaagtgtttcgggcagtgggtctaacaacataaatgcagtgcctacaaaaatgaagaaaacaacaactttctctagtaactgagagtcctggaggggcacacatgcaaacgccaggacagcaggggagtgcccacatcctagaacagagaatatgtggttaggtgggagcccagaaaggagaagggattttcttagcaatctccacagacacatataatgcagctattaactgcaaatttcacctctctacttttttatactgtagtagttttatggagtaaagtctgttattctcctttgtgatttcttctattgccttgttaaccttgaaaaatattctctctgctagaggtctggtaaatattcaattctattttttccttgtgtagttatttagaatgtttctctctttagtatctggtttggtgtgtgctgtatttggtgaggattgaaattaatttctcctcactaactgcttaacagttactatgctccatgtgaggaagaatccattttgataagcgatgcctcctttcacaacacaccaacttcttaggtatactgtagcctctttcagtgttacgagtttaccctcaaacccatgatgtttctatcactggaactttgaatgttttcatccgtaacattcttatccttccagatacgatcctttagaatcactgctgagtaaatccacatacatgacataattttctcctaaactcccagtttggagtttctgtcttcagactatatagcacctcctttttatggtgcatctacacacacaggagaccctcccctcacttgtagatttacatttctggccactgttctcaccatcattcttggtgactccaagaggatgattcttctaacactccaggctcttggttccttaaattcctccttcccttctgatgaccgtggcttccactactttcaccccacggtcatgtccagaggccttccatgacaaatcactgcaatctgtctcaattccaaccttcccacaggccaaccatcagccccgtgctcctagctcaccctcagctccaacagcactttcacgccaccaggaactccgatctactgatgctgccgtcccctcaccacttgccaaccacctggtccttacctctctcctccagctgagagcccaccaccactcccccttttcttctcctccatcttcctacacgcctgacaaagctcagctcctctcctagtgttttttgagtactctccaatgacacctttggcccaatgacaccacatgaatattgcacttgcctaggcccccagcaccctccatgctgtcaagcccagcagtctatccttggtcttcactttgcccctcagcaataagcaatacgctgcctgttcccctctccttcaaatactctcttcactgtccgttttgttgttgttgctgagacagggtctcgctatgatgcccaggctgttgagctactggcctcaagtgatcctcatgcctcgcttcttttcactgtcttaactggcctctccttctagcttctttttctggtttcagctctccaatccctaggctcatccttggactctgctcatacccagaacctcatatttccaagattcatatttccaaatgtctacacagtatgtccatttacactggcaaacttaacatatccaaaaccaaactctgaaaacacttcccttaacaaacatttctgtcccacctgcagacttcctgcttcaggttacagccactgcatcctttccactgtttggaccatagtccgggaagccatcctgactcctctgcttatctcacatcccatattcaatgcaccaggaaatccgcctctgatcacttctcaccacttctgtgttatgactccaaaccaccattgtctctcccttgtttttcggagcggctcctttactagtcttcccagtgcagccctgagacccccatggtagaatccacactgctgccacaggtctcaactcctctgcctagatccctgcggagacttcatattcttgctcagagaagagcctctgccacggtctcaaaggcacactgcctcccgcaccctcctcccccgccccagctcccaggggttcactgggcacagtaagcacatgtccatgctccaaggccttcgcactggctgtcccctcactgccgtccagtcttccctcaaatgtcatctcctcactggcccccagcactcatcttccaactccttacaggactctgccttctaggctcatcttcaaatctcctatactactcactcgtctgtctcttttacaagaacaaatctccttgagagaagaacagtgcctggaacatggcaggcactcaataaatgtttggtatgtggacaagtaaatattaatttgggaaaaaatgtatttcatctagcctttcaatttaggaagccattttctatctctcaatgtcattttgtatcttaaaacgtttgtgatttaagtcttacaaaactaattcatttcttggtaagattacttattcctggatatttataacttttgatcccactctgtataattctctttttatcattagatattctaattggctattagtagcaaaagaccaataatttaaaattgttctgttatgaggccaatataaagactcattttattagttctaagtatttttcagtgctttatttgttccaagagctttatccccctatggtttttcctaatatgaaataatgtcaccttcatttcctttttgccttattttccagtttctatttaactgtgttgcagaaattccagagcaacaaattaaatgacagcacccatcattgtcttttcttgatataaaccgcaaccaggcttaactgtgaactgtaatatttgccactggtttgaaaaagactaaggactctaccatgttaaggaaatagctttaggacaggtgtggtggcttatgcctgtaatcccagcactttggaagatgcaggtgggaggatcgcttgagcccaagagttcaagaccagcctgggcaacatagtgaaaccccatctctacgaaaaaaaaaatcagccaggtatggtgatgtacatctgtagtcctagctactcaggaggctgaggcaagaggatcacctgagcccaggagttcaaggctgcagtgagccgtaattgcaccactgcattttgcctgggtgacatagtgagacacagtctcaaaaaaaaaaaaaaaaagaaaaagaaaaagaaatatcttcctatgggcattttaaaaaaagcatttttaataggaactgatgttgaattgtctaatgttccttttaaaacacctaagatgactgtagcttttcccatctaacttcctagtatgtaaagttatattaatagattcccttgtactacacttacaagtcacatttaatcataataaattactattttctggccggtcatggtgactcatgcctgtaatcccagcacttcgggaggccaggacaggcagatcacgaggtcaggagatcaagaccatcctggctaacacagtgaaaccctgtctctactaaaaatacaaaaaaaaagtggccgggtgtggtggcacgtgcctgtagtcccagctactcaggagtctgaggcaggagaatagctggaacccgggaggtggaggttgcagtgagctgagatcgtaacactgcagtccagcctgggcaacagagcaggactctgtctcaagtaaataaataaataaatgagtaactgctttcaagtgttattatatttactagtattgtttctgatttttctatctttattcatattattctatgcttttgttacattatttttcttaggttttcttgtattttccagatacaataaccctggcttatatcttcctttcaattataaatattgctattgttctgtataatttttcttaaaagctcaaaacaatgcacctacaactaatttagaaccaagaagcatttctgaagacagcctttcatttcttcattggttactattctgttcagtttttcctaatcctatggtatcaattatgaaagttcctattttctagaaaattattttttagtattttgttctttagcttaatagtacaaacattatattgtactgtttgatgatttttttctgtctgggttaaatgtttttctagatctttaaactctaattttgtctaggttttttcttcccaacccccaattaaatataccaagtatatatttctcacactttgcttttcaaagatccggttctttcttattcatttacttctgcttttcattgatttttcttcttgaatggttctgcctgcacctgctaccaggaccagtgagtaatgagtgtcaggtccccagctgaaggtggtcaactctacttgtctggtaaaggagccccactgggcggtgggtaggaaagagaatgcaaggctctggttagggccttgtaaaagtcctcacttgaggcctaccccacacttgggcaccctcatagacatgtgcaccaagttccagaaaagtccaactagacttcactgttagtactgtgacacaagtaagggccaattacacaatttaattatcaaacaataacacaacactaaccgtttcagctttcacaaatgtggactcaatctatggccgccaccaagatgggtttgttctccttttaacagtctacagggaatctgctaagcatacactaacaatggattatagctgatgccacctcccacacctctcactcctgccctgtcctcgcccagagctccaggctcaatttgaaggtttcttgacatttcttcccctacccctcaagccaggggcaactccattctgaactggtatccgtccccataagcctgttgtccttagggtctcagcagaggtgatacctctgactatctaggcatccagccaagaatctatctcatacctctctgtgccctatcctaagtattcccaaatcaatctcctcttctctacctcaattatcacaggcctagctcaggccctgacagtgtccatctaaacgactggaagaacctccacttcactgagctgtcacaatgacctctctgttgtgcttcaaagcttttagtggctccctatctcttccatgacaagggactccctcagtaacagggagcacaagctttccatgatccgactctggcatacctgaccagcctcactttgtgctgctccctgccttgtctataaagatccagccatggtgaaatgcctccaaatccccattcacaccaagactttctcacttatgctgtaccaccctgcctggaaaaccctttggtccattcctggaccaaacggactcagactcctaagtcaagtctaaattgcactcaacctggtatccttgacacctgagtgtacagtgcatgggcaaccttccccctcagtctaaattcataaaatgtgcttctttccatgccaagtttatttaaaacactgcaaacatactcaaggtcaagttgagaaacttttcaatgggcatctgtgagctgatttctggggaataaacaaagtgtgcttacggacttagtgatccgctgatgaaggtactgattctgttcagcaggacaaacagcagaacgtgggaagttctacattaaagatataaacatataccccatgagggcaagagtggggagactgaatgcagctggagacaggtagtggacccggtgactgcacagatcttaagggacaggcagggtgtgactgattgtgatggggtgggacagcccagacatagggctgctttaaggaccaaacagtcccacaggggacgtggcggtgctgctgatctgagccaggtgtcaggggcccacccaccccaacaggcagtcccactcaccgcctgaatgattccggaggatagagacacaccgccactgctccacattggcaagcttaccactggagccgaacacggtgctggggccgatgtacctgtgtgagaaaggggccaaaaaggcactcatggagtgctctgggcactgcatagaaatgctccctgcagccagcttatcagggcacacagaacaaagcaaaaacaaacaagaactggaaagcactgggttgttgaataaaaggggctggttaggtgaattatgatccatgcacttgatgaaatactacacagccattacaaatcttgcatgggaaaacgttcacaataagtgaaagaagcaggccacaggacatcacatacaatatgatatcacttatgtaaaggaaaaaaaaccacatgacatggatagcatctatgcatggaaaatggattagaaggacacacatcccaaaatgtcaaaatattaactgtagctttctttaggtggtgtgatgagggatattttttcttttgtatttttagttttctaaattgtatactaaatgttacttatgttggctatttaaagaagcaaaatcaacagtattttatttttaagcatctcacaatgaatcaaatggctttgacatctgaggcagagaaaccacgcgatctataggtactagcccccaccacaggagccagaggagcatcaatcacctggggcctggtggaggcagtgctgacacaccgatgatcagagcctctgataacaccttttgctcttgtagagctcatcacaaatccacagaaagagtgtgctgagatagccaagtaggctgaagagacagcctctgcctctgctcttgaagccacagccacagggccactcttggtgagcaatggtgcagggtctggtgccccagactgactggcccagagacctgggagcaatagttttccaggtgatggttagctccttttgagagtagagcagaggctgccccaggtggggaccaacagagaataaagtaatggcaaagaggctggactctggatcccctgccccagatcctgggcaagaaccagagcaccctgacttttaaccattttgtatattgggcttccatgtgaaatttcacttgaaaaaacaaaagcaacgaagccccacccacatcggcactagaagagatcagactttccttttcaggtgagagcctgcagtcctgtgagggggcagctgaccaggtctcctgaattcctggtcaggctccacctgctcctgacctacatgcactttccactacttatgaggtcagggctatgggaacttcagtgacagggtagggaaaggtgactttgataaagaccagcaaagcagcttctaaaaataaaatgtgaagaaaggaaaatgatgcttacgtagcccgcttccacaccataatcagtttgtcatctcccccagaagctaaatacatcccactgtttgaccaccgcacacagttcacacatgctgggaagaaaaaaaaataaggtgatgaaaatccagtagtcatgcccatttgctttatgtagagtttggcaagatgtaaagggtttataaaatctaatctatctaatctatttaaggcatctactgtgtgagagccccagaaaaacaattcagtttaagcactaacctacttgtgctataaaaacaaattaccagaacagtctggagggggaaaaatatacattatctgagaatcgttagtgctgaatgacatagtcaatagaaggcttctttctaagaaaatcaaaaaatgataaccaaatctcattatttcaaaagggtcatctattaatgagacacatttctgagtagagattattctcaaaaaaagagtacgtgctaaaaagggtcagatgctttttctagatttttcagatgaacagtctgttacagtataaaactctgacttcatctcatctgtcagagccagccctgtcacattcggattttccaaactcgccagcactgcagattgactgactctgcgcttataagctaagatcagcagaaattcccccaggcccctgatgggccagagcctccaagagcactcacaacttggcctttggaagacctgaaagatggctatcaaagttgtagcccccacatggcccgtgagtaacatgctccaggtctgaagacactgagaggcatgttgagaggacaagaacacacagaggaaaggaaggagctgatgtccaaaggccagtgactgttcattaagcatctcaggggtgggaaactaaggcactacagcaggaaaggaaaccatcacactgtctgatggccaaaagggtcctggcagagagcctcagagtgacacagtaacaacctgagatgttttggcaaattgtctcttgcgcacccttccccagaaccctactgtgtccaggtcgctggccccaaagccccatggaatcaggcagtaacgactcatgagcaggaaatcaccagaggtacctgcagactgtccaaagatggttctgtgggcgggccgagtcttctgctgaataactcacccaggtgtgcagccaacatctgtgccttcagacagcaggccgaggggagttaccgccgcacggggccttatctttctaattacaaacacatgtgctaaccttgggcactctgccaacacgcaaagcctgcaaagggccactctgtaatacctaagtgattgtccatctggcaaagcatcttgggaatattttcatccttctcgtcatcctcctggaggactggagacatattccagatcacaaccttcccagaatcctgccctggaacaaaggagcagaaatggctgaatgtgcaaggagtagaaatttgatattaatatttaatgtcaaattaaattaggagaagtcctcacttagcttccataaacaataattaactagatctaaggagactgaatttaaattactaatttaagttacagaaaagatgataagtactcatggggacgaaacggagcggacttagcagtcagcagaagtcaacctgactttacaaaaagaactttagactagcaatcaggagggaactgagctctgatctggcctctaacacggatccaccaggggtccctaaaaggtcttcatccctgcccagcacctagactccgactccttgactcctcatctgtgaaatgaggagaagggaaagtcaatgtcataagaccttttctgttctgtgtacaccctaaaaagcaaacagaaaagcacaccctagtggggtttccctccccttccaggtgctgcctggaatttaggctgttccagagccgactgttttgagacccaaatgtaccctgaacacaggaaaaatggctcattatcttgttatccaccctttgcagttacctacagacgagagaccaccaaaagaggggatttagggctcccgtggtcatgagttgatgtattgctcggctaaaaaatatacccatgccttttagtaatgatttcttttctttttttttttttgagatggagtctcactctgtctcccaggctggagtgcagtggcacgatctcggctcactgcaacctccgcctcgcaggttccagcgattctcctatctcagcctcccgactagctgggattacaggcgaacaccatgacacctagctaatttttgtatttttagtagagacggggtttcgccatgttggccaggctgattcgaactcctgacctcagatgattcgcctgccttggcctcccaaagtgctgaaatcacaggcgtgagccaccgtgcccagccttagtaatgatttctaagctttccatcactgatatctaacgaagtttagcccctcacttaattttcctattataatagggccaaatccaatgaacatgccaaaattaccataaagcatgtttgaaactgcctcttggccaatatgtaaaagtatttccaaaacatctctgctggaccaaggtggcaaaatgtgtgtcttctgggtacaggtgcgaaccctctgattccttcagctaagtccatgtgttctctctcatgtgctgcacctcctcctctcgggtgcagtccacagcatggaaggagagaaaggcttccctgcccacagcttccctacactcccttccagctccttgattctgggtggaagcatctgctggaaacccaccctgcagcacctggcctgaggacctagagctcacaaaggcactctctaagtgctgcctggggaggcctggttggagggaggccccgctctggggtaaagatgacagagggctgggctctgtggaatgctacattgtgtcactatatatacatcttggtattgtggcatgaagaacagctctgtctttccaaatagaaccatgcaacattgcaaaagatgctggctgaagcataagggcaatactaccaataacagtttcaaatggtgtgggctttcttacttgcccacagtgtgctttctctttaacctaactgaattcctttgacgagaaaatgggcctaataactacacgattgctttagaagcttaaattaccctcattcccttttttcagatgagaaaaatgctgacagagcccttgtctctggggctgggctttgcccactggaccacctaccgctctcgatgctctacaagtttggggatacaaactgattttaatattaactcaataaacagaaattagaatgatacatccgctgccaaaatacttacagagagcacactaaagccataaaaggattttgattttattcattcagataacacattataactgtacattttaaacagcgttgcatccatcctgaaaaatagcaagtattccctctacagctaaatggacagcaggagaagagcaaggtggcagggctgttaagctttccctttctttattccataaacataccttgtcctccagttgcgaacttggtcccgtcagggtgaatatcaactgaaaaaatcggcttgcctggaaacaaagaaaaaaaaatacagtatctaaattggcttttattcattgaagtgtatcaaactcaacagattcagttaaagtctaaactgctagaagattctccaaacatcagacaactgaaagtccaacagtgggagaaagcattccatcactgagaatggctgagcccataggatgcctgggcatttgtctgccatcttgtagggatgtgtgtttgtaatggctatgagctgttcatgattgaagttctgagtctcaggtacttagtgaaaagggcacacagctgtaactccagacatctccctattgcatggatctgcacttgactggcagcctagacagaaggactgctatttgtcttttctggctgacagctgagcaggaccagcgctggctgcaaccaaggagcattgcttcgcttgtcatacttctgcttccaaacagccctcttttgtttgtgctgtgaagttcccataccgtctgccatctcagcatctcctctggctgaacctccttcacagtttgtactctatgttaaattagctgttcaattcctccaggagaaaggactgtggctattagttcttagaagccccaaagagcccagtatgggcctaggcttgcactaggatcccatgaagctagctggctggctgggtgggtggatcagaccggcaaaagcactgtaggagcttgaaacccagcagaccatagaaggcactcacgcctggtgggcatttgtccagctccctgcttctaggacaaaggtttaagagctacaagtggcatgtcagttgctgttgagttcatcacatcttcagcctctagcacagtacccagtgtacagtagcgcagtaatatttgttcattgacaaaggagatacatgacaatgatctgagcatcaacaattgctgatatagatgggctgttgccaagagtctcttaattgaacatgttctgtctctgtcacccaagaggaggcaatgtggacacagtaccagagtcaccagccctagaatcactcagcaagtactgggatcaggagtgtgtgggcaggcagtggctgtctgagaactgtgaagtcctgccagggctcccatgcaagtgtgaaaattaaatgctggtgcccaaaaggcactgcccagcatgggacccaggcagcacccagctgtggagagccgcagccatgtagtcaaatcaagcatgaacttgagataaaatacactttccttcttactggtcactatgtagtataggttgagtatcccttatctgaaacacctgggacccgttttaaccaaagggaaatgacagaagtaatgttgctccagttccaggtgtaggccttaagagtctagcagttcaactttggctctctggagaaacctagttgtcatgtgagaagtccaagtaccctgagaccaccatgttttgaagaggcccaagctggccacatgtagagcatcaaagagcccggacaagtgagaatcaaggtcacagacacaggcctggtgaggtgttctatccccaagctattcgagccatcccagcagattccatagagccaagatgagctgaacctgctaagtcctgacaagctgcagaattatgagcaaataataaaactgttattggtttaagccagcaaatttaggggtttgtcatataagagataaaccaaaatgccaattcatttgcttttctgcttaagccagcttgagctgggcatttgtcattttaacaaaaaatgttctagctgacagctttggtcttgacgggcaatcagggcggaacattcccctccccttggagtgcttttcagttccataagtctgtgagacattgtattacatcagtcccctcaagaagcacaccagaaacccttacctgcaagtcacagttcccctgactacccaagagcacgtacaggctgagccaggctgtgctgagggctcagctgcacaagtaaccaattacagcccatgcgctttagatcatgcccactcacagcatcaactgcatgttttctcactcagtctctgtttgcagatttctactatgtgccaggcattaggctaagcaatgagaaagtaaagatacataatcatacaaactcccctagtaagatgtccactgatggacacttcacaagcagaaagccacctgactcagcctcgggcttcctgcagaaataataactgaattgggtcccaagggttgagtaagagttagccagaagatcgggtgaaggagagggttttcaggctgaggggacgcacggcatggaatcaagaaataggctgatgtaatgttgcagagcagactgcaggtagagagtgtgagaaagaagaggagacagagatggctcagcaagcatcagtaaggagctgagacatttctctaaaggtactttcaaggcagggtaatgccaaggtcagattcacattctggctccacaatagcagtgtggaaaatgggggtgggggcctcaaggctccaggggaaggcagggatggaggctggcaacaagtttgggttttggcattaaacatcatgggctgaatctttagccctgccacttacccagctacaaagccttgagattttattttattttatttttattattttgagaaggcgtgcctggttcattggcaccaggtttcctttcctagtgctatgcagattagatgaaatatggtaggggacctacacagataccagcgcagtgctggctccccgcctccttacagcactaggcctttccatcccaaggaaagcagtcactcacattccattagtgggaatgaaactatttatttatttatttatttatttatttatttatagacagagtttcgctctgtcgcccaggctagagtgcagtggcgtgatctccactcactgcaagctccgtctcccaggttcacgccattctcctgcctcagcctcctgaatagctgggactacaggtgcctgctaccacgcccagctaattttggtatttttagtagaaacagggtttcaccatgttagccaggatggtctcgatctcctgacctcatgatccgaccacctcagcctcccaaagtgctgggattacaggggtaatcccggccaccgtgcccggccaggaatgaacctcttctaaagggctctctgaggtggagctaaggaaagggaccttctggctgagctagttagacaactcttcctgtggcacagcatgatgatgacaaagatgagttcccaactacctccagtgtctggcctttctttgtaatagagacagaaagaaaagacaaattaacacaccctagactctagagacaccaagcaatcacctatccttagatcaaccccagatcagaatgttgtccctgcacacccaatacacagccaatatagtcagccactgtctactgtctggggatttgctgatttgacaagagcagcacaaatgctttccacctggcagggaataaagaatacattaaggaagctgggattatgacagggcatgctcaggtagaatcgtaccctccttcacactaggggaaagattcctagaagaggactaaacatgggaacttaaactctgagcacagagaggtggccagaggcaaagcagagagggcacaatggagagctgctggcccttccctctcagcagtcccacagacctttggtttggctccaaaaagtctctgggcttttatgttctgatagttcattgggtagagctgactggaacacatgtgcatatgtccttttggaatgaagcttgggaaagttgaggcttttgcccagtgaatgttgctcctgggaacacttcctgcactgcccaatagaacttggttttaaccaatgttgacaaatttagaattaaaaataagaaaatgtttgaaacatttattaaatgaaacagttacagaacaatactaaaatataaggtggggccggtcatggtggctcacgccggtaatcccagcactttgggaagccaaggcaggtagatcacttgaggtcaggagtttgagaccagcctgaccaacaggcgcaccattgcactccagcctgggtgacagagtgagactgtctcaagaaacaaaacaaaacaaaaaatatataaggtgggtgcaaacaacacaaacttatttatttatttatttatttattttgagacgaaatctcactctgtcacccaggctggagtgcagtaacgcaatctcagctcactgcaacctctacctcctaagttcaagcgattctcctgcctcagcctcccgagtagctgggactataggtgtgtgccaccatgcctggctaaaaagtgctggaattacaggcttgagccaccccgcccagctacaaacaacataatcttaaatgtagaaaaccctaaaaattccacagaaaaactattagtgctaataatgaattcagcaaagttgcaggatacaaaatcaacaaacaaaagtcatctgcatttctatacaccaacaatgaacaatctgaaagggaaattaagaaaacaattcaatttacaacagaatcaaaatgaataaaatttgtaggaataaacttagcccaggaggcgaaagacttgtacactgaaactataaaatataaaacactgctgaaggaaatcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaagtgatttgtaggcttaatgcaatccctatgaaaatcccaatggtactttctgcagaaataaaaaaaaaaatcgatcccaaaattcacatggaatcttaagggactctgaacagtcaaaagaatcttcaaaaagtacaaagttgaggatctcgcatttccttatttcaaaacttactacaaagctacagtaatcagaacagtgaagtacaggcatagacagacacctagaacaacagaatacagagcccagaaataaactgttgtgtatatgatcaaatgattttgacaaggggccaagaccattcaatggggaaagaacagtctcttttacaaatggtgctgcgaaaactgcacatgcaaaagaatgaagttggatccctatctcataccatatacaattaactcaaaatggatcaaagacctgcatatatatcttagaaggaaacataggggaaaagcttcacaagattggatttggcagtaatttctttttcttttttctttctttcttttctttttttttgagacagcacctcattctgtcgcccaggctggagtgcagtggtatgatcttggcccactgcagcctcaaccttccaggctcaagcaaccctcccacctcagtctcctgagtagttggggactgagggcacaaccacgcctggtgcgcaccaccacgcctggctaatttttgtatttcttgtagagatggggtttcaccatgttgcccagactggtctcaaactcctgagttcaagcgatctgctacctttacgtcccaaagtgctaggattataggcgtgcaccactgcatctgaccatgaatttggcaataatttcttagatatgagactaaaggcacagacaataaaagaaaaataaactgaactttatcaaaattaaaaacttttgtgcatcaaaggaaaatatcaacagaataaaaaggcaacccatagaatgggagaaatatctgcaaattacatatctgataagggattaatgtccagaatatatagagaaatcctgaaactcaacaacgtgactcaaaattgggcaaataacttgaacaggcatttctccaaagaagatatacaaatgaggcacggtgcaatggctcacatctgtaatcccagcactttgggaggctgaggtgggtggatcacctgaggtaaagaattcaagaccagcctggccaacatggtgaaaccccatctcttctaaaactacaaaaattagccaagcgtggtggtgggtgcctgtagtcctatctactctggaggctgaagcaggagaatcacttgaacccagggggcagaggttgcagtgagctgagatcgtgccattgcactccagcctgggcgacagtgtgagactctgtctcaaaaaagaaaagaaaagaaaagaaaagatacacaaataaccaacaagcacatgaaaagatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaatttcttacatattaatttcctttattgtatgtctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaaacaaaaaacaaaaattacccagtagtggtggtgcaagcctgtagtctcagctactcaggaggctgaggtgggaggatctattgagctcgggaggtcgaggctgcagtgagccgtgatcacgccactgcactgcagcctgggcaacaaaaaaaactgtctcaaaaaaaaaaaaaaaaaaaccaaaccaaaacaaaaaacaaacaaacaaacaaaaccccaaaaaacaaaaaagttttgacgaaaggcatttctgtttcttaatacttctttcccccctcattttgcaaaacagaggtattccctaaaaagtatctgcacaggaggattgcttgagcccaggagctcaaggctgcagtgaactatggtcatgccactgtactccattctgagcgacaaagtaagaccttgtctttaaaaaaaaaagttatctgcaagggtacaatgtatattattcaggtgatggttgcactaaaagcccagacttcatcactaagcaatatatccatgtaacaaaactgcacttacatcccttaaatttaacaacaaaaagttatctgcaaaatgtactcctataaatctagtcccttccacctacttccattagaaaattaaaagctacatttccatagtgggaaaaatctgctagctcaacaataaccacaattaagaagacaacaaacctacaatactatttaagtgaaaaatgcacagcaggctgggcgcagtggctcacgcctgtaatcccagcactttgggaggtcgaggcgggtggatcacctgaggtcaggagttcaaaaccagcctggccaacatggtgaaaccccatctctactaaaaatacaaaaaatttattgggtgtggtggcaagtgcctgtaatcccagctaatcggaaggctgaggcaggagaatcgcttgaaccctggaggcagagattgcagtgagccgaggttgcaccattgcactccagcctgggcaacaaaagcgaaactccgtctcaaaaaaaaaaaaaaaaatgcacagcaacattttagctatgccagttatctgtacaatgcaaggtctgtaagggaggctacacaccaaagacattggatttgctatggtgactgatggggatttggttaaagtcttaaaaaaattcagacacttgtataatgtgcatacactaaatgcgtcttctaaaatcacaaaatcacccagttgtttttttccaaatggtttgaaagaccacattaaaagttttaacaatgtgttttcctttgtgcattttctaatttttcctaacttctttcacagtcttactgagctcagtagatagcaactctgcccttagactggaactcatccttctgttctctcttaactcttttgtgtgtgtgtgtgtatgagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgtatttttagtagagacgcatttttgccatgttggccagactggtcttgaactcctaacctcaagtgatctgcctgccttggcctcccaaagtgctgggattacaggtgtgagccaccatgcccggcctgttctatcttatctcataccccatatttgaccctaccttcccaacatacccataacccaaactttcaggagagatgcaaatgttccttaactttatcagggaacaggttacaaagtacattaacttgtcaaaagtcaacacattatacatttaaggtctggacattttatttatacctgaaaagaatgtgtttatatatacacacacacacacacacacacatacacatatatatatatacatatatatattacatatacatataaacacatatatacatgtaatgtattacataaacacacacacacacagagtctcccccaccagctccaaccatttcttgccatcacagccatcaccatcctgatccagaccatctcttgcttggattactaccagtagttggcattataactggtctcctggctcctccctccctctggtcccccacaaccaatctagtctccacgtagcagtcagaaagatctctaaaactcacgtcagatcacagtagtcctctgctccccttgcagtgagaatcaaggccttctagtagcctactaggctctcccaatcagtctgctattcactctctggcctcctctctcacagcccttgccttgctccaaccacaatgacatctgtgctactgctcaaaccctccaggcaagttccagctcttctttctgcctggaatgctcttccctcagatggcaccttcctcatctccatgaggcctgcagcgaatgctgtggtatcatgcccaggtccctaccctccagggactaaagcacactcccatagctatctgtggagtgttggcagccccaacagctccctgtagtcttcctccaggtcagacctgccctcagtggaagcactcttttggcagggtcaggtctcctttccaaaagagcctatatccaggctgtggacacgggagtaaagggccctggtctcccaccccaatccacgacaattctgaagggcctccccagctacagaactcccagcagggctggctgcggctttctctgtgcttacatcatagcttgccttctccctctgtctggtgctgcttccttcactccttcaatggtgtggatcccgagagccctccccaataatcctgcatgcaaaaatctgcagctcagaatctgactcctgcaacaaggcctttgctcaaatgttaccttttcactcaggctttgccaaagcgtcccacttaaacccgtctatcccccgcctctgcctcagcattcctcatctctaagtctgctgtttctccaattcacaggatcttgtttgtgattccgctatgtgtctcaccaggaagctcccctcccacatctcctcttttccacttacacaggaaacccccagcagatcccatcccagtctcactggccaggatgcataacaggctgctcctcaagagcctggcatgctgcttggttcactgctgttttaagagctgaaaacatacacacactgactcacacacatgcatacacacacacacacacacacacacacacacacacacacacacatattttcagctcttaaaacagcagtgaatttatcaactgttttttccatgtgagaccttctgttagaggatgcagcagacctggagtctgctccaacgtaggtctatccctggacctcaaataaggcctgctgtcccttctgtctggtcttcaccacagtggcttttgccagggtagcctcccagggaattggcctaccctaggtttgttaatgcatcgaggcagacaatgcttttaggagcaacaaatgttaatctaaatgggttttctttttgccaggagtgttttaaaaccatttgctatctgtttcatccacttcctttcctaaaatggaaggctctagaagacagaatcatgtaaatgaactccttgggtaaggcttgggcagaatgtttcccctcatcattggaattgccagcagattccactagaaagagccagccaggatgaacaagaagtttatttgcagtacatcaactctaccagccaaggacaacagacactgttagctgcccatccatcagccactttccatcaccaacttccagcactcagcactccttcaacatttactgagtgactactatggtgtgtaccaagtaccattcctggccctgggaaaagggcatgagcaaagacaaagtctgttttccaggagcatatgctcccccagggaggtgtctaatagaactccagttttattcagatatccactctgcccgttatgtaagccagtaggcaacgatgattgatgcaagagagggcacatgacctagttggaccaatcagccaatggggaagacccaaagtccaaggctggggcacagacctctcccttctgcttctcactgaaaacattctcgataccccacaaccagagaactcttgaaaatcaaatgccagaaaaggctcaccaagcacatttcaagagaaacctaccaggttagaagccccaaggcactcagaatggctacagaagcagtcagaggacaagctccagggaccagactcctggtcccatgctgtaccacgtggtttctgaaagctgtccttctgaggaggaaatgggcctgaagctctccaggacggagtggccagcctcagcacaaagaccagtgcttagcaaattagaaagagtaagtctgggcttgggctggagtctaagtgtgactctcaacacatctccatcacatctagtggaatcttggtgccagggggtcacctcatctcactcagcctaagtttccatctgtgaactgtaatgctgcaagtcatagagaatttcgagggtaatcttctatcgtatataacaagtcctgagataggtcagcttcagggtgcattaatttagcaacttaaagagacgtgtccctctgtcttcctctcctgtcatcagtgtcggccctgttccaagctggcttttacacgcagacctagtaaagtccagcagaagagactagcctgtcaagcatctcctcttatttaattccctaggaggtcccagcagacgtcccctcctagtctcaagggccaaaatggcatcacatggctgttcctcaacaaatccttggcatttacccacacatcagcttagggctatcagcaggttggcctgcagaaggcagaccaaaaaaattggggttctgctaacaaggaacaaggcaggcaaccctacaatatttgcaacactccctttgtgctatttgacaatatgcacaatgttcacaatcccactcacttctaggtgttgttgctgactctggcaggatgataaaatgtgctttgcataaatttttggtccccagggctcattccatacctctggttcatgtgctagacacttctgcagtccataggcaaacaccccggatgaacagaacatgctagcaacctctggggaaagggaggggtcaagccagacacagagcatcctcttcctggtcaccgacaggacccaagatcagcacagtggaagcaggtctcctacttggcttcagtggtcaaggccagacgctcctcagaagtccctcccagctgtgtaactatgattctgctcataaagtgaaaatagttttcaaccacttcttagagtaaaacaaatgtttaagaaaatcccatttcctggccttcatccatattctttctgcagcatattaaagaaataaattcagagagaggctgggagcggtggctcacacctgtaataccagcactttgggaggccgaggcgggtggatcacctgaggtcaggagttcgagagcagccaggccaacgtggcgaaaatgtgtattaaaaatacaaaaacactaaataccgaatactaaaaatacaaaaattagccaggcgtggtggcatgtgcctgtaatcccagctactcgggaggctgaggtaggagaatcacttgaacccgggaggtggaggttgcagtgagctgagaccatgccactgcactccagcctggcctgggtaacagagcgagactctgtctcaaaataaataaagaaaatatataagtaaataaatacattcagagtggcccaaatctacagtcacctgcctacatggccaagtcccattaattctacctctaccctgtctttagtgcctctctatttctcacctccatcacctgtgatctccctgtctccctgagcatctcaccaagactagaaattcctaactcctctagggcctgcctaagacacaggttgggtgtttcatccagcttcctcagaagcctcaatgttctcctctctcccctaaccccaagaaggaagttcaagctgctggcaaggctctgcctcccagccccattctccctcttgccctgtttagcctccctcctaacatgttctatgtctttccctaaatgctttcaccctctgggccttttctcctgatggtctcatgtgctgtagcgccttctctgccatcacaattctagtcacgtcaaggttcagtccaaggacacatccacaaacccgactctgctggtgaagtgcccttcctccttgggctatcacgcttattcctctagctcctgtttcccctgccctgcattctagaatacggtttgtatgtcaatctctctcatctatcttccacacagctttctgttcagagagagagccttatttacctctggtccccacagaactcttaccagaaaggttcaatgtttgttgcataaatcagtgaaaaatccacagcaaaatctcacccagttttcttctgactcttcagatgtactctggttattttcctaaatcaacctactgtcttcaggcataagtcaggagagaaattgctgagagaatttgcattttctgagctaccacatggagcaggtgaggcaagaattactgacttcatgaacagattaggaagagatggaaaaactttttatgtcacatatttagtaagcagcagggcacagagactccagagcaggatatctgattccaaaaacagaagacaaaattcttgtcctcaagaaacttacagtctagtcggaactgtaagacaaatacaccaaaaggcaaataacttattcagagcggggtttctcacccttagcactattgatatttggggctagataattctccatgagtgggctgtcctgcatgctatacgatgtttaacagatttgtcccctacccacttgataccagtagcacgtaccctgcccaaccctgttgtgacaaccacaaatgtctctagacattgccctgtagaaccactgatctaaagcaactgccatgtttatctctcaaccactgcaatcatataacctcaccattaggatcctttccctgccaattctcagacataggtctgcagtgccctccggcagcaggctggaccttacccacccactcctaactttatcattatatgattctgcctacattttcccttcaagctgaattatttaattttcatgctgatgtctcagtaggacagcttcaaatccttttcagaatgacacaaggtaggggtaaaaataatccaatcgcaggacaggagaaaatacacaccataaggccatgtgattaccagcaaattaccctgttcttgaaaatttcccaaatcccttttcataacactgccatcaaagtgtgaaccaaaggccaaaggtggacaagagctctttcagtcctggccctcttggttagaactggcttcaccaaagagctgagcataagcgctgtctgcccaggcatgagaattccagaaaaaactcaggagcaaaggcccagagttgggaagagccatgaatctcaacgagattttctaaacatacaaactccatatttctacaaactttaaaaccagaaacctagttgtttttactttctgaccttaacctaacttagaaataaagcttattttggtcaattctaaaataaaatatatagagaatactgtatccaagaacacgaagtaaaatgtgtatgtatgaacaataactgacacatcttctatataaatgatagctattatatttcaatttaacaatcttttatatttggtcccaggataaaatggaagaggtaagtcttattttaccaaggcccagaagtagagttataagtccaagaatttacagctagtaaatgatgcagttttgaacccagtctgattccacattcaaggctcatttcactacaacgtgacaacttcaagattaacttattgataaccttagacaagtgcttctcaattgggggtgattttggctaccaatggacattggcaatgactggagatatttttggttgatacaactagaagttgtatcaacttactctaagaaggtgtttgtgaagtgctactggcatctggtgggtagaggccaaggatactagaaacattctataacatagatgacaatcacacaattttatggcccaaaatgtcaacctgctgaagttgggaaaccctaccttagaggtgtctctattatcagccaagaaaatgaagaccaaagtacacccacatttcaataaatacttcttctcctgttctagctaccctctccactttgaatggattccctgccacaccagagaaaaatgctgagctgtctgctacttccccctttagactctcgaaaaacagaaaaagtatgttcatgctgggtgcagtggctcacgcctgtagtcccagctactcaggatgctgaggcaggaagatcccttgagcccaggtatttgagtctagcctgggcaacactgcaagatcccatttctattaaaaaaaaaagttatgtttgtgcttcacaaaattggagacatgaatatagaacaaggaagccagaaagtgcaatgatggctttacaaaagcaagcacaattttactggccactacccacccctcaggcttccggctgagcagcccctgctcccagcagccaccaatactcctacagtatttaaaggcctgctcggtagtgattcagaccagcatcatctcctccagggcagtggtaatttacctcttgacagtccttctgaacattccatgagattttaaaagaaaggaaatttaacaaagaacaagtttaaaagaagttaaatcccatcctgccagagttgccatatctttttttttttttttttttttttttgagatggagtctcactgtcatcaggctggagtgcagtggcgcgatctcggctcactgcaacctctacctcccgggctcaagcgattctcctgtctcagcctcccgagtagttgggactacaggtgcgtaccaccacgcccagctaatttttgtatttttagtagagacggggtttcaccatgttggccaggatggtctcgatctcttgacctcgtgatccacctgcctcagcctcccaaagtgctgggattacaggcatgtgccaccgtgcccagcctctttttattattacttattatctcagatttctaaagcacttaacagtttggggagcatttttatatctacgctcccaactgagtatcacaagcatactatgaagtggttagagtagatattatcatgctccattctagggctgtagagaggccctcagcaataagggccactgttgtgcttgctctgccaggctgatgcacttggctgctgatctgagtgtagtctcttattcatttgtacctagttcgtcacttaagcatcttgacttacttatgtttacatagcataaaacttttggcctacaaaggagcttatcaaaaaggaacaagttatatgacagtagaagagaggctggagaagggtaggctattcacaaaaactgatttaggtaaagcattttaaaataaaaattctatcagaccttcacacagtaaactagttcataataacatttttcctttcctaatcacaagcatcataattcataattacaatatttgtccagttctccagggaaagatctgcacagtacacatcaggaaatgctcttggagatcaacaggagaaatgaaactaaaactcaaggcttcggctttcatgcacagtaaacctaacttcatcttgataaattatgaaaacctcagctttcttacctgttttagccaatatttatcacatacccatcatgtggaagaggttgttcaatgcagtagggcatacagaagggactgaggcagtccctaccctgggggcatatggaaagtaccctcacaccttccatgccaggcaaaacacacagacagtgatacagcacatctaccggggtaactcaggatgaacagtttcaaaagaaacacgtgaacctagtccctgaaaaatgggaaagatgtcacacaagatggaaggagagagaggtggcaggaggagaacacacacatgatcagttcagtttagttgtggtagtagagagcatcctgggaccaaattcaaaacgaaaaagccacatgttaaaatatctattctcgctcctaaagaaaacggtagcaccctgtagtcgcactgcaaagtagaaatgaggaacaagacagcatcagggtgaccctttgcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatc

SEQ ID NO: 213 - DNA, 2931 bp, Homo sapiens
ggaggctgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagt

SEQ ID NO: 214 - DNA, 2931 bp, Homo sapiens; identical to SEQ ID NO: 213

SEQ ID NO: 215 - DNA, 3251 bp, Homo sapiens
ggaggctgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagcgtcccgggcccacccagaagcgcggcgggagaggggtccgcgtcccggaggggcccacctgccaggatcgccttccccgggtgcgtcagcttggccttcccggacgcgggcgcggcggccgccagagcgcgcggggcgcggggcgcgggcatggcgggcgggaggcggggcgccctgtggcggcttcgggtccgagactccagaactccgcgctcggtccgcggtggcggcggcggccggttatggtcccaggggcggggcggccgcgtcagctccaggtcccgccccgcgtggtccgagccag

SEQ ID NO: 216 - DNA, 3251 bp, Homo sapiens; identical to SEQ ID NO: 215

SEQ ID NO: 217 - DNA, 112253 bp, Homo sapiens
  misc_feature (11154)..(11154): n is a, c, g, or t
  misc_feature (11174)..(11174): n is a, c, g, or t
  misc_feature (11176)..(11178): n is a, c, g, or t
  misc_feature (11180)..(11181): n is a, c, g, or t
  misc_feature (11183)..(11183): n is a, c, g, or t
  misc_feature (11278)..(11278): n is a, c, g, or t
  misc_feature (11282)..(11282): n is a, c, g, or t
  misc_feature (11288)..(11288): n is a, c, g, or t
  misc_feature (11298)..(11298): n is a, c, g, or t
  misc_feature (11325)..(11325): n is a, c, g, or t
  misc_feature (11329)..(11329): n is a, c, g, or t
  misc_feature (12533)..(12533): n is a, c, g, or t
  misc_feature (26940)..(26940): n is a, c, g, or t
  misc_feature (33649)..(33649): n is a, c, g, or t
  misc_feature (33655)..(33655): n is a, c, g, or t
  misc_feature (38411)..(38411): n is a, c, g, or t
  misc_feature (38415)..(38415): n is a, c, g, or t
  misc_feature (38463)..(38463): n is a, c, g, or t
ttgcctggataaaccgactttaatatttatgattgccaagaggctgagagtccttttatgaggtccggtacctccaaacaagacgtgttcatgtagtcttcaaactggcctggagggggcagctccagccagtcggaggcgcccaggaggaaggcctggctccagcaggagggcccacagtccagtctctgttgtcggctaaagctggtcttgcgccgtcagcctctaccctggcctccccaggctctgggatggctcagaggttgccgtcattgggtttcagcaaaaataaatattgtccaggtgtccctgcctcccattgcgtcccctgtgctgctggagtgacatgctccttggagaagttagtaactctgcaggtagggtgggtggtgacaacgcccactacacgcggaagttgtacattggaggctggcgaagttgggagcagaggcatatccataggggaagctggcaggggctgggcccacggcagggcctgcagagggggaagcccacaatgagcagagctcttcctgcccatgggggtcctctcctggctgcccctgagtagcccggggcccagggagcagggtctataggaccagcccttaccacccagacgctgaggccccaagagagcaggcatccagaggcaaggagcgtggggtcagccagagaacctggcctggctagaggataagctagtctccaaatgggacacttacttagtgcaatcagctgggtctcattcatgcccatcaaaatctaaaaaaaccagaatgacattaatggtggaaggacacactcagccggacgctggagacccgccggcgtgctgcacactcacaccacaccctcaggcctgtgtttgccccacagtgtccaagcaccccacagcctctccagtctgctcgacagccaggctgccctgggcaggttctcaggtgcaaagcccctcccagcacacaccagcagcagccttgctgtccaggggccaggcccagcaggacacagcagtagttcacagctaggcaggcacccctatcagaaggcaggcatccttacagcagggaggacagcggccgtgccaacattcctgggcgtacacttctccacacccagtagccactgggatccttccagcccccacccatctattcccatccccatccaaagcccagccaggtaagggcagtgggactttgactccctccctgctccctccccagggggttgggggctacaggtgccacctaccaaacacgagaggggcaggctctgtcacatgctcctcttgcttgcgcagactctccaaggcatccagtttgtccacctgcaaggaggcaaaagcacgtgagcacccgcttgacagagtgcagtccggcctctaggtgaaagtggagtggaaggtcaggacacagggcctccaggagaatgacagtggaggaggtgcacatgggcagatgtggagtggctcagcccacaccccatgcacttttagaatgcagcaaggcatggagaggtgaagcctcggtagctgggctgagatggaacgccaggtggggcccccagagcttcccagtgggcactggggcagtcagttgttacaggctgtgcatgtggcctgcttatggggggccaagtcctcctctggatacagggacactgccacttaccgacctgcagggctggggccatgtgcagggaacactgtctgcttctggctctggccagtctagtttgcccgcccctccaaaccagcagagagatcatgtggctctcagagacaagtcacctggcacctagacacttcacctgagaagcactgaggacaaactgcctcctcactcttccctgaggcttcaccaggcactgaccccacccactgccagagagcgaggcggcagcactgcactagaggggcggcagcaactgtgcagctaggatcccctcacaaacacactgagtaagaaagagaaataagaatgtgccccccatgagctggggtctggggggggctgagaaatgaggaggaagcagggggcacacttgctgacacctagggtgagggctgagctaggcctgtaccctccctacaatgggagagcgctgggggcgtctcagagggatggccctcaagcttcccagatgagccacgaggccccaggcccagctgtccaccaggaaaggactgtgcttcttgtccgcgccctcattctcccagcactgctgtgtggtgtcagctgagcaccagctcaagctgacaatcagctcacacccccatgccactgactgggaaaccccttgccagccccctcctctccttgaactctccccatgacaggcgtctcatctgccccagcaggaataggtgggtggcagcagagaaggtgctccagcagccaccacctcccagggccagtggagtctgggaaccctgggccaaggctgtgcagccacagtgtggaccaacgtgatagtggctgctaactccatcatccgcaacagaaagggaatgtgcgcctcaaagtcctgggggatccccacaagcactttgacccccacagcaatgacactccctagggcctggtgagcctgagttcctctgacactaacccacgggcctctactgccaggaagagattcaagcactttctttccttgtgctggttctcagaacacagactactttcaggaaagacacccgagggatgggaaaacctgctcatcatggtgacagcagcttccacaggcacgcaccagacaccgcacaccacacactgcataccacaaaccacataccacacgtgccgcctgtagggagttgccatccactgtggtgggggaaccagggcccttgtcaatccaaccagtccatgtcccctggcagcccacgaatctcaggccacgtagccagggctgtcccttcctccccaacccttgagagtcatcagggagtctcactcaggcatgctatgcagatgggatggggtcacactgtcctacaggagggcaacggccttgaatggactctgggatggcctttatcaggggctgggcagccccctggaggctctgcaggcggcaggcagccctccaggctaaagctggcagcatgagcccgccttcctgtttccttcctacctcccactcacctgggaggcccctcccttccctcgctccactgagtgatgcttcagcatgagtgccttccgaggctctccatctggcttgaaggaggttagataggcaagtagatgctactggaagtagcttttccagtgttagaaacaacaaactgtaccagatgacactgctgacacaggtctctggacagtggctaaagctagatcccagcagggactcctaggacttcaacacccagggagagttttacaatcaagtactgtcacttcgatgaggcagagagtcatcctccctatagctgttagaaggattcagtggatctgtgaatactcctactatgtgttcagcaaaaggcagctaccaccaaccgtatgctaacagctgcacccccagacgccactgggagctcctcagggagctgggattgccagccacctcactgtcaccttgttgaagtccagggctggggatgagcacgcctgttgtgctcctagcagtgtgcacattgggacagctgcccagccagagtctacaggagggctgctgccagtgggcactccccatgatgattttctggaggggcttaacgttgggcagaaaaccacttcagcatgaaggaaagcagccactcctgaaggcagccagggctggctggggaatctgggttggcctcaaaggggcccacccttaagacctgcggccagagtcactgccagggttgggtcatgccacacaggggccggggagctgcagccggcccggcacctaccttgctcaggtactccctcatcacctggatgaagtagggcatggccaagtccacgaggttgtgcctccaggccagctcaagcaccatgtctgggcgaagcaggtcatagcaggtgaagagacaagctgcgaagcactccctcttgccttcctccaggaaccactgcagcaacttctgggccagctcagcatcccgcgactctgcagcatgctgcatggcatcctgcagccaaggcaaatgcttgcttgggcatcctgcaggcagaggctttgtgcctgcagcagctgggccggagggcagggagtggcactagactccaccaaggacttcctgcgctgtggagcaagcctggacccatggctgggccattccctatgccctgctgcccactggtgaaacggagatgccacctccggaggctctggaggggacaggtggctcacggaggcgcaggtgccctgggagacaggaactctagccccgagggcagagggcgtgcacaggctgctctgaggaaggcactgatgggagtttgggggttgtggggctgctgcagaggtgctgcactcaggtccatggagcgtgtgacaccaggggagcagttaggaggggtacggctactgctctagaaacagcaatgtgtttttctttcaagtggctcaaaaacccctaactgctattttcatccttgcaaatgtatttgtctaagacaatatcattgacaaaataacacctgcacctgaccagtcctgaagaagcctgcactttctgtggccattctctattttctagctccacagcaggcactggatcacctgattccttctatggcaggggctattagtaccccattcagagaccaggaacctgagacccagatgtagtcacttgcccagggccactccacctggagttggccatgatccactgactgtgacctgtgctctccagggataccctgtggcggtcccagctctgcatgcctgccatcgcctgcagcacacacctctgagttccgtttgggagacccctgaggacgcccagtgcccacatctgcatggacccgatgtgctgagctggctccggaaagaagtctcccccgctggcatgctgctcatcgatcgctgcctcctgacccacactgttcctacaaaggcaccaggattctgaccctcaggtgagagctccaggtgcctttgggtctccgctttgaggacctgtgacgcccgctcatctgtctccctgccgtgccctccaccggcccagcctacccttgctgacttgtcttccacatgtgcctaaagtgggccctgctctgttcctcctctgtgggccttggggactgtctcactgccttcccagaggacttccagtagaagcagcccccaggaagctcccagtcagtgtcccgctcctgcggcctggagcccagctcgagtcaggctctcccacaccctcctctctcatcacctccccggcccatgccactctcagggaggcttcatcctggtccccatccctgtgtccagctctccagtctacacctgtacttccgcagcccctgctcttcactggtgggtgtgggagggccccactgaccgaactttcatttaaatgctacttctgtcatctggaaatacagttttctgttgctagctggctttgccctgactggacacgctgtgacctggccactcctccaggaagactccaggaggcttcagctctggcctcagggcaggctcctccagtggcagtgctgaccttgggaggtctggggagccgcctgtgcactggggcttgtgggccccatccctgcctctacggcctatacacagcaccacgccctaagctgtgacaaccaaacattccctggggtcacagtcattcctggctgacagccactgttctgggggaagcgcgctcggccactttctttttttttttttttcttgagacggagtctcgctctgtcacccaggctggagtgcagtggcgtgatctctgctcactgcaagctctgcctcctgggttcacgccattctcctgcctcagcctcctgagtggctgggactacaggctcctgccaccacgcccagctacttttttgtatttttagtagagatggggtttcaccatgttagccaggatggtctcgatctcctgatcctgtgatccgcccgcctcggcctcccaaagtgctgggattacaggcatgagccaacgcgcccggccctgtgctcggccactttctatctgtggctttgtcctctggactctcttctgggcccacgtggctcggagtgggtggctggcaaggccagtaggcctctggcagcactgatggccctgctcactcatcactgcctgagtgttgaggaggctgtgtgtttaagcccctgacagggaccacatgggtaggacagaatggctgtgatcagccagccgagggcagccttccctcaggtgcgtctgagcccagctgtctcctcccagcagccaggtccagagacctccaggtgcggtctcagagcctcagcagcttttcctctccattccctctgcaggggccctgtgggcacctcaggaaggatcacaagcactgtcaccaagggctaggatatgtcacagaacagtccagaacactggaggtgacaacttagggtgaaactcaatgcaacactgatgcaggcatcagaggcctccacggagtctgagccaacagccgcagaccaggagccatgagaatgaggcccctgtgcgggacaggaagtggcaagtatccatgtgtcctgtgaagatactcaggaatgcctaaggccaactccgtaagtaacaccctcaggtcaagtccagagtctttgggcacaaggagcccttgggaattggctcagctgcatcacacagcacccacaagggccctcttgtacaactccacctcacccccgcggggagatgttcaggccaagcagaggatgttaatgccttcagggtcttgggggtccctccaggcagcccaacctgtctagctgatgcccagatcccggtctgagaatgatactaagaaacctctcaccagcagaaaaaacacagtttctttttcctctcaagtgatcctcccacttcagcctctaaagtagctgggactacaggtgcacacaaccgtacccagctttgaaacaaatgttttgaatgtgatttatttatttttttcctttttttttttccgagacagagtctcactctgtcacccgggatggaatggagtggcgtgatctccgctcactgcaacctccgcctcctgggttcaagcgattctcctgcctcagcctcccaagtagctgggattgcaggagtgcaccactacacccggctaacttttgtattttcagtagagatagggtttcaccatattggccaggctggtcttgaactcctgacctcaaatgatctgcccacctcagcctcccaaagtgctgggattacaggtgtgagccaccacgtccagcctttgaatgtgattttaatttaggtttttaaattcctcaaatctttttttttttttggagacagggtctcactctgttgcctagagcagtggtgtgatcatagctcactgcagcctctgactcctgagctcaagtgatcctcccttctcagcctcccgagtggctggtaccacagatgtccatcactacacttggctaattttttgtaaagatggggtcttgccatgtcgcctaggctggtctcaaactcctgggctcaagcactccacccacctcaacctcccaaagtgctgagattacagggaagttcccaaatcttgataggaagtaaagtaggtgccaagaagtgaatcttgccacactgtgttttggtagagtgaaactcacacaaaactgctgcgaaaagaatcaactccgtaaaactctacaagtctttcaatccaaacagtttttaaggggtgctagctcactcccaattcttactctatgttctaaatatggtctcccattaatactaatccccccacccaccacgaggatcccctggtgaagctcagagccaggtctcaggaacaagagggaagggatgtgacccccaaagccatcaggaaacacaccaaggcaggaaggtgggaggaaacgggcccaggccaccaaccttgtagagatgatccttcttgcagagctccacgctctgggcccaccagttattgcccttgtacagataggccgcaatgcacctgaactccatcagctgatgcttctccagctgctgagccaggctgatgttgtcaaagttgtcataggcatcgatagatgcccttaagccctaggaagacagcctttctgtgagggatgggacactgacatgggctgcctacacatggagcaggcaccttgtgttacttgatggctgttgctatcagcacagccttagaaaggcccctgcccatatatccactggtgtcctgtggggcctgcacaccctcctgtgcaaaggcagcctgctttgagaacagaatggcagttgcaggggaggagcccagcccacccaggacagggctccttcctgcacacccacctgatagtcctcctcctctgtcagcaggtggttgagtgcctcattcacactcttgttgttgtggctctggactgaccgcaggtaaggcttcaccaggggcagctgacctgcctgacaagttgagggaaccgtcaaggcacttggccaagcttgttatggggacactaggcaggggcacaggtgggcacgtgcgtgccatccacttgaatggtccagctctggagccaagggcaccttctggacacctagaaccaaaagacctacactcacacaaagaggactgtctgggcgattcagtggatgccaatgtcaccacagacattcacaccttagagagacacatgggtttgggtccagaccaccacaataaagtgaacattgcaataaagtgagtcatattaattcatgtttacactatgttgtagcctaagtgtgtaacagcattatgtctacaaaaacacagtacacaccttaattaaaaatattttagtgctaaagaatgctaacaatcatctgagccttcagtgactcgtaatctttttgctggggagggtcttgcctcaatgttgatggctgctgattcatacaagtggtggctgttgaaggctggagaggctgtggcaatttctttttcttttttttttttttttgagatggagtcttgctcgtcgcccacactggagtgcagtgccgtgatctcggctcactgcatcctctgcctcccaggttcaagcaatcaattctcctgcctcagcctcctgaatagctgggaccaggcgcttgccaccacgcctggctaatttttgtatttttagtagagacagggtttcaccatattggtcaggctaagtctcgaactcctgaactcaggtgatctgcccacctctgcctgccaaagtgctaggattacaggcatgagccactgcgcccagccggcaatttctttccttcttttttttggggcgggagacggagtgcagtggcgcgatcttggctcactgcaatctctgcctcctgggttcaagcgattctcctgcctcagcctcctgagtatctgggattacaggtgcgcgcccaccacacctggctaatttttgtatttttagtagagacagagtttcaccacgttggtcaggctggtctcgacctcctgacctcatgatccacacgccttggcctcccaaagtgctgggattacaggcgtgagccaccgcgctcggctggcaatttcttaaaataagacatcaatgaggtttgcctcactgactgactcttccctttatgtaagaccactctggacttgtgttgcataaaacaaaataaactaaacaaacaaaaagactctgtgcagcatgcaatgctctttgatagcactgtactcacagtagaacatttttcaaaattggtctcagtcctctccaaccttgctgccactttatcaaccaggtttatgcactattctaaatcccctgtagtcatttcaacaatgttcacagcatctgccccagcagtagattctatcttaagaaaccactttctttgctcatccctaagaagcagctcctcatctgttcaagttggatcctaagattgcagcaattcagccccttcttcaggctccacttctaattctagttctcctgctgtttcccccacatctgcagtgactttctccactgaagtcctgaacccccaaagttatccatgagggttggaatccacttcttccaaattcctgttaatatatggatattttccttatatactggtgtctttacttgtttccaacttcttattgatacatgatagttgtgcatattaattgggcatatgtaatattttgatacatatacacatgtgggatgatcaaatcagggtaattacgatatccgtcacctcaagcatttatcatttctttgtgttgggaacatttcaaatcttctcctttagctattttgaaatgcacaataatttattgttttttttgagatggagtctctctgttgcccaggctggagtgctgtggtgcaatctcggctcactgcaacctcccgggttcaagcgattctcctgcctcagcctcccaagtagctgggactacaggtgcctgtcaccacgtctggctaatttttgtatttttagtagagacggggtttcaccatgttggccaggctagtctcgaactcctgacctcgggtgatccgcctgccttggtcatccacccaccttggcctcccaaagtgttgggattacaggcataagccaccattcccggccattaattagcctaattccaatgctgttgtgtctcagggaatagggaggcccaaggaaaggaagagggaccagggcacggccagtcagcggagcagtcagaacacatacaacatttatccattaagtttcccttcttataggggcatggtttgtggcatcccaaaacaattacaatagtaacatcaaagattgctggttgtgtgcactggctcaagcctataatcccagcactggaggaggccaaggcgggaagattgcttgaggccaggagttcaaggttgcagtgaggtatgaccatgccactgcactcccacctgggcaacagagcaagactgtctcaaaaaaaaaaaaaaaaaaaaaaagatcactgntcacagatcaccataccatntnnngnncnaaaatttgaaatattgtgagaaatcctaaaatgtgccacagggacatgaggtgggcacatgctgttggaaaaatggtgctaatcgactttctcantgcngggttncaaacctccnatctttttttttttttttcttttgagncagngtctcacactgtcacccaggctggagtgcagtggcacgatcttggctcactgctagctgtgcctcccgggttcacgccattctcctgcctcagcctcccaagcagctgggactacaggtgcccaccaccacgcccagctaatttttgtatttttagtagagacggggtttcaccgtggtagccagggtggtctcgatctcctgacctcgtgatccgcccgcctcggcctcccaaagtgctgggattacaggcgtgagccaccgcacccggccacaaacggctaatctttaaaaaaacacagaatttgagaagcacaataaaatgaagcatgatacgggaggtattcctgtatctgaaacctaaaacactttgatacactggtgaatcttcaagtcagctgggggtcatttcaaaaactctttataaaggtgctatcattcagatgactttgttagagctagcccaatacactcttctacctggggttttggttgactcacctttgaaaagaaactgactgtccaggtgtggtccagccggggtgaaagcaccagcagcaggtcattgatgagcagtggtttgtaatccaaatagaactgcagggctctgtaacagagctcgacgttggcaacctgtggtgagcaaagctgagggtcagtccctgccgctgtctccagataccccagggctccttccagtttttgctcaaatgacactttactactgaggcctgccatgactaccccctataagactcaatggcctgtgaaggtgcctcctctcatccctgaggtattttgtcccccagcactgacacactgagcatttttcttaagaggccagcctcagggtttcctgcctcaacccagcacctagaccagtatctgatgcagggtccacgatcactcagtatcggctgaatgaatgaagtgtaatcagtcagaatgaagccccacagcaaaaccaaacaacagagtatgtttccatccaagcaagattactccagctttccttggaggcctcagcctgagccataaccaagtggacagcatgtcctgtgacatcaccagagcttttgagctgaaacactgtggtgctcagaccctgggtgagacctgaaggccagcccatgcagagagtggaccactctgggtggaccctgtgcctgtgctcctgggtctcgagatttggccaggctgctgtntctcttagcactttccccactggtctgccaccattctcttgctgggcgatgtcatcttttttttttttttttttttgagacggagtctcactctgtcgcccaggctggagtgcagtggtgcgatctctgctcactgcaagctctgcctcctgggttcatgccattctcctgcctcagcctcctgagtagctgggactacaggcagctgccaccatgcccggctaattttttgtatttttagtagagccggggtttcaccgtgttagccaggatggtctcgatctcctgacctcgtgatctccccacctcagcctcccaaagtgctgggattacaggcgtgagccaccgcgcccagccctggcgatgtcatttggtggcttgctgactgtggcatcgatgtccagggcctggacacagctctgttcagggagcatgcaagccagatgggcatgaaccaagacagtggtgatgaatgtgtctgcgtgagtgtgggggtcccgggatgtgcacagggcacagctggagctaaagtcatgctgggatcccagggtgatcaccactggagcctccagcactgctgggtttgggtgacctggcaaaaatgtggggcccgatggggtcttctgactaaaaggggtctaatggtcccactatggcttactggccacttcagggtgtcttctttctccttctcttttccttttgtgctagagcactcactgtcaccagagattctgacccagacaggcagcagggtccctagtacccgccaccatggattcagagcaaaacggtgaactggccgcatcacaaagcttcacctatggcactggtgggcccccagactctgccacaggccactgtgggtccactcctattggagctctagcacctgtcagccttctaggctggccctttactcagcagcagggccaggacatgggggcctcaactagacactgaagaagcagagagcagtcaggatgtgatgtggggctgaagagaagggtagggactcaagttcatcttctgtggcgaatcacctcctcaaagccccacctgcttccccaccaaccacaaggctcctcaggcctcccgtgaaggagaggaaccatccaaggacaagcccatttcagagactcttgcaggtatcacgcgagtggacagacttgaagtggggcaccagcagtcctagcttcccttgtgggacacctggtaccatgtgcactcttggccctttcaacaggtccatgcagcatggccggaatgccgtttaaggtggagtataactgccatgttcccacccagttcctctggtgttgaggcctgcagggacacacatctctgttgggctcagctgctgggatctggagccctctgcactacaggaggaatggagcggcggggcccctctggagcgtcctccagatccaagctgaaagacaggatggggtgagtccactagccacgcgccaggacatggagcactggcaggcccgtgcccactagcatggtcagcaaggacagccagcaccccagaagacatggtagtatccctgttttatacaagggaaaactgaaggctgggcgtggtggctcacgcctgtaatcccagcactttgggaggccaaggcaggcggattgtgtctgtaatttattccttccggtgggttcttggtctcactgacttcaagaatgaagccacagaccctcatggtgagtgttacagctcttaaagatgttgtgtccagagtttgttccttcagatgttgagaggtgtgagtttcttccttctggtgggttcgtgatctggctgacttcacaaatgaagctccagaccttcgcagtgagtgttacagcttttaaacctagtgcagactcaatgagtgagcagcagcaagactgattgtgaaaagcaaaagaacaaagctcccacaacatggaaaaagacccgaacaggttgcactgctggctcgcatggccagcttttattcccttatttggccccacccacatcctgctgattggcccattttacagagcgctaattggtccattctacagagtgctgattggcccattttacagagtgctgattggtacgttttttacagagtgctgattggtgcatttacaatcctttagctagatgcagagtgctgattggtgtacttacaatcctttagctggacacaaaatttctccaagtccccacccgacccaagaagtccaggtggcgtcacctctcaagatcacctgaggtcaggagtttgagaacagcctgcccaacatggtaaaaccctgtatctattaaaaatacaaaaatgagccgggcgtggtggcaggcacctgtaatcccagctactctggaggctgaggcaggagaatcgctcgaggctgggaggcggaggttgcagtgagccaagatcgcgccactgcactccagcctgagtgacagagtgagactccgtttcaagaaaaataataataaaacaaaaaaagaagagaaaactgaagctgagattccgccacaagctccaggatagctggttggcgtgctgtgctgcacaacctgaaagaagcgcccaccggatgccaggcacctgccatggaccacttggtcgggaggaaacatgatgtccattgtatggatgggataacgaggttcacagcggtgacacccctagcccacatggagagagacagtgaatggctgagctggggtgccccccgtgtgagttagcaagctcccctgctcaggctgctgctggcccagccctatggctaagtggattcctgctatcgtgtgccccaaatacagattggatgtcgtccatctgattggacccctgcactggcgagtatcctcctacccccttcacacctgagctgacagtgtctgtctcccacacggcagggtgtagtagaagcatcatgaatcacacaaggaactggactcagccatcagccctgcaggcaccagatgagagatgctgctctcccacacagtgagtctcagctgtcctgctattattttatatgccagtaagaaacaaaagcatggccacttccaccacggctcagcaatttttaaaaacaccctaatatcagaggagttacaatgtgaataaaatacacacaggattgatcaagtatggattttccagcacacagacaaatctacaaggcagcagccacgtgtgccaggccacagtaaggtatgacctggccgcactccctccagcaacctgcagactctgctcagggtgggacgccccatcaaaggcccccactttcacgtaccaccatgcccagtaacatggatgtcctccaacaagaagctcgggcttgtggcctggtgctcaatactgggttccttcaaatagttcccaggaaaggcagaggctgaaggctcacctggcagcacacgtgccactcgcgcccaccctcagtagccgcatgtggaaaagaggtgcatgagcgaggccacagctcactgctgtgccactccagtcacaagccgactgtgacaagttagttacccaaagaccatggcacaaagcgcagatacccaatgcaaagggatgggggctgaggataaagaattccagccccttcaccaaactcacatacagagctggagaggggtgggtcctgaggttgaactctctaagagaccggaaacaaaataacaaaggctcacttgaccatggcacccaaacccgacaccacccaacagtgtggctgctgacagagaaactcgggtcccggtttagcccagttaggctacaggatggaggcccactcccagacaggtaaggccgctggtgctggggagagacatgaactaaaaaaaaaaaaggtccgatggtgaacaataaccacaggaagtgggggtgggagccctgagctgacagggcagaaggaagaacgaactgaggcctggccacaagggcgtggtatggtgggaggggcgggcaggcagggccacagggccacggctgcatgctggcctgaccctgcccgcagctcagctgtgcatcgctagacgggtcacctgcccttcttaagtgtcagttcccttcaaagatggaattactaccatctgcccagagggtggtggactcatacaagtgaacgcacacacagcatgggggcatgctggtactcattccactcccacctgcccattcccctgcacccagaatagggcctggcagaggctggcaggagccagcgctctgtatcccctcttaccttggtaatgatgtccttgaactgaccctccttccaggcctcagtggggtggctcatcatggtgagcacagcattgtcatactcctcgtacttgtcatagaggaacaccagctcagcccacaggtgtgcctgctctgcagccctcagcacctggacaaggaggtcagggtcggcttgtgctgcacgtggccacggctgccagactgcaaggagtacacggtacctttgggatgttgacacgggaccagaaaagctccagatgctccagcatcttctgtggcttgaatttggagtagaggatggccagctcagtgaacatgcccatgtgggcccgctccaggcccagggccgcttccaacagcaagatcagctcctcaaagtagccacgatcctagcagaccaacagccacgcgtggggcagagtgattgcatgcctcctgcagccaccctccagcccatgcccacgccgcagggactgtgcttgtgactgggaatgatcccgaggaggcatgtgtgaagaaaacgtgtatacatactgtgctacagatcatgccatttacttagcaacttattggatcatctgacaattaccagtggcacactgcactacaattttcaagtttagtaagtgcaaattagtattgccaattttatttaaagaattagaaaaaaaaataggaagtgggtggtaacagggtctgggaatgatttgttttaatcccttgctacagctcattactgagatcctggctccaacaaaccttcaactccactcacgatgccacgtggctgttgtttcactgtgtccctaattatgatggccagccccttgcattcagccccacacgcctctgacactctccctggacaagaccagacgtctggttacagcctgctcagcatgcagaaagcctggagaaacacccagccatgtgaccctttccctttactctaacgaccacagccctgggagggtccgacctagaggactgcctcacacctcttgttttcccaaggaggacacccttctgtgccccctccactctcagactaacctcatttcccagtggcacacttgtctgctggcagcatctgcaccccccaatcagctacagacacgccgcctgtgctcctgtctggaacctgcccagcctgcagctccatcccacctgcttgcctaccaaggccacagctccggtgactcctcatttctcttctgccttattttcactctccacagctgggttcagcaagcatcccgctcatcctcctatcctaaacaccctcttgacccgatgtccctgctagctacctcccattttttctacttccttttgcagcaaaaactcctcacaacaaccattcccattcctctccctgttctctccagccaccatcaggctgagtctctcccaagctccaggtcacaagcagccccctggccctgccatcctgctgtctgctcagcagcaggccctgtccctgctgaccggcccctcctctccagtgcatccaggagccagcacactctctgggttttcttcccactgtactggctgctcctgctcccctcctcagcccacccctgttgggcagtctggtcttttcacctacactcatccccaggggactgcaggcaaacatagatggatgtggatcacctatatgtcagcaactccaggttcactgctctagctaggcccctcctctgtggagctccagatctgtctccagctgcctacatgatgcccccacctgaacatccagcgggcagctcaagacttagcaccatgtgtccaaaaagtaattcttgtccttccctcccgtgctgcaccttcagtcttcccctcatccactggtgataactccgttatttctacttattcaagccaaaaccaaatggagttatcctgggcttttctctctcactccacatcagtgcattagcatatcaaggtggctgctcattcaaagcacacacccaatcctgatggcctgatcacctctcaccctgtcaccaccaccctagtcagagtcactgtcccttctcgcctagaccactgcaacagcctccagctgctcttctggctcctgtccctactcctcaagtatgtgtctcagcacatgagccaccatgatccttttacccccgacagccctgcacccatcccaagtacagcccgtgaccttcctaacggcctgagatctggccctccgtcagcctctctgccccatctctggctccagccccttccttgaatacacagcacacttctgcctcaggactttgcctggccactgacccttccctcaaatgttcccatgaccaaatccttccatttcttcaggtctttgctcaaatgtcaccccctcaattgctgctaccttgaccgcccctttatgaaactccatccaggcactcctatgccctcaaaccggctccattttcctctataactgatcaccttcaaacacactatataattattcattaggtttgttgcttgcctgccaaccttgctgaatgccagttcaattaaatagaggcttttctgttttgttcactgacacaattattgagaataatgcctagcacacagtaagtactcaaagatttgctgactaaattgttcttttgtcagccctgtactgcttgatcaccctccctgttggctttccagttcatttctcaggcgcctctctgggggtgggaaagcatttctcattgaaaagccatcacacccagctaatatctggacactctggcgctggtgcgagcccctccagacaacgtctcacatagtgaggggtttggggctcaatttccatggccatggtgacactgctgagcagagtcagatcccatcttcgtctgccttgactaaccatacctggagttgtcatgtggctctaggaatcccacaggtggaagcccaggtccctaaacacacaaatcactgtctaccaaccactcaagagagcctacctacagcatgaacatacagggccccacccttccaaagggtccaggtggggttccctctcttgcctgtgctttgtccctaaggcacttgaaaaacagactactggggctgcacactgtggggaactaggctatggactagagctctgccaccaccagcccagtattctcagcaaccctccaagggttgttcccgtcatgcaagccactgactgggcttctgaaggcccaataacacaagaggatggagagaacttaaaaaacacaaaattccagccagccatgaggtcgaggatagctaacaaggcaattgaatttagttcataaatgactgtctaacacatgaatcttcccctcagggccatgcttcatatttgcagatgcaacactgtgatggtcacgagctaaggggatgaccgtgcctctctgtggagtgtttaggcatcacttgtcatctgcattaccagcagagatcatctggtcacctggtaatagcacatcagctcctccagctcatctgcatgaatgacgatgtgaagaccacacagctgtgcgaagcggaactcttgtccatccatgcaggcaaagcacacctaggggacggagggcaagcgtgagggtccccaagacaggacacagcaccacagcagctgacttacaaggcacacagttgcaaatgcagaaataccagcagtggggtattttaagttggattctgaacaagtagctaactctatgatgaattgtacaagactgggagaaaaaatatgacatttgtaatctgcaggccaagggggtgcttgagaccatggaaagaataaagtttgtgcattacttcgtaggccctgagttttgttcaggtggcgggaaagtcatgctggaatttcaggtttggggtttgaaaaggaaggctaaaaaataatgaccatcagaatgcatctcatctgagtgttgttttcacgggggagcttgttttaatagttttttagactacttttgttttctgcactgtacagtatgtatacttaatgataacaagccttgagaagtgcagaattcccctgtacaaaaataatcacataagccagtgtcattaacttgagatataatctttggcccactgtttcctatgtgtgatgcatacaccagcaccctgacaaatttcccacataaacacagtggaattacatcatacattctgcatgatgatatattcctcgcataatattggcaacatcttttcctgcaactctgcctattcatcttaaacagcagggtagagttgtaatgcatacattaacaaaggccttggccgggcgcagtggctcatgcctgtaatcccagcactttgggaggctgaggtgggtggatcatgaggtcaggagatagagaccatcctggctaacatggtgaaaccccgactctactaaaaaatacaaaaaaattagccgggcgtggtggcgggcgcctgtagtcccagctactgggggagctgaggcaggagaatggtgtgaacccgggaggcagagcttgcagtgagccgagatcgtgtcactgtactccagcctgggcgacagagctagactccatctcaaaaacaaaaacaaaacaaacaaacaaacaaaaggccttgacattagacctttaggctaattttaatctttcattaaacaatgctgttttggatatttcttcagttttttctacttgaagatggattctgatattatcagagagcctccagacaatttaccaatttgccacaaaggaccaataatgtaaatttacactgattatgcaaataaggtgacatgatttaaaagtgttatgaaaatacttataatactggtaattccatgctattaaggctacctctgggggccaactggttccacatcagattctctggggcctctgttccaactacaaacactagcctagagactctaagaatcccaagggttcagacccctgcctgggcaagagaccggcacccagaagagtaccgagcagaacgcaaaggacacggagagcgtgcctgtccagcacactctgccgtctgcagttgcccgcagctcacctccttccacgtccgggtgctgctggccttgcggctgttgtccactgctgcctgatactcaccgaggtgaaccaaggtggaagccaggcgggcaaagttagaaacattgctatagagcagcttggcagcctcgtacattccctcctcgtaacagcggtctccaactacggataatagggtagctcgactgagacactcttcaatgggaagatttctccagagttgcttttaagttcctagatggcagaggtatttttctgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtccagtgactggactgaattcctgcagccctgtccatgcccaacttgcacttgccccagctggtggccccagatcatgctggacagctcctggcattcactcttgactctcctgattgttctcagtcctgctcagagctagttctctgcccattccatacctgtggctgcagagctaaacacagacagcagaaccccaaagtgctgatgggtctctctaaattcatgaaggctaacatcaaatgcactggcaacactacccatcctacttccgccatccacagcacctcccgcaccaaccctccttccgccatccacggcacctcccgcaccacccctccttccgccatccacggcacctcccgcaccacccctcctttgccatccacggtacctcccgcaccacccctccttccgccatcacggcacctcccccaccacccctccttctgtcatccatggcacctcccctccttccatcatccatggcacctcccctccttccgtcatccatggcatctactgcactaccctacttccgtcatccatggcacctcttgtaccacccctacacgcctgtcatccatagcacctctactgccacccctccttccatcacccatggcatctctcatgttaactctttcatatctccttctcttctcaaagctctaacgattcctcaagctgagtatttggcttcccttttcctgagaaaacaaactatcaggagagcctttcacagcacagtgtccgtggaatgtccttcctatgccaccaaggcctgctccatggatgtccctgaccccctctccacatgctccatgtcagggtttcagcaaatccctgcatcagcatccatcaccttctgcactcatccactctgacaagcttaaagaaccactgttcttttctctagtttaaaacaaaacaaaactggccaggcacagtggctcacacctgtaatcctagcattttgagaggctgaggcaggtggatcacctgaggtcaggagtttgagaccagcctggccaatatggtgaaaccctgtctctactacaaatagaaaaattagctgagcgtggtggcgggcgcctgtaatcccagctactcaggaggctgaggcaggagaatggcttgaacctgggaggcagaggttgcagtgagctgagatcgcaccactgcactctagcttgggagacaagagtgaaactccatctcaaaaataaataaaataaaactaatccaacttgctctgccctcaacttacctgggggctgtcagcctgtttccatgcttcccatcagagcacagttctcagggagtatctgtgtgtctgtaacagttgtcccctgtcttcctattctctctgcaatccactccaatcaggcttctgccagcctctctgccagggtcactgctcctccagacagacgcagacatggttttctggacacccctgcctgcttttctcccaccccgctggccagtctccatctccccctctccctgctgtggggctttggggtgctctggcttctttggtccatccccccccagccccacacccccactgccatgctctcccacacaggtggcggctgtgggtgctgcctgtccctggaggctgcccatgcacatctctagtctgggcttctcctctaaaacctaactcctacttccagctggacagatccacatggcatctactagaggtccgacttgtccgaatattagtcctgatgcccccaggcagtcctcacacactgtccccacactggtaagcatgactgcccacacccccaagcttgacccgccctcactgcttctctcctcacaccccacttggcagcacgccctgccggctctgccttcaacacacatccagaagctgactatgctttgcacttgccttgcccactttatctgctgtcgctgccccttgcgacatcactgcaccatcctcctctatgcactccctgctccacccttgtccttcactctgtttgtagcatagcagccagaggggttccgctgacccctagaccagatcattttcctcctctgctcaaaatgtccagtctcgcccagagcagaagccagagaagccagagtcctgatgacgacccctgaagtcctgacccgcagaggccaacagctgcctcttcctactgctccccaagcctctctcgctggatggctgtgctccagccaggggctcctgcaccccacaatgctcctcacaggatccttgcacttgccccgctgtcttgttctaagggctccttcccagaggtgtacagactcagcacttacccaggggccctttctaaaaccagaatgtccactgtcacacccacaccgttccaacgcttcttatccctgccccgcttcacttagctccttatattcaccatttaatagatcacagtatttttaagaatcttatgattcacggggcagaaatctgattaccattttccctgctacatccatagcccctactctggcacacagctagctgatgcttaataaaaggtgatgaatgcataaatgaagtattctatcaaaggggtaagcatgtaagacttgttactgccaatttacaggaaacgcagggaaaatgagttaaatgacattgtggagttgcagtcagcagatgccagactgtgggaaacatacacaaaccaggcgatgggctgggatctggcccccaggctgaaggttactggcccctatctcaggggagtgacagcagaaggcagagagcttgccaggcctggggccactatgaacataggtaaagagccaggtgtgcctctgccccacccagccggccctatgtgagggagcttctgctctggcccacagcgcctctgactcaggagaaccctgttactaacccagagggggattgggggcaaggctttgttttctattattttaactactttttggattataagggcaatttctaaagttacatgatcactgattaaaaaaaaaaaactttgcaaacacaggcaagtaaaagaaaagcaatatgatattgccaattccaaatcccagagttattcactgtcctcatcagtattatactccattgatggatgttgttatttaactatttcttggccgggcacagtggctcacccctgtaatcccagcactttgggaggctgaggcgggtggatggtttgagcacaggagttcgagaccagcctgggcaacatggtgaaaccccgtctctaccaaaaatacaaaaattagctgggagtggtggcgtgcacctgtggtcccagctactcgggaggctgaggtgggaggatggcttgagctcaggaggtcgaggatgcagtgagctgagatcgtgccactgcactgtagcctgggtgacagaggagaccctgtttcaaaacaaaacaaaagcactatttccttttgccagacattggcttttgatttttatttgcataatcatgctgcaatgattaaatatttataggtaaaactatgtggatcttttctactttcttgggatagatttttacatctagacttagaggtccatgtttagaaataataaaactctatagctatatttcaaatatttatgtattagctgaactgatattttcctttatgctttcttccactgcttacatgtttaaaaattcctttctcatgcaaaaattcaaatacatatttttaaaaaattttaaggaaaagctcaatttttacctttaattctttcatctggaattttacttggttacagaattacatgatgaacttttaacacctttcaaaactttaacttaatttccaaccattgttttttttttttttgacacaggcttctcactccgtcacccaggttggagtgcagtggcacaatcacagctcattacagtcttgacttcccagcctccagtgagtctcccacctcagcctcccaaatagctgggactacaggatgtgccacaatgcctggttaatttttgtatttttggtagagatggggtttctccattttgcctgggctggtcttgaactcctgacctcaagtgatccacctgccttggcctcccaaagtgctgagattacaggcccttcacccccttgttttctttttgtttgtttgttttttaaagacagggtctcgctctttgcctaggctggagtgcagtgccccgatcacagctcaccccgatcacagctcactgcagccttgacctcctgggctcaggtgatcttcccacttcagccttccaagtagctgtgattacaagtgcatgccacacactcggctaatatttttnagttttttgatagagatgggggtctcactatgttgtccaggctggtcttgaactcctgggctcaagtgatctttccacctctatctccagagttgggattagaggtgtgagccaccgtgcccagccccaacaactacttggaacttattttgaaataaaaagctcaaagttcattttggttattttttttctttttcctttttagagatgggggtctcattatgttgcccaggctggtcttgaactcctgtgcccaaacgattctcgcacttcggcctcccaaagtgctgggattacaggcatgagccactgtgcccggcccactttgttgttattcatttcaataaattgcatgcgttcctccaagaagtgcacttgtaactaatatagagttataatacattccattatctcttcatgtctctgcatcacattttccaagggtaacatcttatctacatggcggactccacaattatttagatcttttatttatggttaaggtttatttaaacattttggctttattcctattaaaaaaggaatgttttcttccccattatgttatctgatttttggtgacataaactactaatttttttttttttttttttttttgagacggagtctcgctctgtcacccaggctggagtgtagtggtgctatctcggctcactgcaacctccatctcccggattcaagcgattctcctgcctcagccttctgagtagctgagactacaggcgtgtgccaccaggcctggataattttgttatttttagtagagacggggttttgccatgttgaccaggttggtcgcaaattcctgacctcaggtgatccacccgcctcatcctcccaaagtgctgggattacaggcatgagccaccatgcccagcctattaattttcaatatatattttatgcatccagattattaactctgactcaattaattttgttttcttgtagtaaacagaacgcctggatgtaagtcttcacatctcttctaggagaattattctgatgtgtatagccaagagcatgtcaaaattccatgggtctcaatttccataccaataatagcaacaggttacttacttcctcgtgtggcttgcttctcatgatctttatctgcatcacactaaagcagcggtccccaacccccatgccacggaccgctgctggtctgtggcctgttaggaatcacgccccatagcagcaagtgagcagcaggcaagcgagtgaagcttcatctgtatttacagctgctcctcattgcttgcattactgcctgagctccgcctcctgttagatcagcagcagcattagattctcacagagcacaaaccctattgtgaacagcacacgcgaggatctgtgttgcatgcttcttatgaaaacctaatgcctgctgatctgtcactgtctccatcatccccagatgggaccatctagttgcaggaaaataaactcagggctcccactgagtctacattatggtgagttgtagaattatttcattatatattacaatatgataacagtagaaataaagtggacaataaatgtaatgcacttgaatcatccccaaaccacccccgacctgtctgtggaaaaactgtcttcgatgaaaccagtccctggtgccaaaacagctcgggactgctgctctgaggaacatccctggacctaaatctgactggcagtgcacagcccccagggggcatggcctacctgctggatgtgggcattgttgggtccattaataaaatcttctagctcagaaacacggctggttttagccaaggcaaaaataagttcagtctctatataggactcacggccctttttcctggccatctgcagaaatttaactagatcctcccagttgtctaaagacagaaaacaaagataggttaacccagagctgataattttaaacaagggctcaattcctcccattctgttctcagccagacacatttaccctccagttatgtctcactgggaactcagactccagataacgtctaggaggtcttgattatgctcactaagcagatccatagctcagaagggaggaggggaggggcagagccacactcaggccacctcccttagaaaagactttgccaggagacagaatgcttgttctggacatcagagaggtcggtgccacaatcaacttgaaacaccagaagatccctgggaattgtgggcctgtcactcactttaaaattactacagtggcgatattgagatatctagtgtgcttaaatgacctcatcttgtaaaggagggcaatagtcaactaaagagctggtgtcaataacagaataatgtttatctcagactcttgtgggaaactttcatgtagatgtgccctctgatatctctggatacatcatacgtagagatttgtgagaatctcttcaacttcttgcttcagccaggttttgcatcagtgagatgcagagccctagggagaggggactcacttactgctcctgctggctgactgaacaacttccaggtaagaggaagggtcgtcccctctgatataggagttgatggcttccttcaccaaatctttctggagctgggcttgggccagctgactccacacagcaggctcattgcatctctccgcaaactcatatgcccggtccaggtttccaatgtgctcgatcaggacctaggggttatgagaggacttccattctctgcaacatctagtcagctccaaaaaacagacacatttttgtttggtttcctgttctgcctaaagctgcatgaccatttcacttcagtcagaagcaatcaggtactaagcatttctcagatggacaggttgagggaagagacaagagctattatatgagaagggggatgccgaacaaagaagagacactccaataaagaggcacagagatggagatagccaggttaagctttctgggccgggggtaggacatgggacttgctcctgaccttgggaggaaagacagtgcaacagagcatagaaactgtaaaagagttcacaagaattgctgtggggaataagattgctcaccaggcagaaacaggcttgctgagcagtctggcagattgcgtgacagtgagggccacccactgtatagtagtggaggtggtggcagtatcagctgccccctaatatgatgagctggtctgtctcaaagcaaggccagagcccatgagggggcacaaaagaagggctcctggattgggggtttcacagcaggtatagaaataaggtaaaggaagaggcaaggacataaagataattggtaggacagcagttcaggtgagatgtcctgtggtttacaactgatttggaaataaaaccagaagaggctcatagactggaaagaaagggatgcagtttaaagaagaagagttcttgaggaggcagaggggcaggcagggagggctggagggcctgctctgggaacctgaccttggatcctgaaaagctcctgctgaggagatgggggaatggggagtatagggggtgagtagcatggtgcagagggctggaatggttgtcattgagggtaagatgtgagtgcctctgaaaatcaaacgtttctgtcacctgggctgaccgatgacattgggtcaggtacccaagtccaagggagtgctggggagtaatagggaaggggcagactaacagccaatggaaggagcacccacagagaaggtcaagacaaggggccagcgggctgggaagatgggttgctggtgaggaacagagaagagcacgaagagatgcactggacaaccagagggtctgacacccttggagaggacaagggcttgcagggcgcactcatgatgtggcagaaggtgctaggtccgacatgcttacactcagcagcccacctggattgctgaggcattcatatcaaacttgtggaaaacggtgaaggcctcctcatacagtgcgctgctgacagcgatgctcgcgatgtccagtgcgtcatagttgtccaggcggctgatgtactccatgacccgtgtgcggtctgccttgatggcagtcaggatcaacagattctgtagattcctgaggagagagggtggtcagcacggcatcccaggaacgaaggctgcacaaaccattttttggcaggtcaggcatccccagacccccagtttttttaaaaaagtaattaatatacacacacataactgctaagtaaatacaacagagtatttgtgaagtatttgggatctaaaaagaaacagtatagcaaagtcttgggaaagcacaggtaagagaatcagaatgtgccaatcaaaccactgggagggctgctgtggctttttagagcccagcctctggatcctgctgtagaggtacctattttcctacctgtgctttctttgtgattcattatagctttatcacatctactgtatttctaagcaatataggcagctttgcatttttttttaactttttaaaaattttgagacggggtcttgctatgttgcccagctggtctcaaactcctggcctcaagtgatcctcccaccttgcccccacaaagtgctgggattacaggtgtgagccaccacaccaggtcactttgcatttcttgaactttcctttgctttaattataatagatgcattcttgcaaaactttatacaattcaaaaatgtggaaaaaaaatcagtgtaacacaccacatatcaataatctaaaaaagaaatactacatctttatcaaatgatcagaaaaagcatctgacaaaatctaacacctattaatgagaaaaactctcaactagaaatagaaggaaacttcctcaatctgagaaagtacatctacaaaaagcccactgttaacatcataagtaacagagtctggacactttccccgaggatcaggaacaaggcagggatgtccactctccacacttctatttgtgctggaggttctggttaaggcatttaggcaacaaaagaaacaaaaagtttcttttctataatgaatcgcaaagaaagcacaggcagcactagattaggaagaaataaaactgtccccggtgtctcacgcctgtaatcccagcactttgggaggctgaggcgggtggatcacaaggtcaggatatcaagaccatcctggctaacacggtaaagcccgtctctactaaaaatataaaaaattagctgggcgtggtggcaggcgcctgtagtcccagctactggggaggctgaagcaggagaatggcacgaacccaggaggcagaggttgcagtgagctgagattgcgccactgcactccagcctgggcgacagagcaagattgcatctcaaaaaaaaaaaaaaaacaaaaacaaaactgtcccaatttgcagccaacatgattgattaaaaaaaactgaagaaatctacaaaaaaaaaaaaatccaataaatgagtttagcaaggttgtagaatacaaggtcaacatacaaaaatcaattgtatttctatatactgacaatgtttttcaatgaacaactgtaaacaaaaaatctatttaaaatacttccaaaaatatgaaataagtataaatctaataaaatctacatatgacctatatgccaaaaactataaactgctgatgaaagaaatcaaagatctaaataaatggagagacatatcactttcatagaatcaacatagtaaagatatcaattctccctaaattggtccatagatttcatgcagttccagttccagcagattttcttgtacatatagacaagctaattctgaaatttatatagataggcaaaggaactacaatagctaaaacaattttgaaaaagaataaagttgagcccaggtatagtggctgacacctgtaatcccagcactttgggaggccaaggtgggaggagtgcttgaacctcagggtttgagactagcctgggcaatatggcaagaccctgtctctaccaaaaaaaaaaaaaaaaacaactagccaggcatgatggtgcacacctgcagctactcagaaggctgagatgggaggactgcttcagcctaggaggttggggctgcagtgagccgtgttcatgccacagcactccagcctgggtgacagagggagaccctattgaaagaaagagaaagaaagaaagaaagagaaagaaagaaagaaaggaaggaaggaaggaaagaaagagaaagaaagaaagagaaagaaaaaagaaagaaagaaagaaaagaaagaaagaaagaacaaaggtggaagaattacactatctggccaattgatttttgacagagatgcaagagcaattccatggagaaagagtatttttaacaaataatgctggaataaactggacattcatatgcaaaaagctgaacctcaccctaaacttcacactttattggataatgaatctaaatataaaatgaaaaagaatgaaacttttagaaggaaataacagaaaatctctgtgacctgggagtattaacagagttcttgttttaacaccaaagcacagtccataaaagaaaagtttatgaattggactttatcaaaattataacttttgttctgttaatgacactattaagaaaataaaagaaaatctacagaatgagaaaatatatggaaatcacatatccaacaaaggacttgtatccagaatatacaaagaactctgaaaactcaacncctaanccaaacaacccaattaaaacacaggcaacagatttcaagagacacttcaccaaagaggatctacggatggtaactgagcacataaaaagttgttcatcatcattagccactagggcaatgcaaattgaaaccacaatggcacactgctatacatttatgagactggctaagataaaaaaataccaatataccaagtgctgctaaagatgaagagtgactggaactctcacatattgctggtgggaatgcaaaatgacacagccattctggaaaacaatagtgaggcggtttcttaaacagtacatataccatgtgattgggtatgtttaaacaaaaatctggacacaaatgttcacagcagatgtattcataataacctcaaactgaaaaccacccaaacgtactttgatgggtgaagagatcctgtggtacattcgtacaacagaatatcattcagtgacaaaaaagaatgtaaggctgatgcgatgcactcaccaagttggatgaatctcaaaggcatcatcacgctgggtgaaagaagcctgtcacagaggagtctataccacgtgactccatttgcatgacattcttgaaaatgcaaaactagtgtggcggggtggtagccagggttgggggttgaggtttgggggaatgtataatatacacggtagctagcacaagggaatgttaaagggtgatggaattgtttgtatcccgactgtggtgattctacagatctacacttgtgttaaaattcctagcactgcattccccatccccttccagaaggtcatttttactgtatggtggttttataaaaaagaattttaaagttgggtgctaagggtcatccatgtacagtgttcatttctactgctatctggtattccactgtatgactgtactacagcctacttattgatggttatctggatcgctcttagagctttgtcttgagtatccctgcacatctcctcatacaaataagctgagttcctttagggctcataaggaagagaggaaattgctggctgtgtgcatcttttttcaccaaactgtttccaaatgtaacgcacattcccagcaggggcacgtcagaggtccagctgttcaacatcctcatcagcactgattaggagagtggggttcctgctgctctggcaggagtaacaaagcatcggatgatgcactgtggcctcactctgtgcctccttggtggctgatgaggctgaattcacaagctgcccttcctctcaccggagggtgtgctcaagctctctgcttggtttctcattgggttgcttgtgtttgtcttttattacaacttttccctactaattttttgttggttgtgttgcaaatatcttccccgcatttgtagcttctcatttgtccatcttctttacgataaagtgcttaagtttaatacagtcttattggtttttcactaaaggtttatttatggtttctggtttctgtgactggcttaagaatttattaggtcataagtatattcttccaagtatatactctaaaaataatatattttgcttttttttttttttttgagatggagtctcgctctgtcacccaggctagagtatagtggtgccatctcggctcactgcaacctccacctcccagactcaagcgattctcccgcctcagcctcccgagtagctgggattacaggcacctgccatcatgcctggctgaatttttatttttagtagagacagggtttcacccatgctggctaggctggtctcaaactcctggcctcccaaagtgctgggattacaggcgtgagccactacgcccagccaaggctatttttacctacgcataaaactgtctggtgaaatcatcaatgaaagaagagcacgaacttgaggttacctgcatgtttgagaagcaagtgtttaagaagacagcagagctacagccacctgtaagtgcctggaagtacacacaaactaacaactatcaaaggaggttgatcagacagcaagacagaatatcgtagccacctcaggcaccttaatcctggcatcctgtcattagtcagggtttatgattccattaaatataatttcacattccatatgccattaccatatagcatctccaagtttaaaaacacacacacaaattcctctctataatactacagcccttgatagcctttctggcctacaaaataaatctcataactaaatctttacagctgcacttatgatgtgagttgattaaaatctgacacagaatctctgatggtgaattttgaagtggagaggaaccccaggtggctggcccatgcggaagcacgcactcttacctctatggtgcctgcccatgcaaaagaagcacgcgctcccacctctatagtgctggtccatgccgaaacacacactcccacctctatactgccggtccgtgtggaagcgtgcactctcacctctatagtgccggtccatcggaagcacgcactcgcacctctatagtgccgggcctgtgctgctgcccctgccacagctcctgctcatctggcttctacattatacttcgggcaagtcttccctgatacatgcccagatctggttctcctgccacctttctccaagctttgttcaccatgatttgaagagttcaacacatccttaggccacatgagaccttcataaaatgccagctccctttctctgagcattgtgttaaaggacagtgtgggccagagcagtaagaggagcgcaggctcctagaaaatgtgaaactgaggctgggctctgagacaggcaggagctaataagggaagggctagattgaggtagaggaggtggtaagaagattggcatgtctggggagcagccaatgggcaggctggatgggtgaagcggtacgagattgtaacagaagatgagtatcaagcagatgttttgaatctgcctgtgtccacagctacccctggcatagcctcacctgtgctcgctgaagacagagttatccagaactatcttctccagcagttcaatcagttcattaggcaggtcggctgtcataaaggctttgacagtgaccgaaatctcttcaggatcccgtgtttctgacaatgctgtctgtaccacctggttttaaaaagcatttgaaagaacttgattaaagtcaattcaagactgtatctttgaagctaaacagaagggaaggactcctccaagatggtctggaatagacacagagaaaatgggagacttcttaatgtaacaaaggaagggttttcaaagttaatttcaggaaattctgtttgctctgttttgacaattagtttttctctcatatcaaatatgctacagactcttactcagctccaatgaccagtgcaccaggcattttgaaatgaatgtctccttttagatttgtctcttaaagccactaatagcaaatatggctccacttctctaatgaagacaccgcagggcttccagcagcctcttactagaagagagcactgccactgctgtggcacagtccacagccagagctgtggagccacgtgccttcacaccggatgacactcagaaccacaatctgaaggaaagaccaacaaaagactggctgtgccacccctcctccaattataggtgtctcacatacaaaaacacttacaaatagggtggaaagacagttttccaaagagtacatttcccatgcaacagcagtttggaacgccagcactgttctctttgcactttggaccaggcaccttcagtgacttccagaatctaatatttttgccaagtttctggttctcctcaggggtgggcaacagccgtgtatcaatgagagggaagagacagctctggacggtctttcatggctaacacagccctctgaccatgaactttcacctagcaatcttgaggggccttaaaggaacctagggtcaaggtcagtccagtccacctttctgctagtctttgtgaactcaatggtaccataagatgcaaaagttctacctctgtggaatttgtagtaactacaacaaggaggctgaagagtttgagaacaggagctctcccagcagctaaggaaccaaaagggtatgcctgagggaaaggggcaccaggacacagcacaagtccatccaaaggagaaggtacacttccaacagtgacatctaactgtcaattcttgaaaaccttggaggccggccgcggtggctcatgcctgtaatcccagcactttgggaggccaagacgggcagatcatgaggtcaggagatcgagaccatcctggctaacacggtgaaaccccagctctactaaaaatacaaaaaagtagccgggcgtggtggcgggcgcctgtagtcccagctactcgggaggctgaggcagaagaatggcgggaacccggaaggcggagcttgcagtgagccgagatcgcgccactgtactccagcctgagtgacaaagtaagactctgtctcaaaaaaaaaaaaaaaaaaaaaaaagagttcgagaccagcctggctaacatagtgaaaccccatctctactaaaaatacaaaaattagccaggcgtggcggcaggtgcctgtaatcccagctactcaggaggctgaggcaggagaatcacttgaacctgggaagtggaggttgcagtgagccgagatcacgccattgcactccagcctggtgaagagcaaaactctgtctcaaaaagagaaaaaaaaaaaaaaagaaagaaagaaaaccttggngcancttaaataaatacacacaggttgttttaagggcaaaaataaatttctnccatctgtttgagtcaatacaggatgccccacctaaggttgcctcaggacactgctctcagtaaacttttcataatgaggttccactccagacactaaaagcagcctccctctgttattatgcgctctggattacaggagcattgcagttgaatttcgcaccaggaggtggctacagatatccaattacagcagagataatgaaagaccagcagctctacccagaaacaggaagacaagaggcccccgctggctccggtatggtgcagtgttaaagtggcccttccccagtaccaacatgaagtcaccttcaaggtgtaccaggtggctggactatacctggagaaatgtctgatgtctgggaacctggatgtagaaccctagtagaatattgtgttgtttaatatttttattagatttggatgggtaagtccaaagttgaaacagagattcaaaacaacatgaccttccataaatctcaaagtatttcaaaataaaaagtttatttaaaaaagtagtggcacaggcttgaggaaacagtggacagaaaacgagaggatgaaattcagtagagataaaggtcaaatccagccctcaagcctttcgaaagcactggtccagcaggttggcaatgtgtatgagggaggtgggagttttaactggtcctattctcagggctgaagccacttgttggacgagggttttgttccaacattggtcttgccccacccctaaacagtctgcctagcacctagggacagtgctgagggcagcagaggcactatctgcaaatgtctgtgaggctataactggagaggaggctcttccacagggctgtgggaagccctcccagaggccgaggcagactcccacctgccaggccatacccaataatgacccctggccccagcactctgcccagtctccaaggaggtgctggatagtcacaggggcataaagagcacctcaacaaagggaagtcagctgagacaaccttgaaagctacttcacctctgtccacgagggctgagctgggcccagcatgcaggcatgacaccaggtactctcttcctgggctgcatatccctgctttggatccaagggccaactctatgcccttggccagttaacagttccaagtcagcttaccctggggaatcaagctatttttaggcaagctatttctgcaggggagaaggttcgtaaggactaagatgttttatttatttatttatttatttatttatttatttatttaatttttttgagacagagtctcacccagttgcccaggctggagtgcagtggcgtgcagtctcggctttctgcaacctccacctcctgggttcaagcgattctcctgcttcagcctcctgagtagctgggattacaagcatgcgccacacagtgtgttttcgtatttttagtagagatggggtttcactatgttggccaggctggacttgaactcctgacctcaagtcatccacccgcctcggcctcccaaagtgctaggattacaggcgtgagccaccatgcctggcctatttatttatttttttgagatggagtctctgtctgtcgcccaggctggagtgcagtggcacgatgtcggctcactgcaacctccaccccctgggttcaagcaattctcctgcctcagcctcccaagtagctgggattacaggcgtgtgccaccatgtgcggctaatttttgtatttttagtggagatggggtttcaccacgttggccaggctggtcttgaattcctgagacctcaagtgatccacccacctccgcctcccaaattgctggcattacaggcgtgagccactgccctcagccaagatgttttaaattaaaaatgaaaccagtcacttgagccacaatgatgatcggacggcaaaatgcaggtgtgcagacatacccatctctgtgcctcacctggtcaattagctgtctcctggatgggttggtctcctcaaggacgtgagcccagagctccggatcctttctgcataccaggtagcgggcctcgcttttgaacagagaattctcattgcacacctgaaatgagcacactcatgtgtgtgacacagcagccaaccagcggaagctgcttgggaggacacaccccaattcgttccctgtgtgcctgatactggtttggtggacagtcagggcccaggcaagacgctatgctttgacatgggatgagcagcatcctacagggttaacgatggactcaaactacctcaaaatgccctttccaagtttacaacaactcccagggatgtgccacatatctggccagtaggacttcctgcattcagggacatgctctgtctcccattctgtctgatacagccactagccatgggaggctactgagcccttgaaatgtggtgcgtgacaggaactaaactggtaatttttaatttagttaaatttaagtactcatatgtagctagctttaaaccatctgtaaaatgttatcagaacagcctagaactggtataaaacagcacaaacactgcaatgtttcaagatctaaaaactgtaaactgtgctttcactggtagatctggagacctttttctgaatgttataacagatctccaaaacaccaacagtccactggaatgttctagcgtgtgcagcacttgctaaatcctggtgaggatcagatctgttgagtgccagatgcccggcacaaggctgagcggcgtgcacacgtgcttgcggatgcagcgcagtccgcctgtgtatcacaggaaaagcccaagcaggctggtgtggcaccaacctcacaggtgccctattcatgtctggatttttagatctggatttttagatcaaatgattaggtaggaacagttcatacaattcaacctaaacatgtaattatatgtggatccaagcctgggcagatgcaggcaaaagacctgggcagatgtctcaaggagaggccagcaagagctcattggtcaggtgatggggaagggcttgtgtagagggttaccccaaaaagggggcatgaagtacaagggtactcgggacatgaggcacccagggaattgcaggcctctccaggtggggtggcaagatggatggctgatcaagttcgggagttgggaaaggtggcagtccacagaggagctcacgagtcaggccaaggagttcaattctgccctcaaattgccaggcaatagtaaggactgtaagcagagggatgataagtcaggttcaggaccaactggtctacaggtacaatgcatacaaattgcatgagcaagttcccaaaagctgtgagaatcacaaggaaataatctcatgacctgccatctccaggtgcacagaaagccctgatcagctccccacaggcacacctttgaaagcttccctgggagcccagggttacatgggcagctcagcacatctgctacccaccttgatgagctcaaggtcacactgcccccgctcataggcaacacaggccagatgggggtctcgcttctcacagtagcggcccaccacgctgctgtcatagtaggcattctctctcaggaagcactcggggctgttgttgctgtcgatgtagattttagccagtgcattgtgagtggcaggctcctcacagccttcctgaatctgggactccagccagggaagcagcagcttgagcctttgaaagaaggaaggtgctgtaaagtctcaaggctaccactggaagtcttgagggcaactccagggctctgacagatgtttcctgaaacaaaaaatctcagagtccattgacttcaggttgctctagggaccaagatggacctggtttccaaactgatttctactgttaggttttcccccaaggtcttcacagtaccaatagcaagtaactcattgctacatctaagatgtgtacatgaacgaccagctatagagacagtcctggagaattagacagaaacaacaacagacactagaatccaggggtaagagaaaacaccaagtaaggacaccttacctatttcttttttctacttcagccaccaactcatcagtagagaactgtcctctcactgccatgattaagtgtttaatcacttcctcagaacaatccacatcaagcagccctccaatcacagctggggtccggctagggttgacctagggtagtcaaggtcaagtaacttcagtgttgcaaacacaagttattgttagaagcctcctacgacgtggacagtttgggcaaaaccctgaaagggctcctgtttagcactgcgctgtgtcccaccaaaattcacctgctgatgtcctaacccctagtgggattctacttggaaagagggtgtttaagaaggtaatcaatgtcaagggtggggccctaatgtaatgggactagtgtccttctaagaagaggaagagacaccaggagtgcacatgcacagaggaaaggccctgtgagggcacagccaggaggctgtctgcaagcgtgggagacagccttcaccagaaaccagccctgccgacaccctgatcatggacttccagcttccaaaactgtgagaaataaatgtgtgttgtttcagctgcctggactgtggtcttctactctggcagtctgagcacacgaacccaccacccttcaaaatgatagtctctgaaatgtcaggtgttacaggcagcctctgaggggaagactgccactgactggggcccagaggcagccgggtgtcactccagggagccagcagtaccttctgcacgtagatctcaatgtacctctgcaggttgttgcggtataaatataggacaaggtcatggacaaagccaaaacgatcacacacgatgatgaggggaagctggtctgtgagcttggcctcctgaggattagaatgcacagaacaagtcagggagtggagaaaccagacagccagacctcggactcattgcacacatgggacggctctgtctctgcagcagagtgacacacaggagactcagaatgagactgctctaaataggctgtcgttttgtggtatggcatttgctttgggaaataagtgagagaaagatattagtatttggttaaagactgctacatttggcattaacattccaaatctggacaaaaatatcttttaagacaagcagctcattatgtgcaaacccaacagaaaccaggccattctcaagaacagcacacctgcggtaagggctgccttttcagacacgcagccgcaggccatggaaacacacccggccaccattcccagatgatgatggcacttgggtaggacagccacaggccaccacaatcatgcctcccctcatgtggtcccgtgcctagatcacattttgaagttttaagtgtggccacatgacctcatttcctccaatggaacgtgaatccaagtgtcatctgccacttgcaggcctcgcccataaaaaccacctatgctggttcctctgtgctcttcccttcctctagctgactgggaagacgacatccaggtgaggtgctgaacacggcaaagcagccatgaagctggtccttgaagtacagtgggaaggaaagtcaccccactgacctccagcctaccctggactgccacataaggaagtaggcttcctgttctttatgacactagtgctgagtggtctacttgtttctgcagctttgcctgcctaattgacaatggcactaatgggatgttgatgaattacaatgcagcaataagtgccagatacttagagcacagcctcaagctgctttccacactcttaaaacgatagaagggttactttagaactttaagccataaagtggagctctgtccctgggactaaggggtccctggcgagacagatccagcttcctgcccctgggacgtcctgcggatggtctgccccacctgccatcagcaagggcagctcatggaaggaggcagcactggaacacaccttcaggaagttcttcacacgctctgggttgtagcagctgctctctcggcatatcctctccacctccttgatctgccctgtcttacaggcagcctgaatgtatttcagatgcacatctgggtcttggctgaagttcacgattgagcccaggaagtagaagaggcctatgaagagagaccattccatttttgtccttgtaacacctgcctgtctcctccgtagctgctgcccaccttccctcgatgaccctgctccactctccagggacccacagcacactcagaactcataatcaatatgccatttgtctgttttggcagctcccaaaaatagctagtcggatttccattatatttggcaggtatacctggcatgttttgatgtaaaatactagatatttggtacaagtgaaattccttttgtgggcccaggtatacctagatagtcgtcatcaagagtaattcccactgaggtaatctgaaatggtggtgggactgcttctctaaaaagacacatcaagggacagagaaataagccatggcctccaggaggaggcctgcaactcaacacagagctgacagtgacatgggcaccacatgctgagccccagggtgagccccagaggacagcattcacagaggctaatgatgttcctcatcattacagaggccagccaggaggcaccagtaacaacagggtacgacacatctgagaaggcccctccctgtcgaggtctttcactgtaactgtgagaccctgatgctaggaagggaatgggcagcccctgggctgacggttctccaccaacctactctactgccctctcccagcccagctccactcaatcgtctgccatggtctttcctacaggggtgtcttctaaagagaaggccagttccctgaggacagggtcatgtcccaccctccaccgatgccccaacctcactggacacatggcagtggcttgatgcctagacaaatgcttagtctctatcctgggtgggccagacagcccccatctgtccctaacaaagccactcccatcccaactgccctagaacacttttttggtgtgatgtccaagaaggggaaaggaagacaaccaggttaccttgtcagccccccacaatcaactgggtagcagacaccacaaagcaatgcaccctctatcgtgggctctcatttaggagaggcccaaagagcctccctcctggggctgtaaagaccagacatcaggccctttcactgtacccacgacacaggcttttagatgaattcttgccagactgtgctgcgtagacacaccgggctccataagtttctccatcccatcaccaaccaacctgatttcttcctttggaaataccaaaaaggttactgaagctgagggtgcacatgagatggcagtagcattctgccaccgactgagcacccaaggcagccagtgctgcatcctgcctggctttgcaggaaggccgtcttaaggcgggcaggtaggcagcaacacctgagaaaggaggtgtagtcacatggtggggtcggcgagaggctgcatggtttacctttgtaactcttgaaggattcaaagagctccaccagggcctgcgtgcccagctgctcgtggtacttagaggccacctgcacacacagctgaaggttctgtctgatgttagcagacagcatggcatgcagacactccacagaatcctccaccgataaggagccaaagaaattgacaagccactgggaacaaggaagagtctgtccacaacgatgcaccactctaaagattgctaacacttggaaaataactaggtcattctcctgttcccctgagtgtcaaaaatacagagaatttccacataaaggggttgaaaagcaactatccatcacgggaaaaagtaggagcaaggagtaaagctgggaaaagacactgatctaaactgttcacctggaatattccacagatgatgctaaaacttattccataaattggaacacaatagctagtttagctttgctaatggtttcagacagtcctattaggttgtcaatgttaaaaggtgaccagtatactcctgctattagactaagtcaaaggtggatatcagaaagaaaggtgctacagggcccagacatgctgctgagcagataaactttgtgcgtgggctgaattagaactgcttttggtagtaaagtatggtaggttagggcagtgacaggctcaggccacagttccacaatcaccaacaggtgaacactggggagcatgtgacattaattgcatagacaacagccataataggagtgcccaggggtacacagtacctcgggattgaggaggtgagtgtggaccacagccctcttgatgtcatagaggtcggtgtagtgctccagtgcttgctgcaggaggcctgccttctcacagagctgggcaatgtgggcccggtcgtaatgagtaaacattttatttccaaggatggcatctgcaacctatgaaacagggagttcggtgagaagccctgatcaatggcaataactttttaagaccagctgctcaatcttgccccagggtagggtatagcctggcaaccagaactcacaggcccctgtccacatccatacctctgtggtggcagcagtgcttgtgggtcccaaatccctggctgtccttcaagccatcttaggccctttgcacaaggcttcattctcccatgttgcagctgggccaagcccatgtggtcacagagttgggcctgtgagaaaggctgaggctccataaagccctattactgggatgagtccaagtcactgttgcagcttttaagcaatcacattctttttttcctttttttttctttttttgagacagagtctcactccatcactcaggctggaatgcagtggcacaatctcagctcactgcaacctccatctcccaggttcaagcgattctcatgtctcagcctcccaagtagctgggattacagacgcacaccaacatgcctggcttatttttgtatttttagtagagacagagtttcgtcatgttggccaggctggtctcgaactcctgacctcaaatgatctgcccaccttggcctcctaaagtgctgagattatagccgtgagccaccgtgcccagccagcaatcacattcttatagggtttctatggcaagatcaatgtgagggctcaagtctaccgattctccttgaatgagctcaagccttagattagcaatgaccagaaggagacctgaacaaaacaaatcccatttgtgcttactagacttctctactaggctaaatacagaactaggagttggggattgcatttaaaaaacaatgaacactcctggaaacaattttgatgaggcataaaatcttttttttttttttttttttgagacagggtctcactctgttgcccaggcgaatggagtgcagtggtgcaatctcggctcactgctgctttgacctcccaggctcaagcaatcctcccacttcagcctcccaagcagctgggattacaggcacatgccaccacacctggctacttttttttttttttttttttgagatggagtctcgctctgttgccaggctgcaatgcagtggcatgaccccaccctgctcactgcaacctccgtctcacgggttcaagtgattctcctgcctcagcctcccaagtagctgggactacaggcatgcgccaccacacccagctaatttttgtatttttagtaaagacagggtttcaccatgttggccaggctggtctcgatctcttgaccatgtgatccacccgccttggcctcccaaagtgctgggattacaggtgtgagccaccgcacctggcccacctggctaatttttatatttttttgtagagatggggtttggccgtgttgtccatgctggtctcaaactcctgggctctgctcaccttggcctccaaaaatgctggggttataggcgcgagccactgcacccagccactaaatattctcttgaagtaagtaatttttgggctaagactggataggtcaacacagcagccttgcagcatggctgagtgagtgctccctcagtatctaatgatggtcttgacaagctacactcctgggtgccttcccctgccacctggcacactctttcttattccttctaggatctgcatcaccaaccaggtatggccacagagtgaccacagccactgtcacacaccagaccacttcagagtgatgcacagagttgacgatcaaacacagtactaagagtagggctttagaacatctagcacttacctgagtctcctatcctttgtttccttcaggtttatctttacttcttgttttcaaacattttctcctcatagcaacagtgtattttatagaatgtagaaaccatcacgcagtcctactgcccagagaagactgccagcgtcctggggcactaagccagagcctgctggcacctcacccaactacttgtttctcctttagggtctgggcattccttagggtctgtctgccaagtttctgagtgacgcttggtgtgtttcaaatctcattcaccagaaacggttacatacactcacaaagtcatgagagtccagtagaccccaagcagcaaattaacagtacttttatttcctagagttggaatatgacccacttcttagcagctaacttgtagatttgaataaattgaggtaacagaacaatatacttaatatgttgtttcctaattataaaaacagtaagtgattattaaagaaaaatcagaagagataagtaaagaacaaagtgaacttgtacaatcttatccacttagtaccgtggtgaacagcttgatataaactcctctaaatccctttcttgtatatatatctaaatttaacccaaaatagcacagacatgtgatttgattatacctgctcccacaagtttcaggccaacaaatgatgcctcaccacagtgagataccactgcacgcccattaagatggtgattactattattattattttagacagggaagatgtgttggcaaggatatacagaaattggaacagctgagcattgctgggaagaatataaaatggtacagcctcctggaatacagtatggtggttcctcaaaaaggtaaacatagaattactgtaggacatgatccagcaagtccacttctggatatatgcccaaaagaattaaagcagggtctcaaataaatctttgtacacccatgttaacagcagcattattcacaatagcctaaaggtagaagcaacccaaatgttcatcaatggatgaatggataaacacatgtcatatatacacatggtggactattactcagtttcaaaaatgaaggtgtttctaacacatgctacaacatggatgaaccttgaaaataatatgctaagtgaaaaaagccaggtaaaaggacaaatattttgtggttccatgtatatgaaatatcttgaaaagccaaattaatagagacagattagaatggcagttgtcaggggctgggaaatgaggagtcactgcttaacagttacatagttactctgggataataaaagttctggaactatgtagtggtaatggctgcatagcattgtgaatgttcttaatgccactgtatcagacacttaaaagttgttaaaatggtaaatttggttatgtatattttaccacaatgaaaaaaagaagaaaggaagaaatgctgccctaattagaactgtttccatgaaagtcctgtatcatgatttctggaaaatccttttaaggaaagtcatggagaatgtccactgagaagtacaagataaacatctggcacaagcccagcccagtccaaagccactgtgctcaagtctgcaaacccagagaggtgccacaggtgctctgcctctcggtgttagcctacaagtcactgacctggggtgcatgaacaaggttcatctccaacagccatgtctgcaggagtccctcagctgggcgattattcttcaaggcatccaataagaaggaagtacactgctgaattaaactgttttccatgaaaatgtccacaatctgaaacatatccaagccacattttcactcagtatgttttcattcagtgtttcattttcctattgaaatagttcctgaaatattatctcatttagaaattcagcaattagttccctcccttggttttttttttttttttgagatggagtctcgctctgtcacccaggctagactgcaaaggcacaatctcagctcactccaatctctgccctccacctcctgggttcaagcgattctcctgcctcagcttcccaagtggctgagactacaggcacccgtcaccacacccagctaatttttctatttttagtagagacacggtttcaccatgttggtcaggctggtctcgaactcccgacttcaggtgatccgcccgcctcggcctcccaaagtgctgagactacaggcataagccactgcgcccggcccctttccattttcttctgtcatcgcaattcacatacagccaggtgtggtggcatgtgcctatagtcccagctactcaggaggctgaggtggatgcattccttgagcccaggagttgagaccactgtgggtaatgcagtgacctcatctcaacaacaacaacacaattcacgtaatttatggtcattaatttattaataatcttgcaaaatcatatcacctacatcatacttatcagtgaggtattttactgaagtatatgaaagggagtaacttttataacatatgaacccccaagcagtaatcatacattacttaatcacatcctagaggcagctgtgatgcttaactttaggtgtcagcttgactggattaaggaacacatagagaacaggtaaagcattccttctgggtgtgtttgtgagggcattcccagaggagactggcatgtgagttgggggaacaagtagaatgatccactctcaatgtcggggaacaccatctaatcggctgggggcacaaaaaaggaaagaatagatttcttctctctttctcctggagctgggacattctccacctcctacctttggacatcagaactccaggctccccagcctttggactccaggacttacaccaaaggccccccagggttctcaggccattggcctcagactgagagttacgccttcagcttccctggttctgaggctttcaaacttagattgagccacgctaccagaatccaaggtctcctctagcttgcagacagtctatcacaggacttctcagcctccataatcacgagccaattctcctaataaactccctctcatatatctgagatagggtctcactctattgcctaggctgaagcagtgacaaggtcaccactcactgcagcctcaaccttcagggctcaagcgatcctcccatctcagcctcctgagtagctgggaccacaggtgtgcaccaccatgcctggctaacttttaaaaaattgtttgtagagatgggggtctcactatgttgcccaggctccctttcatatagctatagctacgctattgattctgtctctctgcagcatcttgactaacaaagcagctgatacttgatatctaactcatatatatcattatattattggggcacaactgggaaaatgcaaatatttacttagacaattattaaagttaaattgatgttaatttaaataattaatatgccttagtaagatgtgaaatacaggaataaatttaataattgtttttgaaggacagctttacaggaaaataaaaaagaacttattaactgtggaacttctcataaagtatgagaagtttatattttgaacaactttaaaatatgaactgtaaacaagatgtgaactggaaatttctttcctattgaaagctaagtaaatttgtctcaaatctcttattcatgttctccaaaatatctgcagattcccagatgtacaaacacatacaactgcacttattatttctaaacagttgttggttctgatgccttgcttcaagctttgttacacatctatatatcatcaaagctccttgtaccaatttactgaaagtgacttgtcatgtgtttacatctaaattttaagtaggttacactaaaaaacaggctgatgctcacgtaatccaggtcagtcagacacccacaggatgaacatctgggggacgcaacagcactagctcctggtgctcaggccaatggtcagggagagacaatgatgtagtaactggggtgggccacgggatggagggctggaacctaaatgacatcctcacaccctacaccatcaccacccaaagacacaaacccaaacaaacattctctaaagtacttcaaaacaaaggaagcaatgagtactcacatagtaaagactagaagacaaactccccaagtacactagattttttaaaactgcaagattaatagcagatgaagaaaagcattgagacaagttaacaggaaacgaatcaaagaaatcttctagatggctctaaaaagccacaaaaagttgtccaaaactgcctacgctcacctggctaatgttggccagcggctcctcgtcctgcactagcattcgagaaaactgcaggccctgttccggactgatcttcattacacccctcagcagaaagatccagtctggggtgtacccaacctagaagcaagggagcaccaatcaggaaaatcaatgaaaaaccctgggcattagaaaaggaagttatccatcctttgttttaaactcgtgttaacaaagaaatgagcagcaacattatcatgtgtaggtaccaccttctgccaaacacaatatccaattaaatgaattgatttaatgtacatggaaggcacaattaactatacaaagagcccagaccacaaagaagtttcctgatctgtgtgcaaacacagcctgccagtaagcacacagggataagatctgggagtctgccaaaatatcaaattaacatacagaaggaagagagggagagaaaaaacaagataaagctcccaaataaaacgaagatggaaggactggaaaactaaggataataaaaagctgaagagaataaaatatgatcattatgaataaagatcctaacagcaacattgccaactctcacaccagaggacttacaaagaagggtattttataaactttaaaatcagcaaccactcaaccacacgtgagtaatctgtgagatgccagtggttcaacacacgttacctttttggcatagagcacaattttctggaattggcctgtttctgcaaaacactggatcactttgcttggcacatttgcccgaaggtacacactcagagcgagcatggggtcagtggttttgaccaagtctccgagctcctctgagcactccagctgtggtatgccaagggacaaggcaaagttaggaggcaggtagggagcctggaccaagttttcaagctgtgcgggggggctacgagctcacaagtgtttctaccttatcttctttcagccacttctctaggagttgcttacgcccctgctgaagaaccagatggcaaagttctaaggattcaagtttattgagctgaccctggtcgagcaggattccgaagtactgcagcaatggagaagcctggccagactgagcgggtatactctggaatttctggaccgtctctctggtacgcaggattccctaataataaatggaaaaataggtcattgtgttgtaatcacaggggatcccttcactcaacttccttgtatgtaaaaacaaaaatctgccagtggaaattccacactgctctgtcatagacaaaaagtcctctaccaaggcaactgcttctatcttcaacaataaccataagtataggggaatctaggtcctccaggtggcttcacacttagggtcttacttctcccccagcatgctgcagtaagaattcggcctctcaatcagtcttgtagtagtgaagttctgctatcattatattctaattcaaaatactcaaattcacagatgaaggctagaaatggtttgttcacaactaccccttgaaagacaagaaaaattctttcaaggacaagcaacttgaaagtctttatctactcaggaacagatccagtctctgaacaatttatccaaatgaaataaacccaagaaaaagccatatgccgaaatgctatattctaaaagagtggagaaagtccagggtaggactatcgctagataaaacagggaacaaccacttgatgtattgtacagttgcatatttgacaaccaggtagcaagagtggaaaatgctaagttacagaaatgtgaaactgtatctaagctgttgggtgagaggtacgtatgcacacaaagtgggaggcgtgaagaagtgccgatgcagcaagagtgtgttttttgtttacttcctttactgttatgccattggtgcaaaaattttaaactaaaaactcctaacataacactaatagactgcaatatcactagtgaaatgcttttatgacttattttcctctcaaggttggttcttaacactcagaacacttgaacagtattcaaggtttatcacctttggtgcagacgctgcaactttggcggcttcagcatagctgccctgtgcaaagagggtattgaattttctcacaaacaacttctctgccccagccaggttactacgaacggccaaacgcagaccaaggtctggattctgaagcacgttggttgcataattcacaatgttatcttcctcaacacaaactgacagtacctgtaaggacacaacaagtgagagcagcccggcctagaagagtgctccaccatccctctgccatgttcccttccgatgctggagtggtagccacattctcaggcgagtgttgagcacacctgtgatggtggccctcacagtgaaaggaggcaaagcagccgaaagccaaatggtaacaaaacagaacagcataggagtctatgtagttattaaagtcacacagataagtgtgatgcgttctgcgctacagcaaaatgacctatgtggatggaactgacaatttttcttcttaaactttttatttttaaagtacagagtttctttcttttttaaaaaatatttttgtagagacagggtcttactatgtcgctcaggctggattcaaactcctagcctcaagcaatcctcctgtctcagccttccaaagtgctgggattataggaatcagccactgttcccgacttttttttttttttcccctgagacaggctctcactgtttcacccaggctggagtgcaatggtgtgatcacagctcactgcagcctcaaactcctgggctcaagccatcctcctgcctcaacctcccatgcagttgggattacaggcataaactattgtgcccagccaagagtttcttcttttaactatctttttcaactatggttgagaaaagttacttaaataccatagtatctgctttttcaaccctccccagttagggtgtgcatggtataaagatgatgtgcatcagaactgctgttctatacgcaggaaggagctgctctcctcctggaatcaatcctgtgttaggaatggtgctgtctgaagagaggaagtgtcaatatgaaggaggagacatgggtttaagtttaataacaggaactattaatagctacacccagctgctttcctagagaagggggaaagtttaaacgccagtccctaatgaatggaaaaggtagaaaatgaaatgtcagagttacacacctgtccctttttgttgacaccaataattccagaggttggtttgtgtggagcagtgacaaatattgtgtcagcactaatacggttcatgcagatgcacacgccagactctaggtcgtacagatgaagatagccatactttgtgatcaagtaaataacaccatgtttagctccaatctataagaagacagagagcaagaggttggaaagtaaggaggagaagccatgcgggtaaaaagagctcacaaatgataaagaggattcttgtttgtttgtttgttttttgagatagggtcgtgctctgtcacccaggctggagtgtagtggtgccaccatagctcactgcaacttccgacctctgggctcaggtgatcctcccatctcagcctccaatgtagctgggactacaagtgtgagctgccacacctagctatacaaggattcttcagtttctcaggccgagagattactggtgggagcaatgctttcctgagacatggattctaagttgtacttgattgagaattagttttaaagacaatattttgtccaaccactctcaaataaaggtccaataaactcaggctactccatttatctttcaggtagagcgatcctttcacagtttatcgaacccctttaagcaagctgtgagttcataagagaaggggaaagttctggacaaagacctcaaacgccaagatgatgttccagcatgccttctaccaccacttattaacctttgagttttgccaaatgctattaacttttacagaaaaatatttaacacacaagaaaacctgaaggggctggggagaaaaaacagatgcatttgcccaaccagattattaaacatatatattaaaacagacagtaatttttgaagtatgattttaccactggaagagacagagagagaaaataattaagagccctgaaagagaatgaatcatatatgagaatttattaagaatgagtgtgtggtggctaatgactatagtcccagctacttgggaagccaaggcaggaggatcacttgagcccaggagtttgagtcaaacctgggcaacgtagcaagactccaactctagaaaaataaataattagtaggtaacatattagtggaaaataggcactttaatcaatatataacatatattattaatatagttagctagctatctggagatggaggtaagagtaaagaactgaatttctatcttactctttagatcaaagtaaattccagatgggtcaaagattttaaataaaaaacaaggacaattaggataggaatgaaagaaaatataggtaaatgttgtgatcatcttcaggtgcagaattagtctcaaaacatgataccactgccacacaaaaatgcagcacttccataaggtgccacatatcacaaattacgactgggaaaaatattcaaaatacatcagacacttagtactctacaagtacaaaaagctcttacgaataaggtaaaaatcctggagttgggcacagtgacacacacctgtaaccccagctgcttgggaggctgaggcaggaagatcgctcgaggccaggagttcaagactggcctaggcaacatagcaagaccccatctctactttttaaaaaaagatcccaatagaaaaaaaatgcaaagattaggaaaaggcaattaaccggatacatatgagtggctgatacatcaattctgccttgatggtaaccaagggaaagacatcacaacatgggatgctgtccagctaccaccggcagcatcagtaggaatgtgaactggccagcatggtcaggagagtctgtgatgagagtgtgcccctgacccagcagtttaatttctaggaatttatcctcggacttttagactaacatacaaagatgtatggagcacaatgttccttatagtgtttcttgtaaatgtaaataccaatcaacaggggattgtttaaatgagttgtagcaaatccacagaacagatgacacagacaataaaatacatacattatgttactggaacagaatgatctacaacatagctagaggagtttatacagcagcaaggctagtgcagagccattttcataagagtccatctgtataaatctgcacaaatgtatgcatgttaagttacttccaaaggggtagccaaattatcagcagtgctaggatttcaggtgatatttaatcctgctgttacatttattgatattattagaaatgtacagataacatatattttatgagaacaaaagagtaaaaaggagagtagattatataatcttacatatataatgtgatgccaattttgttcagaaaaggtatagatctaaattttttataaaacaaattgtaagattttttatttttattcttatttatttatttatttattttttggaaatgaagtcttgctccaggccgcggtgcagtggcatgcagtggtgtgatcttgcctcactgcactctctgcctcctgggttctagaaattctcctgcctcagcatcccatgtagctgggactacaggtgcacaccgccatgcccagttaattttttatattttagtagagacggggtttcaccatgttgcccaggctggcgtcgaactcctgagctcaggcaatctgcccgcctcggcctcccaaagtgctaagatgacaggtgtgagccaacgcgcccggccaagatttcttatatattttacatccaactggtttatctacagaggaatgttttctgactctgtgcctttgacacttccacaacaatattctgctcctcaataaggaaagcacacttgatcctgtcacgaacacacttagcacacacggaaccaccacaggccctgctgacatgtgtttctgttttagggaacctcacaagaacttcaggtctcatagcacgaactcctcgaagtctggctaggcacatgccacatgcaggttcaggtgttttcccaaccttcttgatgtaaaggtgaataattctcccaccaggggcttgggactacctagtttcactagaggctgcgtgtcaaaggctgggccattctgaatgccagctcaaaggactgtccctgggagctctaggctccctcaatggcagccaattgtaaaggaaataagtgttttattcttttttttattattataagttctgggttacatgtgcagaacgtgcagttttgttacacaggtatacacgtgccctggtggtttgttgcacccattaacccgtcacctacattaggtattttattctttaaatattctcataccacagtgaacatctaatcttttataataagaaggaaagagctgaggactttgatgtgtgacttggcaacgtcttcctgctgccctaactcaccctcatgccgggcattcctttctacgaacagggctttcccagctcacacgccaaagccttaggcctctaaatgggtttgaaagcatcacagtggcaggagacagcagaagcagactaaaaatggcagcctcctgtatcttgggaggtgctagagtagattttaggacatgaagatgtttagagagcagcacattcgtacctgcatagccactggaaaatcattctgtgcctctggaggaaaaaacacatctactgctttctttacaaaaggttggtttcccgctgcaggctgtccaacttcaatgatgtgcaactagaagagagattttaggtcaatcaaggggaccgcctgtggtggtgggcaagtgctagtcaaggcacagaggcaagtggagcctcagctccacacactggatgattaacgctaaaagtcacattcaaccaaagcagaacaacccccttgtcggagtgcctgtgattatccaataacctgctgcccaccaccaagcatggcacaaagggccaatgccaggcagcctggagcctcagttccagcacagtggcagagtcacttcccctccccgggcctggatgccgatgaaacaaagggctccagtcagaatctgctgtcccttccaactctgctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttttttttttttttttaagatggagtctcgctctgtcgctcaggctggagtgcagtggcgcgatctcagctcattgaaacctctgcctcccgggttcaagcgattctcgtgcctcagcctcccaagtagctgagattacagattacagatgcatgccaccacacccggctaaactttgtatttttagtagagatggggtttcgctatgttggccaggctggtctcaaactcccgaccccacctcgggtaatccaaccccacctcggcctcccaaaatgctgggattacaggcacgagccaccacgcccagccaccataactttcatctaaagaaaaaatattataactaacacaagtccacaacaaaatccaaaatgaagggtaagagacacaaaacaagggcgggaggctgggcttagaggacacagacaagggtgtctgtggaggggcagtctgggtttgcggtctgggtttggccgggcagagagaggagggaaacaccaaaggggctcagataaggaggggagcagcactgagagccgggccaatgggggaggctgagcggcaagcatgtgggtgctcctgtggggacagaagtctgtggatggggaatagaaaagtcttgcactgggagctttaaggcagataaaaggtagtttaggaaaattatctggctaggcctattggtaagaaggcgtgaagcaggtctgaggacctaataaatggctattctgtaacccaaatgtgaggtgagaaaggcttagtgtaccacaaaagggtaagtcagatgtgggacttgttaaaggtcagacagtgacgagagaatagaatggggcttgactgctatgggttcttgctcgggagctgagaagggtgacactgccagcaggagcagaggcacagaaaggacaccaggctctcagggcagcagcaggaggaggttggcagaaaagaactgtgtccaggcaagctccgccccacatgtggagacagctggccagtcccaaaaggacaggtgagtcctgaaaggaaggtgcatgcctgggcacaggcggggcgggcaccctcccaggaccccacacccaccctgcagccgggaggaccgagtctgccacaagacacagggccgctccaggacaggtactgtcaggaaaccgcatttcccaggctctctgggtcacagaagacctcctggtccatctccagctcggctggaggggcatgcccaccagaaagctaggtgtagagagaacccccagccccttctcttcttggggctgccgtctgtgtacagagccccgctctgggaagtgctcttctccacagggcactctgtgaggcaggctctgctcctcagagggaggcctgtcgctgccctgctgcatctgtaaaggagaggtgtgcctcactctgagggaatatgggagcaagctctttgagccacataactaaagtcagtgtccttcatcagcaacaaggctgacacgtgacccgagtccttttccttctggctctcaaatgaggagggcatgaagtatgttactcaacaggaggccaaagtattcagtgtatttcagatgaggaagtttgtaaagccacattctaattgagaactcctctgccttggggaatatttcggggctaacgaacaacccaaaattatggtttgagaaagtgtttttcacaagacgactgtcttgaagcagctctccaagtggctgagaccacaatggcggaacccaaggtctccctgacatcacaagctcttctgtctcctcacctctgcccatggcagccctgccgagcagccgctggccatgtccctgagcctaataaaacccactggctcctgggcacagtctcaatctctctggagcctccctgaggcgcctcccaaccacctgggaagaaccatgctaatggcaaggatggcaccacactggtgatttcacagtcatctccccaagagcagaaactgtgcctcatctaccttttttttttttttttttggagatggagtctcgctctgtcgcccaggctggagtgcagtggcgcgatctcggctcactgcaacctctgcctcctaggttcaagcaattctcctgcctcagcctcctgagtagctgggactacaagcgcacacagccaggcccggctaattttttatattttaatagagatggggtttcgctgtattgtccaggctggtgtagaactcctgagctcaggcaatccacccacctcggcctcccaaactgctaggattacaggtgtgagctaccgcacctggctgcctcacttacctttagagtgcatttcagtctagtctgtgtggaaggattttttttttttcttttgagacggagtctcactgtgtagcccaagcaggagtgtagtggtgcgatctcgactcactgcaacctctgccttgcaggtcccagttcaagcaattctcctacctcagcctcccaagtagctgggtttataagaatgcgccaccatgcccagttaatgtttgtatttttagtagagacggggtttcaccacgttggccaggctgttcttgaactcctgacctcgtgatccaccctcttcggcctcccaaagtgttggattacaggcgtgagccaccgcgcccagcctgaggattttttaggggaatggggccacttaatcatgtgcatcacggtgcacagttctcaacaccaccatgaacctttcctcacacagacatctgcaggccatgcccagccacacacacgcacacccctaacaccagctcatgacacttttctcagggagaagacagtagagtggatcttaccttgcctcctgtgggattacgtacagcaaagcagaaaagggtggcaggcttggcattcccctccatcttgaactctgcaaaagccgcagcatggccttctatgggttgtgaaaccttcctatccacagagtagagctgcattgctccaaccacacggttttgctaagaaaagatattatgcaatgaaagggagagaaaagagaggaatataaagaaacaattcttaaaatatatttctaaaatgaaagtctcatacattagaggtatacttcctctagtaaaaattaaatgtattagctattaaaggcatgatatcactctgaattttatgtggaaagatggcaaacactatggaaaaaaataagaccacaaaaaagtaagatggacaaacctaatttgttaaatatagtaagtgtgagagcattttttcatggaaagtaactcgtgcactttggaggaaaaactctaaagcattaatagtagttaaatcgggggatgcaatcacaggtaattttgaaaattgtgttttctgaaatttctaagtagcaaaaattgtatttaataaaaaccaataaggccagcacagtggctcacacctgcaatcctagcaccttgggagaatcacttgaggccgagagttcaagactagtctgggcaacatagcaagacgccatctctacaaaaaaataagaaaattagctggtcatggtggcatgcgcctgttgtcttagctactcgggaggccaaggcagggggattgcttgggccaagaagtttgaggttgcagtgagctatgactgcagcactgcactgcagcctgggtggcagagcaagactctgtctccaaaaaaaccaaaacccccaaaccagtaagactaatatcttttataaaacttagaacttgtattttctttctttctttcttttttttttttttttttgtgatggagtcttgctctgtcacccaggctggagtgcagtggcgtgatctcggctcactgcaagcttcgcctcctgggttcacgccattctcctgcctcagcctcctgagtagctgggactataggcgcccgccaccatgcctggctaattttttgtatttttagtagagacggggtttcaccatgttggccaggatggtctcgatatcctgacgtcgtgatctgcctgcctcagcctcccaaaatgctgggattacaggcttgagccaccatgcccagccagaacttatattttctactaaagaatttcagtacatttatatccaatgtcaaatgctcaaaaagctaagtgaatggaatacaaaagggtcccagttcaagctcctgtaattaaacattcaatcctctctgctgagtgagctcacatatagtcgtgggtaaaatcctcagtctattcctcactcactcacaactccttaaaatgggataacaaaggcttcaactttgtctttaaaaatattttctattgcacagatttctgttaacgttattaagcaaagtactgacacatgctaccacatggatgaaccttgaaaacatgctaaggaaagaagccaggcatgaaaggctgcatattgtctgattccacctatgaaatatccagaaaaggaaaatttattgagacagaaaatagattagtggttgccaaaggctggtaatagggagaaataaggagtaaaccagcagataagtggtctgtgttttaacagaaaaatgagcatggaaaggtaaaaatgagaatccaaagacaggacaaaactcaccctccccaagagactgtgggaagacttccagcaacatgatgatagcacatttgagtcctaaaggtacagatacctaaacgaagcctaaactgcagccaagacgaagaggcagagaagacagaacagccaaggtgaaggtgagagaccagaccttaggctacgtgtgtggccttgggccgatgtcctgcttctaagtcttaggcacctgccaggcttaccttcccacctcatggggctgctgagtgttaagtgtgtcaaattttggtaaaggcatgttaaggactgtagcaggcaaggattcaatgagcaaatgcattcattgtgccaggcaccatgctaggggccagggataagtaaaatatgacacaggtccttctctcaagaacagatggtaagagtttccggcaagtacacaagcaactgcaatacagagtgctgattgctacagcatgggagagaacaagatgccttatcagctcaccaagatcagtaagtcagggaggcttcccaaagtgacacctaagctggagtaagagctaaccaggtgacaggaacagaagttgtttcaaacagaaacaggcatctgtatttgcaaatgcttagacagggttggcaaactatggccccatgttcccctctccccctcctttttttttttttttttttttttgagacagagtctggctctctctcacccaggatggagtgcagtggcgtgacctcggctcaccacaacctccacctcctgggttcaaacgattctcctgcctcagcctcctgggtaactgggaccacaggcgcgtgcaagcatgcctggctaatttttgtctttttaatagagagggggtttcagtatgttggcctggctgatctcaaactcctgatctcatgatctgtccaccttggcttcccaaagtgctgggattacaggcgtaagccaccacacctggcttcccctcccctttttatgttgaggtgacattcacaaaacaaaatgaaccattttaaagtgtatgattgaatggcatttaggacactcgcaatgtgtggaaccaaaacctcatcatagttccaaaacattttcatcacccaaaagaaattcctgtgcccattagtcagtccccagtcccctgacccaagtcccctagcagccaccaatcctactttctagctccatagatttactgattctaaatatttcatataaatggaataacaataaaatatgaggccttttgtgcctcacttttttcatttagtaagtttttgaggtttacctatgtgtagcatgtatcagtacttcatttttagggttaaataatgtcccactgtatggatacaccacaacttgtttatccactcatttgctggtgaacatttgggctgtttctaccttttggttattataaaaaatgctattacgaatatctgtgtaaaagtttttgtgtggatacattttcatttctcttaggtagacacctaacagtggaactgctgggtcaaatggtaattctgtgtttaacttttttttattttttgagatggagtctccctctgtcatttaggctggagtgcagtggtgcgatcttggctcactgcaagctctgcctcccgggttcacgcaattctcctgcctcagcctcccaagtagctgggactacaggcgcctgccaccatgcccggctagtttttttgtatttttagtagagacagggtttcaccgtgttagccaggatggtcttgatctcctgacctcgtgatccacctgcctcagcctcccaaagtgctgggattacaggtgtgagccaccacgcctggccttatgtttaactttttgaggaaccaccaaactgctttccacagcatctgaacatttttatattcctaccactaatgtaggagggttccaatttctccataacattgccaacacttcttttcttttcttttttttgagatggagtttcgctcttgttgcccaggctggagtgcaatggcgcgatctcggctcacttcaacctctgccttccaggttcaagcaattctcctgcctcagcctccggagtagctgggattaaaggcatgcaccaccacacccggctaattttgtatttttactagagatggggtttctccatgttggtcaggctggtctcaaactcctgacctcagggccaacacttattttctactttgtaaaaattataaccattcgagtgggtgtaaagtggtacttcattgtggttttgaattgcattttcctaatggctaatgatgtcaagcaagtcatttgcccactttttaactgggttgactttttgttgttgagttgtaagtgttctttgtatatctggatactagacccttatcagatagatgattttcaaatattacatcccaggttgtcttttcactttattggcaatatccttttatgcacaaaagtttttaattctgaagtccaaattatctattttttaattttgttgttcaggcttttggtgctattatatatctaagaatccatgccaaatccaaagtcataaagctttctccttatgttttcttctaagagttttgtagttttaccttctacattgaggtttcagatctattttgagtttatttttgtacatggtgtgaggcaggtgaccaactccattcttttgcatgtggatatttagttgtcccagcaccattcctgaagagactattgtttcaccattgaacagtcttgacactctcatcaaaaatcaattggccacagatgtaggggtgtattcctggaccttacattttttcccattggtctacatgtctattcttatgcccatgaggtgttttgttgttggtaaatgcatgggatttttttatttgttgttttttagtttgtcagtaaagcatatacatgtaactatgatttataatttttgttttatattcttcaaacatgatgatttctttgtaaagaggcataattcccaagagtttttattttgttgttgttgttgtcatttgttttgttttgttttgtttttgaggcagagttccactcttgttgcccaggctggagtgcaatggtgtgatctcggctcactgcaacctctgcatcctgggttcaggcgattctcccgcctcagcctcccaagtagctgggattacaggcacatgccacaactctcggctaatttttgtatttttagtaaagacggggtttcaccacattggccaggctggtctcgaactcctgacttcaggtgatcctcctgccttggcctcccaaagtgctgggattaaaggtgtgagtcaccgtgcctggcccccaagggtatttttaaaagcttaattgagatataattcacataccatagaacttatctatttaaagcaagcttgtccaacatgtggcccagtatagccttgtatgtggcccaaacacaaattcataaactttcttaaagcattatgaacttttggctgggcatggtggctcacacctgtaatcccagcactttgggaggccgaggcaggcagatcacctgaggtcaggagttcgagaccagactgaccaacatggagaaaccccatcactactaaaaatacaaaattagccaggtgtggtggtgcatgcctgtagtcccagttattcaggaaggctgaggcagtagaatcgcttgaacccgggaggcggaggttgcggtgagccaagaccatgccactgcactccagcctgggcaacaagagcaaaactcggtctcaaaaaaaaaaaattatgaatttttttgcaatttttgtttttagctcatcagctattgctagtgtattttatgtgtgacccaagacaattcttcttccagtgtggcccaggggatccaaaagatcagacacccctggtttaaagcataccatccaatgtttcttcgtatactcagagggctgtgcaatcatcactacaacatagttttagaacactttcatcctttgaaagaaaccctattagcattcaatcctcattcctatctcccagactccacctccagtcataggcaactacttatctattttctgtgtctataggtcagactatcctgaacatttcaaataaatggaatcatatagtatgtggtcttttgtgactggcatctttcacttagcttaatatttccaaggttcattcatgatgtatttttagtagagatggggtttcgccatgttggccaggctggtcttgaaatcctgaccacagggtgatctgcctgcctcagcctccctcccaaagtgctgggattacaggcatgagccactgtgcctggcccttctaagagttttataggttcagttcttacatttaggtctgatcgattttgagttttttagtattatgagacagaggtcccatttaatgcttctgcatataaatgtccagcgccccaagaccttgtattgaacaactcctctttttttcactgaactgtcttggcaaccttgtcaaaaatcaattgaccacaagggatacaacactttgattagactggaggaataagttcaaatgatcatgcctataatcccagcactctgggaggccgaagcgggcggattacttgaggtcaggagtttgagaccatcctggctaacatggtgaaaccccatctctactaaaaatacaaaaattagcagtgcgtggtggcacgtgcctataatcccagctactcgggaagctgaggcaggaggattgcttgaacccgggaggtggaggttgcagtgagccgagattgtgccactgcactccagcctcagcgacagagcaagaccctgtctcaaaaaataaaaaaaattaaaattaagaaattaaaattaatgaatttttaaaatatatatttgcactctactgatattattttgattcagagaaatatgttcataacttattagaaataaccttgagtagtttgagaccagcctggccaacacggtgaaaccctgtctctactaaaaacacaaaaaaaattagccaggcatggtggtgcacatctataatcccagctacctggaaggctgagataggagaatcacttgaacccaggaggtggaggttgcagtgagccgagatcgcaccattgcactccagcctggacaacagagcaaggctctgtctcaaaagaaaagaaaaaaaaagaaataaccttgagtaaatttaaatttatttctaagttgatggtatggctaggttttgataatttttatttggtttcccttccctttaatcagaaaattaactttcataccctgttcacaaaccatcaaagctgattttgaaacttaaaaaaaaaatcgccaggtaccatgcaaaagcaatcttccctttagaatgactgatggtatgctaaggtttttcgtggcatattattattaaaggtgaatacaaataaatgggccgggcgcggtggctcacacctgtaatcccagaactttgggaggccgaggtgggcagatcacttgaggtcaggagttcaagaccagcctggccaacatgatgaaacactgtctctactaaaaacgcaaaaattagctgagcatagtggcacacacctgtagtcccagctactcgggtggctgaggcaggagaatcacttgaatctggaaggtggaggttgcagtgagctgagttcgtgccactgcactccagcctgggtgacagagtgagactctgtctcagaaaaacaaaaaaagaaaagaaaggaaaacaaaacctgttttttgggcacatcacttttctgggactcatctgttctttttttttttttttttttaattttagagacagggtcttgttctattgcccaggctggaatgcaaagacatgatcatggctcactgtaaccttgaactcctgggctcaagcaattctcctgcctgagcctcccacgtagccaggactacaggtgcatgccaccacaccaagctaatttgtttgtcatctattctcaagttagtaccacattctattttttttaacttttttaatttttttttagacaaggtctcactctgtcacccaggctggagtgtagtggtgcaatctcagttcactgtaacctccacctcccaggctcaagcaattctcccacctcagcctccagagtagctggaactacaggtgcatgccatcatgcctggctagtttttgcattttttgtaaaaaatgggttttgccatgttgcctaggctggtctcgaactcctgggctcaggttatccaccttcctcaacctcccaaagtgctgggattacaggcatgagtcactgagcccagctagtaccacattctggatcactgtaggtttgtggcaagttttaaaattgggaagtataagtactccaactttttatttgttttatggttgttttggctattctgggttccttgcaattccacataaattttaggatcatcttgccaacttctacaaagaagctagctggtattccaatagagattatgttgaatttgtagaccaatttgaggagtacttccatcctaaaagtattaaatcttcgagtccatgaacatgcaatatttttcgatttagatcttctttaattacttccaaacatgttttgtagttttcagaatgtaacttttgcactttttaaattaaatttacctctaagtattttattctttttgatgttattattaatgagattgctttcctgatttcatttttggattgttcgttgcaaatgtttaggaacacaattgatgtttgcaaactgatattgtattctgtaaccttgttcaatttgtttattagttctaatagttttttactagattccttaggatttccatatacaagcttatgtcatctgcaaatagagacagctttaattcttccatttaaatctagatgcctttttgttttgttttgtttctgagacggagtctcgctcttttgcccaggccggactgtggtggtgctatctcggtcactgcaagctccgcctcccgggttcatgccattctcctgcctcagcctcccgagtagctgggactacaggcgcccgccaccgtgcccggctaattttttgtatttttagtagagacggggtttcaccgtgttagccaggatggtctcaatctcctgacctcgtgatccgcccgccttggcctcccaaagtgctgggattacaggcgtgagccaccgtgcccagcctaaatctagatgccttttatgtttttctcacctaattgccctggctagaatctctagtccaaagctgaacagaagtagcaagagaagacatccttgtcttgtttctgatccttgggggaaagctttcagtttttcaacatgaagtaagatgttagttgtatttgttgtagatgccctttatcagggtgagtaagccaaagtcttaggtcttgtctcccctgtatatctgcaatgccactgccttcatctagtcacacatgcttcatatcttctgggggttgcagaaatggaacagagcgttccagaaatggaagtactccttccctgtttgcgtattcttaacctttctcatacatgtctctattccagaacagactacatggttttgttcctgtatctgcctttcaactagtctcctggcctccagtcttcatggtggtccatcttcaacatcaatgatagcattttttcaattccactatgctgctaagaaggaaaattaattacatcactctcactcaaaacctgctacataattcccattgcctgcagtctggcccccaatcatctctctaagtcttgcccctctagctacctaatatgcttacctataggtatcatccacggtgggtgaccccagactcccagaaagagccattctcctccattctgtgcctttgcatacactgtgtccttccaaagtgcactttaatagctagcaaaatgcatcttagatcccctgtgttgcaggctgtcttgacttaagctgctctctcatggctcccacagtattctcttcaaacatgtgacagttccttaattactagaattgtgcagatacaccttccccactaggctatagacaaatcattcactggtcatcaggattgaatgacgaagatctatgtcccaagtgcaaacatcctgtagtcctcaagtatctggtgactgaattagccaccaggaatgaaaaaaggggacgggcgcggtggctcacgcctgtaatcccagcactttgggaggccaaggcgggcggatcacgaggtcaggagatcaaggccatcctggctaacacggagaaaccccatctctactaaaaatacaaaaaattagccaggcatggtggtgggcgcctgtagtcccagctactggggaggctgaggcaggagaatggcatgaacccaggaggcagagcttgcagtgagccgagatcgcgccactgcactccagcttgggtgacagagtaagactccgtctcaaaaaaaaaaaaaaaaaaagggaggacaaaaagatactgctttcagtataatagaatatgagttagtaacattccagtaagtccttaaaatacagtctaagaactacttcttttttttcccataaaattaaatgctttttagtgtttcaaataagcagcatttacacagaagcagctctatgttaaccatctagatgctgggactttgatacaatacctacagtgcagacacacgggggccagagatgccaggaaggccgcgttgtgtgtgggccgtggtgtgtgcgggcagtgtgtgcaattaccaaggacaggccagctgaccgcccatttccccaagacctccctccctgcggcagctgtgcacatcggggccctttgaccccatgggccacggtccctccctgccctggctgggacgcagtgggcaggatgtctagccctctctcgtcttcccgaaggactacttcttataaaactatgggttccaaattactctataaaattcctcaacaacctctcaaaacagtgctagaaatagtttatacaatgaacatcagtaacctgaaggaatgcagtagtagttaataggccaaaggtaaattaagattatttgatccaagttcagatttctttgtaatctctatttctctcagttccaggcctacttttgccttatacctataaccaactttttttttttttgagacagggtcttgctctgttgcccaggctggagtgcagtggcgcaatcttggctcactgcaacctcaaacccctgacctcaagagatcctcccgcctcggcctcccaaagtgctgggattacaggcatgagccaccgcacctggccctataaccaacttctaatgatttaaccactccattctaatattgggctttgaagttacatcagaccagcccctaaaggcagctcaaggcttacctgagccgagatgcctacgagcagcagccacttctggtactcatcagtccggtagtgaatcacctggcagcccaccagactggtatgtctatcaaacatcttcatgggctgggagtcaccttccatgctccagtggtagaccgcggtctcggtcaccaaggcaacagtgttcacagaaacccatttccagaaaatcacttcttctgccatagtatgagccttcattttactcttcatctcaatattaaagatctgaagtgtcttcccagctagtatttgatataatagagattagagaaagacaaattaaaaatctgaaagacaaattcatatactcttaattctgaattcttttaatattactttaggttgtactgctaatctgattaacagggtctgaaagatgctgccagagtagtaattaagcataccttaatgtctaaatattgagaagagcctgtatgcattaaattcttcttcagaggaatgtaaaagtatgtaactattcatagaaatatgtgaataacaatgagaaattagttctactgaagcaagcctctcttttagattggtttcttctagttttaaaatacttttctggataactcagcaaaaacataagacaccccttctctgtgtggtctccaattttcaagaaagactacaactatcccttcacattaaaccaacttctccaaatttgtcttaaattctagaccaatgctgacaaatggaattttctacaatgttggatatattctatatttgtatccatcacagcagataatagctatatgtggctactaagcacttaagatgtatctagcaagatatttcaggaactgaatttatacttttatttaactttaattaatttaagtgttaaacagccccatgtagctaatgtccaatagggcagtacaattctagacaaaatatttggcatccattctctggcaagagatccatattgtttctacatgtagcaatgaactaaattttgattttggaattatacaaaatttagacctaacataaaatattaaaatattgcttcccacaaagattgggaacaaggcaaggattatttctctgaccacttgttttgatactgagaataacatagctggtgtgataaggcaagaaaaataaaaggcataaagatcaaaaaaggaagtaaagctgtcttaactcacagacaacataattatttacaaagaaaatcctgcagaatctacaaatctacaaaacaactattagaattaatagatgactacaggagtgcagcaagatgcaaagacaacctacaaaaatttcaattgggctgggcacagtggctcacacctgtattcccagcactttgggaggctgaggctggtggatctcttgaggtcaggagtttgagaccagtctggtcaacatggtgaaaccccatctctaccaaaaatacaaaaattagccgggcttggtggcagtcacctgtaattccagctacttgagaggctgaggcaggagaatcgcttgaacccaggaggcagaggttgcagtgagccaagatgatgccactgcactccagcctgggtgacaaagtgaaaacaggtctcaaaaaaaatcaactgaattttgagatactagcagcaaacaatttggaaatataaaaaagaattcaggccgggcatggtggctcacgcctgtaatcccagcactttgggaagctgaggcaggtagattaccggaggtcaggagttcaagaacagcctggccaacatggtgaaaccccgtctctactaaaaatacgaaaattagccgggcatggtggcacactcctgtaatcccagctactcgggaggctgaggcaggagaattgcttgagcctgggaggcggaggttgcagtgagccaaaattgtgccactgcactctagcctgaccgacagagtaagactctgtctcaaaaaaaaaaaaaaaaaaattcataccaccacccaaaacatagcattttggagtaaatttaacaaagggtaagcaaagtctctacactataaaatattcctgaaagaaagtaaaggcttaaataaaagaaggggcataccatgttcatggatcagaacacttaaaattgccaagatgtcatttccccataaattacgtacaggttcaatgcaatcccaatcaaaatcccagaatccttttccttctttctttctttctttttaatagatacagggcctcactttgtcacccaggctggagtacagtggagcaatcatagctcattgcaacctcaaattcctgggctcaagtgatcctcctgcctcagcctctcaagtagttgggactataggcatgcactgccacactcagctaatttttcttttttttttctttttcttttatcttttttttttttttttttttgagacacagtctctctctgttgcccaggctggagtgcagtggcatcatctcagctcaatgcagcctccacctcccaggttcaagtgattctcctgcctcagccccccgagtatcagggattacaggcacatgccatcacgcccacctaattttcgcatttttttgtagagatggggtttcaccatgttggccacgctggtctcaaactcttgacctcaagtgagtcgcctgcctcagcctcccaaagtgctgggattataggcgcgagccaccatgcccagtctaatttttaatttttttttttttttagagactaggtcttgctatgctgcccaggctggtctcaaactcctggcctcatgcaatccttccatctcagcctgtcgaagtgctgggataacaggtgtgagccaccaccctggcccagcatcttttgtttgcttggtggaaaataaaatgatgctataatgaatatggaaatgcagaggacaaagaatagacataacaaatttggaaaagagcaaagctggaagacttacaatacctaatgttgagatgtactataaagctattaataaaacctatgttattgtcataagacacatagatcaatgaaacagaagaaagtctagaaacagctgcatgcactgatttgataaaagtgcctcaaaaaactcaataggcccaaacacattttttataaaaatagaaaaatccattctaaaatgtatatggaacctcaaaggacctcaaatagccaaaataatcttgataaagatgaacaaggttggatgatctcacacttcctgaatttaaacctcattacaaagttaaagtaagcaaatgtatggtaacagcatagaaacacagacaccagtggaatataagagagaactcaaaaatgaaccttcacatatatgatcaaatgatctttgacaagggtactaagaccattcaatgagaaaaaagaatactcttttcaacaaataatactgggaaaactgggtccacaaaataataaaattggacccttaccttataccatatacaaaaagtaactcaaaatggattaaagacctaaacataaaaactaaaatcacaggcagaacctgagtcctgttctctcactttcctccccagacagcatgagtttcaccactcactccactaccttctctactaactaccagtccctgggatccgtccagccgcccagctacagtacccggttgatcagcagtccagccggcatctatgcagatgtaagggatttgggctcccagatctctgtgtcctgctccaccagtttccagggtggcttggggtccagggccctggccactgggatggccaggggtctggcaggaatagggggcatctagaatgagaaggagaccatgcaaagcctgaacgaccacctggcctcctacctggacagagtgaggagcctggagactgagaattagaggctggagagcaaaaaccgggagcacctggagaagaagagaccccaggtcagagactgggccattacttcaagaccactgagaagctgatggctcagatctttgcaaattctgtggacaatgccttcatcgttctgcacactgacaatgcccatcttgctgctgctgactttagagtcaagtatgagacagagctggccatgcaccagtttgtgaggagcgacatccatgggctctgcaaggtcactgatgacaccagtgtcactgggctgtagatgaagacaaagattgagactctcaaggagaagctgttcttcatgaagaaccatgaagagggagtaaaaggcctacaagcccgtattactagctttgggttgactgtggaggcagatgtccaaatatcaggaccttggcaagatcatggcagatatctgggcccaatatgacaagctgactcagaagaacctagagaagctggacaggtactgatcccagcagattgaggagagcaccacagtggtcatcacgcagtccaccgagatcagagctgctgagataacactcacagagctgagatgtccagtccagtccttggagattggcctggacttgatgagaaatctgaagatcagcttggagaacagcctaagggaggtggaggcctgctataccacgcagatggagcagctcaacagggtcctactgtacctggagtcggagctggcacagacctgggcagagggacagcgccaggcccaggagtacgaggcctggaacatccaggtcaatctggaggctgagatcaccacctaccaccgcctgctggaagatggggaggacttcaatcttggtgaggccctagacagcagcaactccatgcaaaccatccaaaagaccaccacctgcaggatagtggacggcaaagtggtgtttgagaccaacgacaccaaagttctgaggaattgagccagcagaagcagggtaccctttggggagcaggaggccagtaaaaagttcacaggttaaaaaaaaccccaacaattaaaatcataaaatgtttagagaaaacataggggaaaagcttgatgacattggatcttgcaatgatttttttggatatgacaataaaagaaaaaaaatgaattggacagcatcagaggtcacaaaagagagaaaaggcaacccacagaataagagaaaatataggcatacctcactttattacactttgttttattgtgtcttgcagatattgcacttgttttgttgttttgttttgtttgagacagcgtttcgctcttgttgcccaggctggagtgcaatggcatgatcttggctcactgccacctctgcctctcaggttcaagagattctcctgcctcagcctctgtagtagttgggattacaggcgcccaccaccatgcccgactaatttttgtatttttagtagagacggggttttaccatgttggccaggctggtctcgaactcctgacctcaggtgatctgcccgcctcggcctcccaaagtgctgggattacaggcgttttttttgttttgtgaacaacaacaacaaaaaaaatcaaaggtttgcggcaatcttccatcaagcaagtctattggtatcatttttccaacagcatgtgctcacttcctgtctctgggtcacactttggtaattctcatgatatttcaaactttttcattattatatttgttatactgctctgtgatcagtgatctttcatgttattacagtaattgttttgtgtcaccatgaaccacacacatataagatagtggacttaataaatgtgtgtgttctaactgctccactgactggccatgccctagtccctcttcctctcttcaggcctccttattccctgagacacaacaatattgaaattaggccatttaacaaccttccttgctaaaggaaagtgaaagtgaaaggaagagtcctacgtctctcactttaagtcaaaagttaggaatgattaggctttgtgaggaaggcatgtcaaaagccaaggcagactgaaggttaggtctcttgcaccagttagccaacttgtgaacacaaaggaaaagttatttaaggaaattaaaagtgctatttcagtgaacacattaatgataagaaaacaaacagccttactgctgatatggacaaagttgtagtggcctggatagaagatctaagcagccagaacaatcccttaagccaaagcctaatccacagcaaggccctaactctctgcaattccatgaaggctgagagaggtgaagaagttgcagaagtctgaagctagcagaggttgattcatgaggtttaatgaaagaagccatctccatagcataaaacggcaaggtgaagcagcaagttctgatgcagaagctgtgtcaagttctccagacgacctagctaagatcattgatgaacaaattttcaatggagaagaaacaacctcctactggaaaaagatgccatttaggactcaagcaagagagaagtcaatgcctggcttcaaagcttcagaagacaggttaactctcttgttaggggataatgcagctggtaactttaaatggaaggaatgctcaccgaccactccaaaaatcctaaggcccttaagaattatgctaaattgactgggcgcagtggctcacacctgtaatcccagcactttggaaggctgaggcaggcagatcacttgaggtcaggagttcgagatcagcctgaccaacgtggaaagaaaccccgtctctactaaaaatacaaaaaattagccgggcatggtggtgcatgcctgtaattccagctacttgggaggctgaggcaggagaatcccttgaactcgggaggtggaggttgcggtgagccaatatcgtgccactgcactccagcctgggcaacaagagtgaaactctgtctcaaaaaaaaaaaaaaaaaaaaaaaaagaattatgctaaatctcctctgcctgtgttctatgaatggaaaaacaagagtcgtgatgatagtacatctgtttacagcatgatttactgaatatttaaaactcactgttcagatctactgatcagaaaaaaaaaaaaaggttcctttcaaaagattactgctctttgacaatgcacctggtcacctaagagctctgacggagatatacaaggagatgaaagctgttttcatgcctgctaacacatcaattctgcaatccgtggatcaaagagtaatttcacctttcaagtcttattatttaagaaatgcattttttttttttttgagacggagtctttgctctgttgcccaggctggagtgcagtggcgtaatcttggctcactgcaagctccgcctcccgggttcacgccattctcctgcctcagcctccccagtagctgggactacaggcgcccaaccatgcccagctaatgtcttgtatttttaatagagaaggggtttcaccgtgttagccaggatggtctcgacctcctgaccttgtgatccacccgcctcagcctcccacagtgctgggattacaggcggaagccaccgtgcccagcctaagaaatacatttttaaaggctacagctgccataaatatgtctcctttgatggatctaggcgaagtaaattgataacctcctggaaaggattcaccattctagatgcaactaagaacattcgtgattcacgagaggagatcaaaatatcaatattaacaggaatttggaagaagtgtattccaaccctcatgaatgactttgtgaggttcaggacttcagtggaggaagtcattgcagatgtggtagaaacagcaagagaattagaagtggagcctgaagatgggactgaattgttgcaatctcaggatcaaacttgaacagatgagggctgcttcttagggatgaccaaagaaaggggtttcttccaatggaatctactcccagtgaagatgctgtgaacactgttgaaattactacaagaatttagaacagtacataaacttacctgataaagcagcaccagagtctgaaaggactgactccaattctggaagaagtctactgtgggtaaaatgttagcaaacagcattgcacgctacagagcaatctttcattaaaggaagagtcaatccctgcggaaacctcactgatgtctttttttaaaattatttattatttatttatttgttttttgagatggagtctcactctgttgccagactggagtgcagtggcgtgatcttggctcactgcaacctccacctcccggattcaagcgattctcctgcctcagcctcccaagtagctgggactacaggagcgtgccaccaggcccagctaatttttttgtatttttagtagagacggggtttcaccatgttggccaggatggtctcgatctcttgacctcatgatctgcctgcctcagcctcccaaagtgctgggattacaggcataagccaccgcacccagcctgatgtcttattttaagaaattgccagcctgtcgcggtggctcatgcctgtagtcccagcactttgggaggctgaggcaggtggatcacgaagtcaggagatggagaccatcctggctaatgtggtgaaaccccatctctactaaaaatacaaaaaattggctgggcttggtggcaggtgcctgtggtcccacctatttgggaggctgaggcaggagaatggcatgaacccgggaggcggagcttacagtgagccgagattgcactactgcactccagcctgggcaacagggtaagactctgtctcaaaaaaaaaaaaaaaattgccacagccactccagccttcagccaccaccactgtgatcaatcagcagccattggcatcaaggcaagaccctccaccagtaaaaagtttacaactcgcagctgggtacagtggctcatgcctgtaatcccagcactttgggaggctgaggccggcagatcacttgaggtcaggagttcgagatcagcctggccaacatggtgaaaccccatctctactaaaaatacaaaaattagctgggcgtggtcgcacgtgcttgtaatcccagctactcgggaggctgaggcaggaggatcccttaaccctggtaaacagaagttgcagagagttgagataacgccactgcactccagcctgggtgacagagagagactccatctttaaaaaaaaaaaaaaaaaagattacaactcactgaaggctgataatggtaagcaatttttaggaataaataaatagattattcatttatttatttatttattttgagacagagtctctctctgtaacccaggctgacatgcagtcatcagactcctgggctcaagatattctcccatctcagcctccttgagtaggtgagactacaggcgtgcaccaccacacccagaattttttttttttttttttgagctaaggtctcactgtattctttgccatgctgctcttgaattcttaggctcaagcgatcttcccaccttggcctctgaaagtactaggattagaggtatatgccaccatgcctggccataaattatttatttttatttttatttttattttttgagatggagtctcactctgtcacccaggctgaagtgcagtggcgcagtcttggctcactgcaacctctgcctcccgggttcacaccattctccgcctcagcctcttgacaggctgggactacaggcaaccgccaccacgcccagctaatttttgggttttgtatttttagtagagacagggtttcactgtgttagccaggatggtcttgatctcctgaccttgtgattctcctgcctcggcctcccaaagtgctgggattataggcgtgagccactgcacccagccaaattattttttaattaagataatccatttttttagacataatgctatttcacacttaatagattacagcatagtataaacataacttttatatgcactgggaaaccaaaaaattcatgtaactcactattgtaatattctttttattgtggtagtttggaattgaactcaaaatatcttcaaggtatgcctgtatatggaaatcatatatctgacaaggggttaatatccagaatatataaagaatgcctacaactcaacaacaaaaaacacaaatagtccagttaaaaaatgacccacgtggagtggttcacgcctgtaatcctagcgctttgggaagctgagacgggatgatcatgtgaggccaagagtttaagacagcctgggcaacatggcaagaccctgtctctacaaagaaaaaatgtttttaattagctggttgtagtggcgcatgcctatagtcctagctacttgggaggctgaggtaggaggatagcttgagtccaggagttcgaagttacagtctcttaaaaaaaaaaaaaaatggctaccattaaaaagaaaacaatacaaataacaagtgttagcaagaatgtgaaaaaattggaaccctgtgcactactgagaatataaaatagtgcaaccactatagaaaagagatggcagttcctcaaaaaaattaaaaatgaataatgatatgatccagtcaattacttgtgggtatagaattaaaaggattaaaaacaggttccccaaaagacatctgtacactcatgttaacagcggaattatttacagatctagctttttttgaggtactactatctctgaggtacacagctagaaaaaaagagttaatctgactatccagttagttagccaagctacgcaacaactgatattattacaatattatcatcaattagcaaaactggttttaaaccacaatttgagaaataaggctgctgttgctaacagaaagtctttaatgatatcatgatatacctgggcaataattaagatgatttcttgaattcacaaaaaggagcaactcaatggtgaaatttcatgcaatttttttttttttgagacagagtttcgcttttggggcccaagctggagtgcaatgggtcgatctaggttcattgcaacctccgcctcccggattcaagtgattgtcctccttcagcgtcccaagtagctgggattataggcatacaccaacatgcccagcaaatttttgtatttttagtagagacagggtttcaccatgttggccaggctggtctcaaactcctgacctcaggtgatccacctaccttgtgctcccaaagtgctgggattacaggtgtgagccaccgtgcccagccgaaatttgatacaatttatatccaaaacacatgatcagtaagataaaggcctgctgccataaaacagttctaaagttagctataactatattatcaacttaagtttaaactatataaatttataaaacaactgcttttggacataatttaggtgtgatgtagttttgctctctagtcaaaatggtaaatgttagaccctcactgtcttcaggcactaacagcttatggtaaatgacttctaatcagactgaactaagatgggagctcaaatccacaaaaagaaataaagagcactggatatgataaatatgttggttagtataaagatttctcttaatttcattaaataatatcatttaaaaccacaataaaactacaggttgttgagtttataacatatatagatgcatatatgcatcttattttctcttttttaatatattttatatattcatatatatgaatgataaaaatagcacaacagagggaggaggaaatgaagctatgctggagtgaaatttctgcattttaacagaagttaatattaataatctgaaatcatttgtgatgttaggatgcattttataaaccctacagcaaccaccataaaaatacacatacatacacaaaatagtaaaaagaaaaattcagaagaattaaaatggtatgctacattttaacaagaaaggcacagggtaggcagctgtgcgcatgttcctgaagcagcctatatacaccttgccagaagtagggtttttcaaaacaatcaagaaaactaacaaatcttatttatttatttttacagacagggtctcactctgttacctaggctggagtgcaatggcactatcccagctcactgtagccttgacataatgggcttaggatgatcctcaagcctcagacttctgagtagctggaaccacagacacgtactaccacactggctagttttttgtttttgttttttaatttgtagagatggagtctccctatgttgcccaggctggtcttgaacttctggtcccaagtgatcctgtcacttcagactcccaaagtgctgggattacaggtatgagccaccaggcctgacccaaaccttagttaatgatcaagaaaaaaacagaagacacaaattatcaaaattaagaatgaaagagggcaccactgccaaccccaaagaaattaaaagaagcgaatattatgaacaattttatgtcaacatactagaagacttagataacctggatacattcctagaaagacacaaattaccaaaactgacacaagaaaacagaaaatctgaacagattcacagcaagtaaggaagttgaatttgaaatttaaaatcttcccacaaagaaaaccccaggaccagaaggctttcactgttgaattctatcaaatactcaaagaagacagaaataagtccttcacagattctttcagaatatagaggaagaaggacctcattctctaaggccaacatttgcctaattacaaagtcacaaaaggacatcacaagaaaagaaaactatagaccaattataaaaataacagaaaacccttagaatattagtgaacaaaatccaacaacataaaaaaaccaccatacaccatgaccaaaagagatttaccacaggaatgcaaggttggcttaatagccaataattaatttatgtaatacaccacactaataaaggacacaaactatgtgatcatctcagtagacacagaaaatagaagggaacttctccaacttgataaaggatttatctaccccaaatccacagccaacatcatatttaattgtaaaaggctaaaaactcccccctaaggtcagaaataattcaacgatttctgttcttgtcacttctgtttaatactgtactgggtattctagccgatgcaatgttgaaacaaacagaatctggattagaaaggaagatgtaaaactgtctattcacagataacatgatacagtatgtagaaaatgccaaggaatccactaaaaactacaagaataagtttaataagtatataggatacagaaaaatatacaaaaattattttatttctatatactagcaagaaacaatccaaaaataaaactaagaaaataagtctgtatataataacataaaaaaagaataaaatacttgggaataaatttaacaaagaagtataggatttgctcactgaatatgcaaaacatcactgaaagaaattaaagatctaaataaacagagacattaaatgactagaagacttaatattgtcaagatagcaattcttaccaaattgataaattcaatgtaatctctatcaaagccccagaaggatttttgtaggaattcacaaactaaacccaaaatttatgtggcaattcaaaggatctcgtttcaaagagtttcaaaaactattttgaaaaacactaagttggagtaccaacactatctgacttccaaattaccataaagctacaactatcaagtaatcggtgcaagaatgggcacagatctgggtcgggcacagtggctcacacctgtaatcccaatactttgtgaggctgaggcaggtggattacctgaggtcaggagttcaagaccagcttggccaacatggggaaaccccatctctactaagcatacaaaaaactagccaggcatggtggcaggcacctgtaatcccagctacttggaaggctgaggcaggagaatcgcttgaacccaggaggcagaggttgcagtgagccaagattgcgcccctgcactccaggctgggtgagaagaacaagactctgtctcaaaaaaaaaaaaaattaaaactacaaaaccataggctaagcactcttagctatgactccaaaagcatgatccattaaagaaaaaaaaaataggtaagttgggctttatcaaaattagtaagttttgcccttcaaaacatatcctatggtttgaatgttttttgttctctccaaaatgcatgctgaaacttcatccccaagtgttgggagatggagccttttgggaggcaagccctcatgttctcacaaaagagcttgatggagggacttaggttcctttttgcccttctgtcacagtgttcctcccctccagaggatgcagcaacaggggccatcttggaagtggagtgtgaacccttaacagacacactatctggtagcatcttaatcttggacttcccagcctccagaactatgagaaataaatttctattctttatagatttcccagtgtcagccatttcattatagcagcacaaacagactaagacaagatgtcattaggagaatgaaaagacaaggtacagactgggagaaaatatatgtaaatcacatagctgataaactatgtatatccagaatatataaagaactcttataattcaataataagatggacaacacaattaagaactgggcaaatatttaaatagacatttctcagaaaatatatataaatggttaataatcatatttaaaaataaaagatatttaacataattaggcattagagaaatacaaattaaaactgcaaaatgctagtacacaaccactggaattgctataataaaaaagatagtatcaagtgttggcatggatgtgtggagaaactggcatcctcatacattgctgatgggtacataaaatgagacagtcactttggaaaacagttgggcagtttcttaaaaagctaaacagggccaggtgcagtggctcatgcctgtaattccagcaatttgggaggccaacgcaggtggatcacaaggtcagatcaagaccatcctggccaacatggtgaaacctcgtctctactaaaaatacaaaaattagccaggcgtggcggcacatacctgtagtcccagctactcgggaggctgaggcaggagaattgcttgaacccaggaggcagaggctgcagtgagccgcgatagcgccactgcactccagcctgggtgacagagcaagactcctcaaaaaaaaaaaaaaagaagaaaaaaagctaaacaggccggtagtggtggttcacgcctgtaatcccagcactttgggaggccaagggggtggatcatgaggtcaggacttcaagaccagcatggctgagatggtgaaaccccgtccctacaaaaaacacaaaaattagccaagcgcaatggcaggtgcctgtaatcccagctacttgggaggctgaggcaggagaatcacttgaacctgggcagcagaggttacagtgagccaatatcatgccattgcactccagcctggatgggcgatagagtgagactccatctgaaaaaaaaagctaaacaaatttatcatatgatccagcaattctactccacccaagagaaatgaaaatatatgtccacatgcacacatatgtttattgcagcactatttacaatagcaaagacatggaaccaacccaaatgcccatcagtgatggactggaaaatgtggtacatacacaccacggaatactatgcagccacaaaaagaaatgagatcatgtcctttgcagggacatggatgaagctggaagccatcatcctcagcaaactaacacaggaacagaaaaccaaacactgcatgttctcactcataagtgggagttgaacaagtgaacacatggacacagcgaggggaacaacacacaccaggcctgtcaggggagtggggggcgaagagagagagagcatcaggacaaagttaatgtatgcagggcttaaaacctagaggatgggttgataggggaagcaaactaccatggcacatgtatacctatgtaataaacctgcatgttctgcacatgtatcctggaacttaaagtaaaattaaaaaaaaaaaaaagaaattgcagaacaacaacaacaaagaaaatatgtccacacaaagacttgtcagtgagcattgatagcagcaatattcttaatagctaaaaactggaaacaatccaaatgtccatcaactggtgaatggaaaaacaaaatgtggcatatccatacaatgaaacactattagacaataaaaaggaacaaactactgatacatgttataacatggatggacctcaaaaacactatgctaggtaaaggaagccagatgtaaaagactacatattgtatgattccatttatttgaattgtctacaagaaagtctgttgaggaagaaagcagatgagttgctgcctcgggccgggagtaggagtgagaatggttctaaacaggcatgaggaaactttctggggttgcagacatgttccaaaactgtattgtagagatgattccacaactctatgaattcactaaaaatcaccgagaaggagtgaatgttggtcgggcacggtggctcatgcctgtaatcccagcactttgggaggctgaggcaggtggatcacaaagtcaagagatcgagaccatcctggctaacatggtgaaaccccgtctctactaaaaatacaaaaaattagctgggtgtgatggtgggcacctgtagtcccagctactcaggaggctgaggcaggagaatggtgtgaacccgggaggcagaggttgcagtgagccaagaccatgccactgcactccagcctgggcaacagagcgagactccaactcaaaaaaaaaaaaaaaaaaagaataagtgaatgttatggtatgtaaattatacttgaaaaaagcagacaaagaaagatataaaaaaaaaatctggaccaaaaattcttggtggtacgctgtcaggatgggggtaccttttagtgtcaagcagccttagatcacagaggaaatttcttctagcttgaaaacttgtcaagttgtccttagcctggtttaaatgaacatgtgtttatgaggcacaaaatattcagcatcactaaaaggaccaaaaaaggaccagccttctttgggaaatacttcaggtcagacttaagtagtctaggtgaggagggggcctccagggggtgccattccccctcttctatcccccactgagctcagtgccaactctgccgcacagatactagattagcctatactccatctacttctaaaaattaagagaaaaaaggtaaagtttgtaaaaagagatacatataaatactgaaaaggtaatgtgatatggtttggttctgtgtccccactcaaatctcatctcaagttgtagttcccagtgttggagagggacctggtgggaggtgactggatcatggaggcagatttcccccttgctgttctggtgatagtgagtgagttctcacgagatctgatgggtataagtgtgtgtgtggctactctggacacactgcctgtgggttagccctgctctgcaaggagcagttaaaaaaaagtgtgtgtgtatggcactcccccttttgttctctctctactgctccgctacggtaagacatgcttgcttccccttcaccttctgccatgattataagtttcctcaggcctcctagccaagcttcctatatagcctatggaactgtgagtcaattcaacctcttttcttcataaattatcctgtctcaggtagttctttatagcactgtgagaacggaccaacacacaatgtttcataataaaattgacaatatcacacctgggccagtaatgcaaggtatctgccaactttccctataaaaggacataaaagacctctgtctgttttgttttgttttgtttttacaactcctcataaaaaccattcttggccaattgaggtggctcacatcagtagtctcaggactttggaaggctgaggtgagaggatcattttaggccaggagtttgagatcagcctgggcaacatagtcagataccatctctacaaaaaatgtttaaacattagctgggcatggtggcatgtgcctgtagtcctagctacttcagaggctgacgcaggaggatcgtttgagcccaggagttcaaggctacagtgagccatgatcacatcactgcattcctgcctggatgacagagagagacctgatcttaaaacaaacaaataaaaaacattcctagttcaggagcaaaaagcagaccgtttgccaatccctcagttaaggtgttccactaaaatcacaagcaacagatgagtaattctgccaccacttcatgctctttaagtcaaaggcaaaatgtatctggttttaaagaattcaccacaaatccgtcagcaaagaaagtatgaacagagactgggtactgggtaagtgaatctgctccaggcttctccagaaagccgggcaatgacgtgggctgagtatctctgagcacttgggagttcacggccaggcatgaggacaggctgcaatggtgtcccttttaatttttttttgagacagagtttcgctcttttttgtttgtttgtttgagacagagtttcgctcttgttgcccaggctagagtgcaatagcacgatcttggctcactgcaacttctgcctcctgggttcaagtgattctcccgcctcagcctcccgagtaactgagattacaggtgcacgccaccacgcccagctaatttttgtatttttagtagagaggaggttactccacgttcgtcaggctggtctcgaactcccgacctccaggtgatctgcctgcctcggcctcccaaagtgttgggattacaggcgtgagccaccacgcccggccttaatttaatttaatattatttttagggacagggtcttgctctgtcacccaggctggaatgcagtggcacgataatagctcactacaacttcgaactcctgggctcaagtaattctccagccttggcctcccaaagcactgggattacagacatgagccacctggcctagccctttttgtaaagggaggtccgagagctgcttcacgagcccctttccaatcacaaaacttcaccagccaaaatgggaaaaatctgtgagatacaaggtgcagcacccccccacacaccctgtatttctgcactggatcctagaagctagtcaaggtgtgtgatatggcagaggactctgaggagctcacttacaaatcaatcatctccatcaaccaatcactatacaaacaactctttcttcaaagacagtttgctcattttggtgtagggccttgaaaacacactgtacatcctccacttgtcaacgatttgtactacaatgatctgagattttactgctacagaattagcagtaaaaataagataaagccttaaaattatgtccctttttggttccagagtcttacacttcccccacggaaaagaaaacaagactcaacatgttatagttgaagtgatctatatgaccattaagaacgaaaataaaaagcagcagcccctgccacctggaagctggcctggcaatcacagcaaggccatgctgctctcctgatggacataaaccaccttggagaacaccagcctcaggcaagggccctctgagaccacgatcaagtgagacacagcaagcacagaaaaaacaaggttactgcgcaactcacaaaataccaacacgcctctctttcagctaaaatgagtgactgctacttctttacccattatagctttaatctcactctagtcttccctccctaatagatgaaatttattgagatacgcaatcataaaaattacccccacttgctgccaacatccaatctacagcaaacccctgcttccttagactaccccctaaatcatccaaccaaagcccaaatcctataaaaggctctaacaccttcttactgagacactccccagttccccatggcgtgtgttctctcccactgcaacagtaaacccaccttcttcaactgcaagtgtgttcctggtggtctttggctggaagggattgacaacatctaactattgcgttctctttactccccgactccacaccacaacacacacacacacaccctaggagctccgcactgcacattgttaaagagaactgtaccagaaaaccaggaagattaaaatgcagatcatttctgagacctgctgaaaacactaaacagcaaacaaaaccgcaaacaacatgctaaataaggcctctcaaaagtactacaacaaggctgggtacagtggctcatgcctataatccaagcactttgagaggccaaggcaggaggatcacttgaggccaggagctcaagaccagcctgaacaacatggtgggacccccttctctacaaatatttttttaagtactacaacaacataaaatgcagaaaagggcgacactgcaaggcaaatattccatcaaaaagagccaaggggtaagtgacaaagtaagagacagataaaagcatcattaatatcccataattgtaataatttctaaccaaaatcatttatactgcttacactatatgttcaaataattactttgacaagattacaagggaaaaggtagggttggtaatagaacaaagatcctttcaaataaaagaatttcagttatttctttttaaatagaaaggtcttaactttcagatgtccttctacctactgaaatgaccaagtagacactatttctgtaataaaatagaagcctaggcaaagctaatatttggcattcacaaattttacctccagaaacagtttttgcttttctttgtttcttttttttttttttttgagaccgatttttgctcttgttgtccaggctggagtgcaatggcgcgatctctgctcaccgcaacctccacctcctgggttcaagagattctcctcagccttcctgaggagctgggattacaggcatgcgccaccacgcccagctaattttttgtatttttaatagagatggggtttctccatgttggtcaggctagtcttcgaactcccaacctcaggtgatctgcctgcctcggcctcccaaagtgctgggattacaggcatgagtcactgcgcccggcccagtttttgcttttcaaagtaagtgatactgcatttcacacaaaacattaagtctactgcatacataatccttttatttgccaaatgaaggcaatataagaagattctatatttttcaagataactagaaggctttaagcacccaagactccctgatttcaaggaagtaaaattctattaattatcagctcctctatcattgatgtgtttcacaggaggaaaacccccgagcctgtgtcgtcggatgaccggaagcaccactgcagcaggccctcaggcaagggggccacacagccttcctgggaaacatgcacagtgctgttgtgcgttcctagtcgcatgaagacaaaggcctgggcattttcttcctctcggtgtgtctggcgctgtgggtgatgttaccaagaagctctggtgctcaggggcctcttactagggcacactaaacataacttttgctaaaacttttggaattaagtggaatactattgaggagcacttcgccatgagcttagtgacacttgttcaatatttaaggtaacaaagcagttaaaatgaggtaagattcctttctaacaatcccatcgggtttacctttcagagctatcaccttagaggctggattcatgatggcactctctgcagagataggccgtcggatcggagccattgggtcactcatgtcaatgatcgtgacctgtgcctgctcaccaactttctctcggatacatatgaacttgtcagattccatggtcagtgtgctgaatccaatgttagctggattaattccaaggttttggagctaaacagaaaaaaagcatttgattaaatttttttcctctgaaatggactgactgtagccaaaggcaaaagaggagaagttaaataaaatttagaaaaaagttaacattaggtaaacacttgaaggaaacattagcttgcttttctacgcctgtaatagatccacccaagcctgtgaatcaactctccttgagagattaccagcccacagtggagataagacatgtgcaggatgacactaggcagtgtcaaggacgccacaagtgatacagacaggaggagatgagttgggggtgaactcccaaagaacaccatcagataaggtgtcacagataagcccaccaccgaggagagctttgggaggaaggaggtcttggagaggtgaaggcgagggaagtggaagggaaaaagggaggaaacacaaaacctgatttctccaaaaggcaagaaaaaagaactggccaaaagtttttgcttaaacatttccctagatatcatcaaacctgtctacatctgacttgaatgaatttctaagtcagtgtgaatacttcctggagagtctggggttaataagaaagtcagcaggtttggcacatcttccagggccgatggactgctactactgtgtaaactgaaaccaagcacctttctccaaaggccatcttatacgcagtgcctgggctaaatcaagacctgctaatgggataagcttcagtgaaaaactctgggaaaacacatactcaataaatgtttatcactcccacaaagcaccaagcttatttctataaatttctctgctctgacctacctacaagacacctttatttacttatttacttatttatttatttattttttgagccggagtctcgctctgttgcccaggctggagtgcagtggtgcgatctcggctcactgcaagctccgcctcccgggttcacgccattctcctgcctcagcctcccaagtagctggggcttcaggcgcccgccaccacgcctggctattttttgtatttttttttagtagagacggggtttcaccgtgttagccaggatggtctcaatctcctgacctcgtgatccgccctccttggcctcccaaagcgctgggattacaggcgtgagccaccgcgtctggtcgacacctttatttttaaacactgttctgttcagccccaattctactgctactgattggaccacttaacatctgttaccttgtgtaaccttgaagaggctcacactagcaacaaagatcatggaccgctgcattaaaattgcaccaccctttggaaggaacacaagtgagactgttcatactgagagtataattcaggacggtgccttgtttgtcttttgtagcagagtctagcacatactggatgttccagctgctgagtggagcaggctacaggacaacaagtcacctcatctcatcttcctgttaacccactgagacaagcatctcacacacactttacacttgggaaaaacaaagtgttggggttaagaaatctttcagaaattacaaagctgattaatgatggagccaggtataataaagcctgtgttctgaccacaatactgagttgtttgaaattcatattccattttaacacagaaaagataaactaagtggtgattatgttcccaaatgagtccaccaaaacaaacaaaaacacatataacagcaaaaaaacaaaacattacttcataactgtagtgaaatagttttttaaaaaatagaacttgccaattgatattgccattattacaagaaagtcccttcatgttccaacgttgggttatagcaaggaaaataatgctaggagtggtttattaagcataggaaaaacctaagtatttttcctgttctcacacatcactcaacacaagactgccaacgccagatgtgggggggtttctccagcagacaccacctagttatcctacaatttaattcaattctgacaatatctacctggaaatagtatcagatcccacaggttgagggctcagtcccataagactgactacacttcagacactaatcgcaagccccaggctgtggcctgtacttctgaccatccagctataaagcagggttcccatgaccttcttcctgggtttgactaatttgttggagtggctaacagaactcaaggaaacacgtttctcatttattacaagggatattacaaaggatactgatgaaccgccagatggaagaggcgcatagagaaaggcgcgaggggtgtccttgcctctcccagcacaccgctcttcagggacctccatgtgttcagctatcatggagctcccgacatctatctacacatcagcaccacattattttatttatggaggttttgtaacatctggtagggcctgccgtcctcagcacttgttacttttggaattttcttaggtattatattgcttaacattttgtaagtctaaaaaaaaattcaagccccaaaataagaacatgggggtcatttgtggcaggcgaagtcatgaaactggacggaagcaccaagagagaccgtgaaaagtgagagaatggtttggaagcccagggcacagagccccaggacacaccaaggcttagaaggcaggcagaagagcagcccatgaagatggacataatttacttaagtaaagttaacatatttaagtaaaccaagaataaaagataacagaagccccataagcacaaccactgatacttagtaaaccaggaaaccacattatcacaaccaaagaaaacctcccagtctcaccacctttttcacaaatgagccatgttcaaattccatcatcctctcctagtttagttccctgctggcttatacaacaacatccaaggtcataaattcctggaggacacagatcagattagtggggtttttgttttgctttgtttttgagacggagtctagccctgtcccccaggctggagtgcagtggcgtgatctcggctcactgcaacatccacctcccgggttcaagcgattctccagcctcagcctcctgggtagctgggattacaggcactcaccaccacgcccagctattttttgtatttttagtagagacggggtttcaccatgttggccaggctggtctcgaactcctgacttgtggtgatccacctgccttggcctcccaaagtgctgggattacaggcttgagccaccacaactggatagattagtgttatttactctgtctgcaattaatagaaaaatcctgaaaaatagaataatataaatgccctagaagttacagtatttatgtatttatgtatttatttatttatttgagacagtctcgctgcgacgcccatcctggagtgcaatggcacaatcttggttcactgcaacctccgcttcccgagttccagcaattctcctgcctcaccctcccgagtagctgggactacaggcatgcgccaccacgctcggctgatttttgtaatttttagtagagatggggtttcaccatattagctaggctggtctcgaactcctgacctcaagtaatttgcctgccttggcctcccaaagtgctaggatttacaatatttattaacaaaacagaggacagtgggattccagaagataagactgctgcatctgaggtttcccctccaaattctacaacattatccatcagatttgtgagccctttgaaaagaaaaacatgaatacctgcaatcaatatgggctcactaagaagtcatgccaaaccaatctaattttcttgaagccaagtaaatgtgatagaataaatcttcatttcagcaaagtatctggcttacctctgctgaggtagccaaagtaactttcacggataatcagtcccctaccccaagccttttatctgtggcatgcttatagaatagagagctttgcgctttgtgttagttattcatatttacttaatctcttgtttcttctcagagtcaaattcattttgaatccatcaaaacatttagcacataaaagcccaaacaatgtatgaaacaaaagactcttggaatgaggtagaaaagcatgaggtgagcttgtgtccacagctgaactgcacctcagtggtgctggccacatggatctgtctgtctgctgccagggcccagagctctgaccttaatcacctgctagtcaatattctgaataatgactctaaccaaagtcatatacagggactgttttatcggctaaggttatgctttgagactgtcaatatactagagtaacaatcagaatcttaacagatttgaaaggactatgaaattaaaaagataaatgtacacaaataaaatacatttgtgttaagtataaaaaaaagatcaaagcttgcttcaaaaagcagctctaatacataaaatgtcaaccaaatgcaatgcataggccttctttggatgctgattcaaataaagcatttgaaacaaatagagaaacaacactgacaagatactggatgatactgagaaactactgattttttttttttaggtgtgatgttattagagttaaaaaataaagaattattagtgtatatcaatggatgaatagataagcaaaatgtgttatacacatgcaataggagtattattcagccttaaaaaggaaggaaattctgacacatgctacaacatgaatgaaccttgaggtcattatgctaagtaaaaaaaaaccaaggtctggtgagatggctcacgcctgtaattccagcactttgggaggctgaggcgggtgggtcgcttgaggtcaggagatcgagaccagcctggccaacacggtgaaaccctgtctctatcaaaaatacaaaaattagccaggcatagtggcgggcgcctgtaatcccagctacttgggaggcggaggcaggagaatcacctgaacccaggaggtggaggttgcagtgtgctgagattgtgccactgtactccagcctgggcaacagagcgagactccatctcaaaaaaaaaaaaaaaaaaaaagacagtcacacaaaaagacaaatattgtatgattccatttatatccagtatgtagaagagtcaaatctatagagacaaaaagtagatggggttggggggaggagtgtgaatggggagtcatttcttaacaggtatggagcacccattttacaagatgaaaagagttgtgggccgggcgcggcggctcacacctgtaatcccagcactctgggaggccgaggcgggcagatcacgaggtcaggagatcgagaccatcctggctaacacagtgaaaccctgtctctactaaaaaaaaatacaaaaaaattagccaggcatggtggtgggtgcctgtagtcccagctactcaggaggctgaggcaggagaatggcgtgaacccaggaggcagagcttgcagtgagccgagattgcaccactgcactctagcctgggcgacagagcgagaccctgtctcaaaaaaaaaaaaaaaaagaaaagagttttggagatggatggtggtgatggctgcataacaatttgaatgtacttaatatcgctaaaatatacacctaaaaatggttaagatgataaattttatgttatgtatattttaccacaattttaaaacttggaaaaaaataacaaagagttctctcttggtgacacatcctaaagtgtttaaggataaaacaagatgtctggaattggcctcaataaaatttggcagtgatcggagacgtaagtaaatcaaagctggccacgtattggtaagcaatcattcttggtcttgtctacctatctggattttccggctttagcaggataggactggatgctctccagacagagcagtgcactgaagtgggcctgggttttctaaattgtccttttgttctcagtttggggatcgatgttgggttaatacggtgacattctgatttcaactccaaataccaagaattggtaatcctgaataatttgtatccaatctcttgagcatagtgggttcttaaataatagtagctgagtcaagttccttatctaagagcatacatacacatgtatggcatttgaaaaaggtaaaagtccctcacaaataagacagtgttttaacaactgagaagagtggatccaaaaataagataaagactattagaatcagattaaattaagacagtagttctcaaccaggagtgctattctgcattcttcagaaatgggaaaggggcggccgggcacggtggctcacgcctataatcctagcactttgggaggtcgaggtgggcagatcataaggtcaagagatggagaccatcctggccaatatggtgaaaccccgtctctactaaaaacacaaaaattagccaggcatggtggcgtgcacctgtagtctcagctactcgggaggctgaggcaggagaattgcttcaacccaggaggcggaggctgcagtgagccaagatcgcgccactgcactccagcctggcgacagagccaagactccgtctcaaaaaaaaaaaaagaaataggcaatgggttcgggcgcagtgggtcacgcttgtaatcccagcactttgggaggccaagacgggtggatcacttgagatcaggagttcaagaccagcctggccaacatggtgaaaccccgtctccactaaaaatacaaaaattagctaggcctggtggcatgtgcctgtaatcccagctactcaggaggccgaggcaggagaacccaggaggtggaggctgcagcaagccaggatcactccactgcactccagcctgggcgacagagcgagactctgtctcaaaaaaaaaaaaagaaaaagaaaaagaaaaaaagaaatgggcaagggtagttttaatagtacaatgagtggggaactcattctctactcatttagccaggaatgctcaatacaggacaatcccacaaaaataacttttccatctaagatgccagatactactgtgagtttttctccatacgcaggaactaagtcccagaaaagtgatgtgctgaaaagccaggttttttctttctttctttccttttttttttttttttagacagagtcttactctgtcacccaggctggagtgcagtggtggcaccatctcggctcattgcaacctctgcctccccagttcaagtgattctccagcctcagcctcccaagtagctgggactacaagtgcccactaccacgcctggctaattttcatattttcagtagagacggggtttcaccacattggccagactggtctcaaactcctgacttcaagtgatccacccgcctcggcctcccaaagtgctgggattataggcgtgagccacagggcctggcccaggtttgttttttttttcactagttagtagaaataaccaaggattcctgatccctagtatattattctgataggtaacctagctacacatttttaaaaaaattttctttctttttttctttcttttgagacagagtcttgctctgtcgccaaggctggagtgcagtggtgcaatcttggcttactgcaaagtctgcctcccacactcaaccgattctcatgcctcagcctcccaagtagctgggaatacaggtgtccgccactgcacctggctaatttttgtatttttagtagagacagggttttgccatgttggccaggctggtcttgaactcctggtctcaagtgatccactttcctcggcctcccaaagtgctgagattacaggcatgcaccactgcactggaccttagctacacattttaaatggcatatataagatttaactaaagaaaggtaaagaagatgctgtctaatgatccttttcagttctcaaagcctgcaattaaatcaatcaaaattcaaatctgacaatgggggccagacatggtggctcatgcctgtaatcccagcactttgggaggccgaggcgggtagatcactggaggtcaggaattcgagaccagcctggtcaacatggtgaagccctgtctctagtaaaaataaaaaacttagctgagcatggtggcacacgcctgtggtcccagctactcaggaggctgaggaacaagaatcgcttgaaaccaggaggcagaggctggaatgagccaagattgtgccactgcactccagcctgggtgacagagacagaccctgtctcaaaaaaaaaaaaaaaaaaaaatctgacactggggaatatgcaaaaagaaattactcatctgatagtcctgtggtttctatgtataaggggcttaaggaagatgtctgcctgggaggactacaactgtgtttgtacaagagtattagtgagaacatcaactgcctacatcagtgaagccagaatgcttaagttgcactgaacatccccatgttttcacacctatgtggacaccaatattttttctttctgtatctgtctccttcccagtctcactcactgctttatccttgtgcctagcatatggatggtaaacaaatagtaaaacaaattacttgtttcagggcagtaaaatttagttcatctacagtttttaaaacatactttgagggcctggcgtggctgctcacgcctgtaataccagcactttgggaggccgaggcgggtggatcacctgaggtcaggagttggagaccagcctggccaacataatgaaaccccatctctataaaaatacaaaaatcagctgggtgtggtggcgggcacctataatcccagctacctgggaggctgaaacaggagaatcacttgaacacgggaagcggaggctgcagtgagccaagaccacgccattgcattccagcctgggcaacaagagtgaaactctgtttcaaaaaaataaatgggctgggtgcagtggctcacacctgtaatcccagcactttgggaggctgaggtgggcggatcacgaggtcaagagattaagaccatcctggccaacatggtgaaaccccatctctactaaaaatacaaaaattagccaggcatggtggcacgcacctgtagtccgagctactcaggaggctgaagccaggagaatcgcttgaaccggggaggcagaggctgcagtgagctgagatcatgccactgcactccagcctggtggacagagcgagactctgtctcaagaaaataaaataaaaaacacattttatatttgaaacacgctgggcgcggtggctcacgcctgtaatcccagcactttgggaggccgaggcaggcggatcacaaggtcaggagatcgagaccatccttgctaacacggtgaaaccctgtctctactaaaaatataaaaaattagctggacgtggtggtgggtgcctgtagtcccagctactcgggaggctgaggcaggagaatggcgtgaaccctggaggcagaggttgcagtgagccgagattgtgccactgcactccagcctgggcaacagaacaagactccatcttaaaaaaaagaaaaagaaaaagaaaaagaaacttaccaaagagcctttcctagcctaaagagggagctctgtaaatgagggcctatgaagaatgttgacactaaggtctcttccagaacttacattccaggagtaggttagttcagggatagttaactacatttatataatgctttacagaacttctctcaaattacactattacaggttttctttattttaacaccagtgcacaagactctatatttatcccagttaaatgtcaactagctggattctggcctgtcaagatatatccgattctaatttcatcactgaactttgctatcccagctttgtggcatccttcttcagcctgccaagagtgatggtcatctctctggcatggaggccagcagcaggcctcaagagaagtggaagaaaatgtgggagaagagcctgcaaactcagtaaagtctcagtgaagaagcaaaggaaggaaaaatcagacagattgcagaaagattcccccttagagaagggggtgacagggtgccagcaactactaccctagggaatactgataaacaacatgtcagatagatgcagtgatctgtctgtgatcctatgggaggatcttcagtgtgttaagttacaaaagcaaagggcagaagcatatttaaagcaggattcttttgaacatttttggaaggatatggtggcttcgtttatagtggtttcccctggggagagacagacagaggctgaactgaaagattttaattcccatcagactagcccctgcaacagaaatatctcagcagagaggaaccttgactcagatcctcctaggacttaattctttcaacccaaccaactaaaaaagcactggtttgtgtagcttaggcattctgaacatttaaatgttctatggtgaagatctgtttttccaaagagtccccattcaaattcatttactctttggtcacccacaatgccacagcggtaggtactcccacaaggctcaccctcgcagacaccctggctgaggcaggttactctccttgctttgtaaataaacaagtcagaaggcaactaactggccagtatgtatttccaataccagaagcagtggtaggccaacaggcaaaatttaacagtttacatggtatcttaaaatgacattttacatgggatgcaataattttaggatgcaatgagccaactgctgtcttagtacatcaaaaaccacttcacaaaatgagatagctacataatggcaacataaaccaaatatggactggattactatgggtacgtgtccctttttggagcatgacccccagaagcctctccagacacacacgggtgtgtgtggatgggaactgttttcagttcaagctcaatctacaccttcacagttttactttcccccctctttccttaatgattaatattgactaacatgtagaaggctgtttcacctgggctgtgtgtaagactcacctgggaaggaataccaaagctccatctccaccactcagagctttggatttaacatccagcagaaatatgtttaaggctgcaggccattctcacatgcagcctaggtagagaagcactgattaagatcttgaccatctttctcctacaattctaatgctcaaggtctctacacctgtttcaaacaccgcctcagagacactttgagggaacatgtttacgttttctgtgtattgagctatgacacatttcacagcttacaaacttggagctgcttttttgatatagctggggggaattacttagggctcaagaaaatttttatgtcaccaaactattcagccattcctcttctgaatcaagatgtcttaagtgctcagcccatcctcagatattacaaacagcaatacccttccaactctcacatttgaatatttctaaaaagttcaaatggtagctccctgagctcacaatccagcagagaaaatgaacagctacagtaccctgggaagagtgtcattataagaggaaccccaaagaggcacagaggaagaactcctaactgacaaatcagggagagcttccagagacagcgtcatttccacagataccagaaggctcagtaggagtcagtgagtaaagaggggtgagaggagaatgtgttttggcaaggacacaaagggagcggcagcagagttgagcaggtgttgggctgggaagaacaggaaagagcacgtggggatcagtcttttcatgccagaggaaacacgaaaccactccctgaaggactttaagcagatgctcatccttggagatcatgttgcctgtgtgctggagaatggatcacaggagggcaagactagaagtagaaggacaaagctagcatgaccatcaaggtggggagggatggcatagtttagggaaacggtagtcatgatgacagtggcagaacgatgccaaaagtaaacaggagaaagggacaacaggatggggaaaacacatcccaggctcctggctggacactggacaagatacacatctggggagaaagggaaccccatttatgaacactgtgtttgaggaacctgctgaccatttcctggccttcttcagtaggcagctgtcacaatggcagcaacagctcacaaggacacagtgctttacagtagtcccttcttatccgtggtttttttcacactgttacctatagtctgaaaatattaaatgtaagaccccagaaataaacaattcataagttttaaattgcataccattctgcagagtgatgaaatcttgcaccagcccacccaggacgtgaattatccctcctctgcccagcatatccacgctgtagacattgccagcccattagtcacttagtagcggtcagttaccaggttgactgttgcagcatcacagagtttgtgttcaagtaacccttaatttacttaataatggccccaaagtccaacagtagtgatgctggcatattgttattattgttctgttttattattagttatcattgttaatctcttactgtgcttaacataaattcagctttatcatacatatgtatgcatagggaaaaaaagtgtataaagggttcagaacaatctgcagtttcaggcatcctctgggggtcttagaacatattccccatgggtaaatcgggactactgtattatgtaacagttattgtttaatgctttacatttattaactcaaaaacctcacaactaccttgtgagataagaagtataccttttatccttattttatagatgaagatatagaagcacaaaaaagctacaaacattgccctaaatcacacagccagtaagtgcctgagtccacattcagtgccttcagtttggcctcagtctgtgctcttaaccaggacctgctactgcctcacacacacacagcagtgaaactgcgaaaacactcggatggcttgggaacatcaagcttatgggaatacataacatcaccagcagcatgtcctgaatgaaaaagcagaggggctcaagacagattccaagctcatgcacaagagccgcccatggggcagtgggtgtgggcagagaggaaggagaaaccctgggaaactgtggaaccaaaaacagtagagaaaggaccctcaggaggcagtaaagtgcagcatcaaatgcggctggacatcacagaagatgcgtgtggtgtgatgggctttatctcacctagctcatcgcatcttattttttgagacggagtctcggtctgttacccaggctggagagtagtgacatgattttggctcactgcaacctctgcctcccgggttcaagagattctcccgcctcagcctcctgactagctgggactacaggtgcgtaccaacacgcccggctaatactgtatttttagtagagacgaggtttcaccatgttggccaggctggtctcgaactcctgatctcaggtgatccacccgcctcggcctcccaaagtggtgggattacaggtgtgagccaccatgctcggcctgattttattttttacagcaaagattagccaactgcagcctgcttttgtatggctaaactaaaagtctttttcatatttttagaaggttaaaaaatgtaagaatatgggacagagacagaatgtggcccttacaaaaaagcctgcaggatggcttgtaaccttggcaaaaacagattcaggggaaaaaatggggacaaaagccagactgcaggttactgtggaacataaaaataatgaagcactaaagcagctctttcatgacatccagctatgagacaagagcttcgtggggacaagagcgggggaagaagtttgctggttgtacagatggaagagaggtgagcattgcccaacacaaacaggaagaaacaacaagacagaaggatgaaaatacaggaaagggaggctatgactgaacgaggctcccttatagggaagaaggataccagatccagaacatagacaagaaaggacacctacttttgaggtaacaggaaggcaggaaagggtggctgcagacaaacatctaagtctgcagccatataggtgagaaacatcccagttatggcttcagttttctccaagtcatctgctggttgcaaggcaggagtggcaggatcagggatttaaggaacaggctgaagtctcgaaatgtctgtagtgaaggcagtgtgtgctgactcagtgtttgctctacagaatgcacagcagcctcaaagacccagtcagtgttagagaccacaaaccagacttgcattcacgtggctgcccaccacaagccacaagcattttccagataatggaacatatcaactctgatggacattacaaatcctgatggacattagaaactctgatggacacctaaaatatcttgttgctttcttgccctttgaaaagaacatatttagatagtggttaagcacaggcattggaatcagacctgggttagaactcaagctttgtcacttactagccatgtaacttttgctgaaggaattagaatattaacctcagtgacccatggtagaaaacaggatatcactatctgcctcagttatcatgaggattaaattaaaccagatttataaaatacagtagtctagtgagtggcaagagaaacggctcagtaaatgataactacatcatcatcattattatgagcagcagcagtattttgctacctcaacatgactggtgctggcttagcttagtggcagaatgaagcccggacagatgtcagggcactcccacctccatacaacttccactgtgtcactaaccaagtgaccctggcaggatcccctggatatcaagtttccagtctgcagaatgaggggactggactgcactacacagttcccaaggcttttcccgtctgcatctagggctaacagtgctctgcactgtgaaaataggaactttcaagcaagcacgttcctcgatgtactactttgtggtcaaaaagacttgagtctgaatcctgttcttattgaatgaagatgagttctttaacacttttgagactcggtttcctcatctagaaaagagtaagcgaatcgcaacgaatggtagtgtgatgatttaacacagagcactcagggaggagccgctggctatccctcctctgccgcacctcccagggtaaacgtggggaccagcaccgctcccgggcagacccgcgagcggcccgcacgacgcccgacctgagcctttgctcaaagcagggggccagtccttatgtttctgaacacaaacaaatggagaacaaactgggaccttattaaaaaggcaggctttgggggtgttactgcattgaaaagccctatttaggcttggccctgagaaatttttctcttgggtcacgcatgttcacggtcctcccaggcgaagccgccctggggacgaaaaccgatcacagaggcaaactcaggggcgaataaggaccgcaggacgccaaggaggggcgtggagctgtgggatccgcgcggcccttgggttgccctgcctgcagcgggaatttgtgtgcctcctcgcgggcactgagcggggcgtcccagggggcgttggcttccacccccaccattccccagccggccccgccggtaacgggcttcggcgacggcacccaagcgggtcctcaggagcggccgccgcgcccgggacgccgcagccccagcccaggtgggaggtcggaaatcggcgcggccagctgggcagcggctcagcggggctgggggcgcggggtcaagcctggcagtccggcccggcggaggcgcggctgacagggcagccccccagcccgccgggcctcacctggaagtgctcctgaaagcgaacagggaggatctgcgccatggctggtgcgggacctcggcggcggcggcggcagcggcaggaatgaacgccgacccctcgcgcgggctgaccggt

SEQ ID NO: 218 - DNA, 112253 bp, Homo sapiens; identical to SEQ ID NO: 217
  misc_feature (11154)..(11154): n is a, c, g, or t
  misc_feature (11174)..(11174): n is a, c, g, or t
  misc_feature (11176)..(11178): n is a, c, g, or t
  misc_feature (11180)..(11181): n is a, c, g, or t
  misc_feature (11183)..(11183): n is a, c, g, or t
  misc_feature (11278)..(11278): n is a, c, g, or t
  misc_feature (11282)..(11282): n is a, c, g, or t
  misc_feature (11288)..(11288): n is a, c, g, or t
  misc_feature (11298)..(11298): n is a, c, g, or t
  misc_feature (11325)..(11325): n is a, c, g, or t
  misc_feature (11329)..(11329): n is a, c, g, or t
  misc_feature (12533)..(12533): n is a, c, g, or t
  misc_feature (26940)..(26940): n is a, c, g, or t
  misc_feature (33649)..(33649): n is a, c, g, or t
  misc_feature (33655)..(33655): n is a, c, g, or t
  misc_feature (38411)..(38411): n is a, c, g, or t
  misc_feature (38415)..(38415): n is a, c, g, or t
  misc_feature (38463)..(38463): n is a, c, g, or t
